United States Patent 11,098,302 (IDENTIFICATION OF POLYNUCLEOTIDES ASSOCIATED WITH A SAMPLE) - sequence listing, part 71

SEQ ID NO: 243729 - DNA, 615 bp, Homo sapiens
  misc_feature: GYAE6OF01BLBEU.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaacgataaggacttattagcttggtatcagacaaaaccaggacagcctacctaaactgactcatctccgtgggcatccgtacccgggccacccggacgtccctcgaccgtacttcgagtcggacacggcgggtcgtagggacacgtaccttacacctctaccaccagtacacgaccaaccgtgacgacggtctaggaacgtagtggtcggtacttaagttttacttacgttacgtacgacgtactaaggttagtttaggtagaacgtccgtccgtacttaccggttacgttccggggacgggaccgggtaccggtcgggtacggacgtacgtacggaacgacgggtaacttgggtacggtctacgtaccgacctaagttcttcgtttccttacccg

SEQ ID NO: 243730 - DNA, 544 bp, Homo sapiens
  misc_feature: GYAE6OF01D8ET2.11.11.A11.1.454.CMB.1.raw
  modified_base (208)..(208): a, c, t, g, unknown or other
  misc_feature (208)..(208): n is a, c, g, or t
  modified_base (343)..(343): a, c, t, g, unknown or other
  misc_feature (343)..(343): n is a, c, g, or t
  modified_base (391)..(391): a, c, t, g, unknown or other
  misc_feature (391)..(391): n is a, c, g, or t
tcagcgagagataccacgaccggtgctcgatttagctacgactgcaggggcagcaagatggtgttgtagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagacaaaaaccaggacagcctacctaaactgctcactcctcctgggctatccgtacccgggcacccggacgtccctgaccgtattcgagtgcagcggtntgggacagacttcactctcaccatcagccaactgcaggtctagaagtntgtggtctaagtttactacgtgtacagctagtattgtagacgcctaccgtctcgtaccgtttcgggacgggtacgggaccggtcgggtgggacgtagtacgacggaacgtaacgtggtacgggctcgacctactactctcgttcttctacccg

SEQ ID NO: 243731 - DNA, 725 bp, Homo sapiens
  misc_feature: GYAE6OF01C8V1B.11.11.A11.1.454.CMB.1.raw
  modified_base (666)..(666): a, c, t, g, unknown or other
  misc_feature (666)..(666): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatcgacccacgtccccagatactcctgcctgtgtctcgtggcgaggacggccacatcgagtgacaagtccagcgagtacttacttttatatagtgtacaagtataaggtacttattagtcttggtaatacaacgaacaaaaaccgacggaacacgtaccctaccctaaaacgtcgacttacctacttaccgtaccgtcgggtacctaccgtacccgtacccccgggaccgtaaccccggtaccgttaccccgtacggaacccgtacgttaccgtaggttacggcgtaacggtcggggtacgtacgggaactacgtaccttcacctacctaccaacctagtaccgaacgacccgtaacgtcgtaaccgacggttaaccgaaggtaaaacggtcgtttacgggtaacggtaacctttaaggttttaactttaacggtacttacggaactacgttaagtttaagttaggacgtaacgtccgttacccgtacgttccggttacggttccgggacgggtaccggggtacgacggtaggaccgtaanacgaacggtaaccgtcgtacggcgtagtacgaccgtaacttagtcctacgttcttaccg

SEQ ID NO: 243732 - DNA, 648 bp, Homo sapiens
  misc_feature: GYAE6OF01DTR8E.11.11.A11.1.454.CMB.1.raw
  modified_base (211)..(211): a, c, t, g, unknown or other
  misc_feature (211)..(211): n is a, c, g, or t
  modified_base (263)..(263): a, c, t, g, unknown or other
  misc_feature (263)..(263): n is a, c, g, or t
  modified_base (641)..(641): a, c, t, g, unknown or other
  misc_feature (641)..(641): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtcgtctcgtgggcgagacgggccaccatcgagtgcaagtcagcgagacttcttttaanatagtgtacaacgataaggactatttagcttggtatacagtaacaaaaacgngacacgtcctactaaactgactcactctccgtgggacacgtccgtacccgggcacccggacgtcccgtgaccgtattccgagtggcacggcggtcgtgggacagtacttcactcgtacacaaactcacgctacgccgtagacacgaacgtaggaaacgtaagtcgggttagggttacgttttaagttaacgttgtaactaaacttaacttatttcgttaccgttttggttttaacccggtttaagtttccggggaacgggtaacggtaaccggtaaggttaggaacgtaacgtaaccgtaaacggtacgttagtacggtacgtagaccttaccgtacgttcgttacgttactttacgtaccgttcccttaccccggtntaaccgg

SEQ ID NO: 243733 - DNA, 534 bp, Homo sapiens
  misc_feature: GYAE6OF01BPZKX.11.11.A11.1.454.CMB.1.raw
  modified_base (313)..(313): a, c, t, g, unknown or other
  misc_feature (313)..(313): n is a, c, g, or t
  modified_base (432)..(432): a, c, t, g, unknown or other
  misc_feature (432)..(432): n is a, c, g, or t
  modified_base (516)..(516): a, c, t, g, unknown or other
  misc_feature (516)..(516): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagaggccaccatcgagtgcaagtccagcgagactctttatatagtgtcaacgataaggactatttagcttggtatcagacaaaaaccaggacagcctacctaaactgctcatctcctgggcatcgtacccgggcacccggagtcccngaccattcagtggcagcgggtctgggacagaccttcactctcaccatcacgcaacctgcaggctagaaagatgtggactagtttatactcgtcagctagttacttgtagaagcctccgngttacctacgtttccgggcgggacgggaccgcggtaggaacgtatcgaagtacggaacttcggcggtactcgggaccaaccctnttaccttggtcctttacg

SEQ ID NO: 243734 - DNA, 746 bp, Homo sapiens
  misc_feature: GYAE6OF01BQ7VQ.11.11.A11.1.454.CMB.1.raw
  modified_base (261)..(261): a, c, t, g, unknown or other
  misc_feature (261)..(261): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggagggccaccatcgagtgcaagtccagcgagtacttctttatatagtgtcaacgtataaggtacttattagcttgtatcagacaaaaaccgnggacacgcctacctaaactgactcactctccgtggcctacgtccgtaccccgggaccgacccggtacgtccccgtacgaccgtacttcgaggtcggcgtacggcgggtcgtagggacacgtacttacctaccgtcctacccaacccgtactacgaccgtacctaaccgtcggaccgtacggtccgtaaggaaagttcgttacgggtacgggtacctttaacggttttactttacccgttaggtacctaggtaccttaaggtttagtttacgggtacgaaccggttcccgtcccggtaccgttacccggttaccgggtttccgggggaaccggggtaacccggggtaccggtacggggttacgggtaacgtaaccgttaaccgggaaccgggtaaccggttaaaccggttcggggtaaccgggttccgttaaccccggtaccgtaaccccgttaagtttcccgtttacggtttccccgttaacccg

SEQ ID NO: 243735 - DNA, 704 bp, Homo sapiens
  misc_feature: GYAE6OF01D4RWP.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagtacttcttttatactagtgtacaacgataaggtactatttagcttggtatcagacaaaaaccaggacagtcctacctaaactcgtactctatcgtccgtgggctagtcccgtacccgggaccacccggtacgtccccgtaggacccgtattacgaaggtcgggccgaaggccgggttacgtaggggacctacgtaccgttcaaccgttctacctaacccaagttaccgaacgtaccctaaccgttcggaccggtaacgggtacctaagggtaaacgtaaagttcggtacgggtacttaacggttttacttacgtagtaccgtaggtaccgtaaggtttaacttgggtacgtaacggtccctccggtacttaccggttaccggtttaccggggacggtaaccggggccggtacgggtagaacggtacgtaccggtaacgtaaccgggtaacgttgggtcggtcccgtacggtaccaccccttaaagttcccgttcgttccgttaccg

SEQ ID NO: 243736 - DNA, 716 bp, Homo sapiens
  misc_feature: GYAE6OF01AKSO3.11.11.A11.1.454.CMB.1.raw
  modified_base (363)..(363): a, c, t, g, unknown or other
  misc_feature (363)..(363): n is a, c, g, or t
tcagcgagagataccacgaccggtgctcgatttagctacgactgcagggcagcaagatggtgttgcagacccaggtcttcatttctctgttgctctggatctctggtgcctgtgggacatcctgatgacccagtccccagatatcctgcctgtgtctcgtgggcgagagggcccaccaatcgagtcgcaagtccagcgagacttcttttatatagtgtacaacgataaggacttagtttagctttaggtatcagaccaaaaaccaggacacgcctacctaaactcgctacatcctccgtcggcctacgtcctacccgggaccacccgggtactccccgttcgaaccgtacttcgagtcggcgnggcgggtcgtcgggactacgtacttcgacctctaccaactataccgacaccgaacctgaccgaacggtcgtaggaaagtacggttacggtacgggtacctttaagtttttacttaaaccgtggttaacctaggtaacccttaagggttttaacttacgggtttaacgaaccgttccccgttacccgtacccttaccgttacccgggttttaccgggggccggggtaagggtcccccggtggggtacggaccggtaaacgttcccggaaacggtaacccggtaaccggttgtaaccgggccttaaccgggaccctaaaccccgttagtttacccgttgttaaaccctttcccgg

SEQ ID NO: 243737 - DNA, 694 bp, Homo sapiens
  misc_feature: GYAE6OF01EVQNK.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctctggcgagagggccacatcgagtgcaagtccagcgagacttctttatatagtgtacaacgataaggactatttagcttggtatcagacaaaacagacagcctacctaaactgctacatcctccgtgggcactccgtacccgggccacccggacgtccctgaccgtattcaggtcgcgaggcgggtcgtgggacgagtacttcgtacctcctaccgacctactacacgtaccaaccgtgaccgtacgggtccttaggaacgtagttagggtacggtacgttaacgttttaacttacgttcgtaccgtaaggtccgttaaggtttaacgtttcgggtaacggtaaacggttccccgttcccggaccgttttacccgttaacccgggttttaccgggggaacccggggtaaccgggggtacccgggtaccggggtacgggtaacggacgttaaccggaaacggtaaccggtaaacggttcggggtaccggtccgtaccggacctaaccgtacgtttcgttaccgtttcgttttaccccg

SEQ ID NO: 243738 - DNA, 787 bp, Homo sapiens
  misc_feature: GYAE6OF01BL8Z7.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccagtcccagatatcctgcctgtgtctcgtgggcgaggacgggccacctatcgagtgacaagtccagcgagtacttacttttatatagtcgtacaacgtaagtaaggtacttaagtttagtcgttaggtatacgaacgaaccaaaaaccgaggaacacgtacctaacctaaacgtcgtacctacgtactccgtccggtcgggacctaaccgtaccccggtaccccggggacccgaaccccgggtaccgtccccgtacggaacccgtagttaccgtaaggtcggacggacggtccggggtcgtacgggactaacgtaccttccgtaacctcctacaaccctactaccgaacaccgtaaccgtgaccgacggacgtaaggaacgtagttcgggtacgtaacgtttaggttttaaccttcggttacgtaccgaaggttccgtaaggttttacgttagtaaccggtaaccgttcccggttaacccggtcctttaaccgggtttacccgggtttacggggggacccgggtaaccggggtaccggggttccggggtaagggtaaccggtaacggtaacccggaacgggttaaccgtaaccgggttgggtacccgacgtacgtacccgtaaccgttagttcccttccggttaccttacccg

SEQ ID NO: 243739 - DNA, 628 bp, Homo sapiens
  misc_feature: GYAE6OF01EJ37O.11.11.A11.1.454.CMB.1.raw
  modified_base (287)..(287): a, c, t, g, unknown or other
  misc_feature (287)..(287): n is a, c, g, or t
  modified_base (397)..(397): a, c, t, g, unknown or other
  misc_feature (397)..(397): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtggcgagacggccaccatcgagtgcaacgtccagcgagtacttctttatagtagtgtacaacgtataaggtacttagtttagcttggtatacagaacaaaaccgagacacgcctactaaactgctcnctctccgtcggacacgtcccgtacccggaccgcccggtactcccgtcgaccgtattcgagtcggcacggcggtcgtagggacacgtaccttccgactcctaccgacctancganacctaacgtgacacggntagaacgtnttcggcgtacttaagtttactcgtgtacagtacctagtttactggtacgtaccgtcctcccgtcgtaccgttaccggtttccggggaacgggtaccgggacgggtacggtaaggtacgtaacgtacgaacgggtaacgtacggttccggttacgtacgtaccggacctacccgttagtttccggttcgtttcccgtacccg

SEQ ID NO: 243740 - DNA, 686 bp, Homo sapiens
  misc_feature: GYAE6OF01A54JS.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagacgggccaccatcgagtgcaagtccagcgagacttcttttatatagtgtacaacgataaggactatttagcttggtatcagacaaaaaccgagacacgcctacctaaactgctcatctccgtgggcactccgtacccgggccacccggtactccccgtgaccgtattccgaggtcggacgacggcgggtcgtaggggaccaggtacctttcaccttcctaccaacctactacgacgacctaacccgtgaccgaggtctaggaacgtgtcggtacggactttagttttacttaacgttcggtacaagtcgtaagttagttacggtacgaacgtcccgttccgtaccgtccgttaaccgggtttccggggaccggggtaaccggggtcccgggtacggggtacgggtaacgtacggtaccggaaacggtaccggtaaacgggtttgggtacccgggtaccgttaccggtaaccctaacccgttaaccgtttccggtttaccggttccctttaaccccgg

SEQ ID NO: 243741 - DNA, 733 bp, Homo sapiens
  misc_feature: GYAE6OF01DE042.11.11.A11.1.454.CMB.1.raw
  modified_base (227)..(227): a, c, t, g, unknown or other
  misc_feature (227)..(227): n is a, c, g, or t
  modified_base (391)..(391): a, c, t, g, unknown or other
  misc_feature (391)..(391): n is a, c, g, or t
tcagcgagagataccacgaccggtgctcgatttagctacgactgcaggggcagcaagatggtgttgcagacccaggtcttcatttctctgttgctctggatctctggtgcctggtgggacatcctgatcgacccacgtccccagatatcctgcctgtcgttctcgtgggcggaggacgggacccaccagtcggagtgaccaagtccgagcgacgtacttacttttanagtagtgtacaacgtaagtaacggtacttagtttagtctttaggtactacgaagaaccaaaaaccgacggacacgtacctaccgtaaactcgcctactactcctcgtcggaccacgtcccgacccggaccgacccggtaccgtcccgtcgtaccgtacttacgnggtcggacgtacggtcgggtacgtacgggaccgacgtaccgttctaccgtcctacaccactaccgacgaccgtacgtcgacggacggactaggtaacgtgttcgggtacgtacgtttacgttttactacgttcgtaccgaggttacgtagttacgttaggttaccgaaccgttcccgttacgtcctttaccgggttacgggtttaccggggaccggggacggggtacccgggtacgggtaacgggtacgttaaccggtaccggaaacgggttaacgacgggtttggggaccgtccgtaacccgtaccgtacccgttgttcccttaccggttccttaaccccg

SEQ ID NO: 243742 - DNA, 777 bp, Homo sapiens
  misc_feature: GYAE6OF01EOH1O.11.11.A11.1.454.CMB.1.raw
  modified_base (211)..(211): a, c, t, g, unknown or other
  misc_feature (211)..(211): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgtgtctcgtgggcgagacggccaccatcgagtgcaagtccagcgagtacttctttanatagtgtacaacgtataaggtacttattacgcttaggtatacgaacgacaaaaaccgaggtacacgtacctacctaaactcgtactactactcgtccgtacgggacctacgttaccggtaccccgggaccgtacccgggtaccgttcccctacggtaccgtacgttcgtacggtcggaccgtacggtccggggttacgtacggggaacctacggtaccttaccgtacccgtactaccgaccctagtaccgaacgtaccctaaaccgtgaccgtaacgggtcctaagggaacttacggttggttaaccggtacgtttaacgtttttaacgttaacggttccgtaacgtaacgttacggttaacggtttaacgttcggtaacggtaaccggtaccttacccgggtacttacccggttaccgggttttaccgggggaacggggtaaccggggtaccgggtacggggtaacgggttaaccgtacggtaaccggaacgggtaaccgttaggtcgggttaccggaacccgtacgtacccgacgttacgtaccgtttcgtaaccgtttacccg

SEQ ID NO: 243743 - DNA, 759 bp, Homo sapiens
  misc_feature: GYAE6OF01EE1G1.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatgacccacgtcccagatatcctgcctgtgtctcgtgggcgagacgggccacatcgagtcgcaagtccagcgagtacttacttttatatagtgtacgaacgtaagtaaggtactttatttagcgttaggtatacaacgaaccaaaaaaccgacggaaccacgtaccctaacctaaactcgctacactctccgtgggacctacgtaccgtaccccggccgtacccggacgtccccgtacgaccgtacgttcgtacgtcggaccgtacggtccgggtacggtacgggactaacgtacccgttcctaccttccgtacctacctaacgtaccaaccgtaccgtaaacccgttcgaccggtaaccggacgtaacgggaaagttacggttcgggtacggttacgtttaaggttttaacctttacgttacggttaccgtaacgtaccgtttaaggtttagtttaggtacgtaacgttcccgtaccggttccgtaccgtttaccgggttaccggggccggggtaaccgggtcccgggtacgggtaaggtaacgtaccgtaacggtaaccggtaacgggtacggttgggttaccggtagtacccggtacctaccgtacttccgtttcgttcccttaacccg

SEQ ID NO: 243744 - DNA, 650 bp, Homo sapiens
  misc_feature: GYAE6OF01ART8T.11.11.A11.1.454.CMB.1.raw
  modified_base (277)..(277): a, c, t, g, unknown or other
  misc_feature (277)..(277): n is a, c, g, or t
  modified_base (386)..(386): a, c, t, g, unknown or other
  misc_feature (386)..(386): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagtactcttttatatagtgtacaacgataaggactatttagcttggtatcagacaaaaaccaggacagcctacctaaacncgtctcactcctccgtggcactaccgtacccgggaccgacccggacgtcccgtcgaccgtactacgtaggtcggcgacggtcgggtcgtcgggacgacgtaccttaccnctcctaccaccatcacgacctaaccgtcgaccgaggtaccgtaggtaacgtagttagggtacggtacgtttaacgtttacgttacgttacggttacgacgtaccgttaaggttacgttggtaacgtacgtcccgtaccgtccttaccgtaccggtttcggggacggggtaccgggtaccgggtgggtaggaacgtacgtaccgtacggaaccggtacgtgggtccgtagtacggaccctagtacttccgttcgttccttacccg

SEQ ID NO: 243745 - DNA, 623 bp, Homo sapiens
  misc_feature: GYAE6OF01BVDTD.11.11.A11.1.454.CMB.1.raw
  modified_base (211)..(211): a, c, t, g, unknown or other
  misc_feature (211)..(211): n is a, c, g, or t
  modified_base (442)..(442): a, c, t, g, unknown or other
  misc_feature (442)..(442): n is a, c, g, or t
tcagcgagagataccacgaccggtgctcgatttagctacgactgcaggggcagcaagatggtgttgcagacccgaggtcttcatttctctcgttgctctggatctctggtgcctgtgggacatcctgatgacccagtcccagatatcctgcctgtgtctcgtgggcgagagggccaccatcgagtgcaagtccagcgagtacttcttttanatagtgtacaacgataaggacttattagcttggtatcagacaaaaaccaggacacgcctacctaaactgctcactctccgtgggcactccgtacccgggcacccggacgtccctgaccgtattccaggtcggcaggccgggtcgtggggacaggtacttcactctcacctaagtcagaccaccgtgcgaggctagaacgtgtggtgacttagtttatacgtgtacgacgtntagttattgtagaacgtcctaccgtccttaccgtaccggttttaccgggacgggtacggggtacccgtcgggggttaagacgtaacgttaccgaaacgggtaaccggtaacggtcgggttaccgacggtttccggacccgaaaccgttacgttccgtttaccggtttcccgtttaaccccg

SEQ ID NO: 243746 - DNA, 638 bp, Homo sapiens
  misc_feature: GYAE6OF01D1WBY.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatccgtgcctgtcgcctcgtgggcgagacgggccaccagtcgagtgacaagtccagcgagtacttcttttatagtagtgtaccaaacgtagtaaggacttatttagcttaggtatcgaagaaccaaaaaccgaggacacgacctacctaactgctcatctccgtggacactccgtacccggcacccggactcccgtagaccgtatcgagtggcgaggcggtcgagggacagtccttcactcacaccatacacgaccacctgacgacggctagaagtgtggtcgtacttaggtttacttacgtcgtacgacgtcgtagtttagtggtagtaaccgtccgtaccgtacgttaccgttaccggtttccggggaccggggtacgggtcccgggtacggggtaggaccggtactaccgggaaacggttaccggtaaggttccgggagtacccggtacgaacccaaccgttacgtttcccgtacgttcccgtttaacccg

SEQ ID NO: 243747 - DNA, 657 bp, Homo sapiens
  misc_feature: GYAE6OF01C3U5P.11.11.A11.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (430)..(430): a, c, t, g, unknown or other
  misc_feature (430)..(430): n is a, c, g, or t
tcagcgagagataccacgaccggtgctcgatttagctacgactgcaggggcagcaagatggtgttgcagacccaggtcttcatttctctgttgctctggatctctggtgcctggtgggacatcctgatcgacccagtcccagatatcctgcctgtgtctcgtaggcgagacggccacatcgagtgcaagtccagcganacttntttanatagtcgtacaacgataaggacttagtttagcttaggtactacgacgacaaaaaccgagtacacgcctacctaaactcgactacaacgtcctccgtacggctacgtaccgttaccccgggccgtaacccggtacgtccctacggaccgtacttacgacggtcggacaaggtccgggttacgacggggtaacaggtaccttcacgttctaccactataccganacctaacgtgacgtagccgtagaacgtatacggtggtacctaaggtttaactacgtacgtactaaggtacgtaagttgttacgagtaaccgaccgttaccgaccgttaccgtaccggtttcgggaccgggtaacgggtcccggtaggttacggagaacgttccgaaaggtacgaacggtttcggacggttcacggtacctacgactttccgttagtcctttacccgg

SEQ ID NO: 243748 - DNA, 762 bp, Homo sapiens
  misc_feature: GYAE6OF01EKJ83.11.11.A11.1.454.CMB.1.raw
tcagcgagagataccacgaccggtgctcgatttagctacgactgcagggcagcaagatggtgttgcagacccaggtcttcatttctctgttgctctggatctctggtgcctggtgggacatcctgatcgacccacgtccccagatatcctgcctgtcgtctcgtgggcgagacggccacagtcgagtcgacaacgtccgagcgagtacttctttatatgtgtacaacgataaggacttagtttagcgttaggtatacgaagaaccgaaaaaccgaggaacaccgtacctaacccgtaaaactcgaccctacgtacttccgtaccgtgggacctaaccgttacccggtacccccggggaccgtaccccgggaccgttaccccgtacggaacccgttacttacggagggtccgacggacggtccgggtcgtacgggaacctacggtaccttaccgtacctctaccaccgtacgtaccgacgaccctaccgtacgccgtaagtaccgtaggtaacgtaaggttcggtacggtaactttaaggttttaaccttacggttacgttaacgacgtttaaccgtaggttttaacgttacggtaacgtaaccgttcccgttacccgtacccggtttaccgtttaacccgggttcgggaaccgggggtaccggtaccggggtaggtaaggtacggtaacgtaccggaaacggttaccgtaaggttccggtaggtacctacgtacctacgttacgttccgttctccgttaccg

SEQ ID NO: 243749 - DNA, 591 bp, Homo sapiens
  misc_feature: GYAE6OF01DXXNG.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggactatttagcttggtatcagaccaaaaaccaggacacgcctacctaaactgctcatctccgtggcactccgacccgggccacccggacgtccctacgaccgattcgagtggacgacgcgggtctgggacagtactcactctcaccatcagccaacctgcgaggctaggaagtcgtgtacggtacttagttttacttacgttgtaccagtactaagttattacgtagtaagtccgtcccgtaccgttacgtaccggtttcgggacggggtacgggacccggtcgggtacggacgtacgtacggaacggtaacgtaacggtgggtacggaccgtacgtccgtaactacttcgttcgttcttacccg

SEQ ID NO: 243750 - DNA, 769 bp, Homo sapiens
  misc_feature: GYAE6OF01C0GAZ.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtcccagatactcctgcctgtgtctcgtggcgaggacggccacagtcgagtgacaacgtccagacgacgtacttctttaatagtagtgtaacaacgaagttaagacttagtttagtcgttaggtactacgaacgaaccaaaaaccgaggaacaccgtaccctaacctaaactcgacctactactcctccgtacggtacctaccgttcccggacccgggacccgacccggtaccgtcccgtacggaccgtagtacgacggtggaccgtacgggccggtacgtcgggaactacggtaccctttaccgaccttacctaccctaaccctacgacccgtaaccggacccgtaaaccgtccgaaccggtacggaccgtttaacggaaacggttcgttaccggggttacgttaacgttttaacggttttaaccgtttaaccggaccgttaaccgtaagtaaccggtttaaagttttacggtacggtaacgggtaacccgttcccgttaccccgtaaccgtttaccggttaaccggggttcggggaaccgggttacgggacccgggtgggtaacgacgtacgtacggaacggtacggtacgtcggaggtactacgacctcagtttcgacgttccgtcccg

SEQ ID NO: 243751 - DNA, 857 bp, Homo sapiens
  misc_feature: GYAE6OF01CBFDF.11.11.A11.1.454.CMB.1.raw
tcagcgagagataccacgaccggtgctcgatttagctacgactgcagggcagcaagatggtgttgcagacccaggtcttcatttctctgttgctctggatctctggtgcctggtgggacatcctgatcgacccacgtcccagatactcctgtcctgtgtctcgtgggcgaggacggaccaccgagtcggagtcgacaacgtccgagcgacgtactttacttttaatagtaggtagtacgaaacgtaagttaaggtaacttaacgtttagtcgttaggtacgtacgaaacgaaaccgaaaacgacggaacgacgtaccctacctaaacgtcgtactactacttccgtaccgtacggtacctaaccgttacccggtaacccgggacccgtaaccccggtaccggttaccccgtaacggtaacccgttacgttacggaacggtcgggtaccggacgggttccggggtacggttaacggggactaaaccgttaccgttaccaccgttacccgtaccgtaacccgtacgttaaccgaacgtaacccgtaaccgttcggaccgaacgggttaccgtaaggtaaaccgtgggttttaccggtacgggtttaaacctttacggtttaacgttaaccgggttacgtaacgttaacgtacgggttttaaattacgggttacgtacgtaacgttccccgttaccggttaccgttacccgttaccggggttaccggggaacccgggtaccgggtaaccgggtaggggtacgtacggtaaccgttacggaaaccgggtaacccgttacggtcggggtacctaccgtaacggtaccctaacgttcgttccgtttcgttaccccttaaccgg

SEQ ID NO: 243752 - DNA, 681 bp, Homo sapiens
  misc_feature: GYAE6OF01E0ANO.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggacttatttagcttggtatcagacaaaaaccgaggacagcctacctaaactcgctcactctccgtggcactccgtaccccgggccgacccgggtacgtcccgtcgaccgtacttcgaggtcggcgaggccgggtcgtcgggacacgtacttcacctctaccacctactaccgacgaccaaccgtgacgtacggctaggaacgtagttgtcggtacttaacggttttacttacgtacgtacgtacgtacgttagttacgtttcggtacgtaacgtccgtcccgtacgttaccgttacccggtttacggggacgggtaacccgggggtacccgggtacgggggttacgggtaaccggtaacgttaaccgggaacgggttaaccgtacgggttgggttaccgggcccgtacggtaacccctaccgttaacgtttccggttcgtttaccccgttacccg

SEQ ID NO: 243753 - DNA, 837 bp, Homo sapiens
  misc_feature: GYAE6OF01DD69E.11.11.A11.1.454.CMB.1.raw
tcagcgagagataccacgaccggtgctcgatttagctacgactgcaggggcagcaagatggtgttgcagacccaggtcttcatttctctgttgctctggatctctggtgctgtggggacatcctgatcgacccacgtcccagatactcctgcctgtgtctctgggcgagagggccaccatcgagtgacaacgtccagcgaagtacttcttttatatagtgtacaaacgtataaaggtacttaatttagtccttaggtatacaacgaacaaaaaccgaggaacacgtacctaacctaaactcgacctactacgttacctccggtacggacctacgtacccggtaccccggggccgaaccccggtaccggttccccctacggaaccgtacttacgacggtcggaccgtacgggtccggggtcggtacggggaacctaacggtacccttacctaccttaccctaccctaaaccgtaactacgtaaccgaccctaaccgtacggacccggtacgggtaccgttaagggaaacgtacggttaggtacgggttaactttacgggtttttaacttacggttacggtaccgtaggtaaccggttaaggttaacggtttgggttaaccgtaacggttcccggttacccgttaccgttaccggtttaccgggtttacgggggaaccggggttacgggggtacccgggaacggggtttacgggaccgtttaaacggaccggtaaaccgggtaaccgggttaacgggttcgggttaccgggttaccgaacccgttaccgtaaaccccgtttaggtttaacccggtttcgttttaccccggtttaaaccc

SEQ ID NO: 243754 - DNA, 653 bp, Homo sapiens
  misc_feature: GYAE6OF01EWU7P.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgtgtctcgtgggcgagagggccaccatcgagtgcaagtccagcgagtactttcttttatatagtgtacaaacgataaggtacttatttagcttaggtatcagaacaaaaaccgaggacacgcctacctaactgctctactctccgtggctacgtccgtaccccgggccgacccggacgtccctacgaccgtacttacgaggtcggacgaggtccgggtgtacgggaactacgtaccttcgtacctcctaccacctagtcctaacgtaccaacgttcgacgacggtactaggaagtcgtggtacgtatttagtttacttagtcgtacgtacgagtatttacgtgtagaaccgtccgttccgtaccgtacgttccggtttccggggacggaccggggtaccgggtacgggtagggtacgtacgtacggtaaacgggtacgtaacggttcgggccgtaccgtacgtccgtaaccccgttagtaccgttcgttaccttacccg

SEQ ID NO: 243755 - DNA, 622 bp, Homo sapiens
  misc_feature: GYAE6OF01E2LG7.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcagtccagcgagacttcttttatatagtgtcaacgataaggacttatttagcttggtatcagacaaaaaccaggacagcctactaaactgctcatcctccgtggcagtccgtacccggggccaccccgggtactccccgtagacccgtattcgaggtcggcaggccgggtctacggggacaggtacttcacctctccaccactcgacgaccaacctgcaggctagaacgtatggtggtactaaggtttactacgtgtacgagtacgtagttacttggtacgtaacgtcctaccgtcttaccgttacgtttaccggggacgggacggggtacccggtgggtacggtaacgtacgtacggaacggtaaccggtaaacggttcgggttcgggacctacgggtacctaacccgttagtttcccgttggttacctttaccgg

SEQ ID NO: 243756 - DNA, 718 bp, Homo sapiens
  misc_feature: GYAE6OF01DOIIX.11.11.A11.1.454.CMB.1.raw
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagtatactcctcgcctgtcgtcgtcggtgggcgaggacgggcccaccagtcggagtcgacaacggtccagacgagtacttctttanatagtntacgaacgtataaggtacttagtttacgcgttaggtactacgaacgaaaccgaaaaaccgaggaaccacgtcccttaacctaaacgtctacctaccacgttccgtccggtacgggacctaccgtacccggtaccccgggaccgtaccccggtaccgttccccgtacgaccgttacgttacggacgtacggccgtacgggccgggttacgtacggactacgtaccctcgactaccacacctcgtacgactaccgacctgcgtaggcgtaacggtagtgtacgtgtacttaagtttactgtacgtacgagaacgttagttcgtacgtaagccgttaccgtccgtccttaaccggttccggtacggggaaccggacgggtacccgggtggacggtaatacccggtacgtaacggggtactaacggtccggacgttaccggaccgtaacccttacgtaccgtttcccgtttcgttacccgtaccccg

SEQ ID NO: 243757 - DNA, 531 bp, Homo sapiens
  misc_feature: GYAE6OF01BEQI3.11.11.A11.1.454.CMB.1.raw
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (370)..(370): a, c, t, g, unknown or other
  misc_feature (370)..(370): n is a, c, g, or t
  modified_base (380)..(381): a, c, t, g, unknown or other
  misc_feature (380)..(381): n is a, c, g, or t
  modified_base (386)..(386): a, c, t, g, unknown or other
  misc_feature (386)..(386): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (452)..(452): a, c, t, g, unknown or other
  misc_feature (452)..(452): n is a, c, g, or t
tcagcgagagataccacgaccggtgctcgatttagctacgactgcaggggcaacaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctggcactccgtaccccgggcacccggcgtccctgaccgattccgagtggcaggcgggtctgggacagacttcactcncaccntcancactgcaggnngaagntgtggtctagtttactacngtcagntagtntgnganctcgctactacgttcgggcggagggcccgngggtagacgtacgtcgaacggtaccgaagttgggtcggacgtcgaccgtacctacgttcgtacgttccgttcttacccg

SEQ ID NO: 243758 - DNA, 677 bp, Homo sapiens
  misc_feature: GYAE6OF01CLT8Q.11.11.A11.1.454.CMB.1.raw
  modified_base (426)..(426): a, c, t, g, unknown or other
  misc_feature (426)..(426): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatcgacccacgtccccagatatcctgcctgtgtctcgtgggcgagagggccaccatcgagtgacaagtccagcgagtacttacttttatatagtcgtacaaacgtaataaggacttagtttagcgttaggtactacgaagtaaccaaaaaccaggaacacgaccttaacctaaactgtcctcatcctccgtgggccacgtccgtaccccgggccgacccgggacgtccctacgacccgtattccgaggtcggcgacggtcgggtacgtgggaacacgtacctcaactccgtaccaacctntaccagaccctaaccgtcgccgtaggtaccgtagaaacggtgtggtacgtactttaggttttaacctacgttacgtaccagtctaaggtttattaggtgaactccgtaccgtccgtacttaccgggttcgggaccggggtaggtaacccggtcgggggtacgaacggaacgttacggtaacggtaagtaaccggttggacggttaccgtcgtaacccggaccttacgtttacgtccgtttacgttaccccg

SEQ ID NO: 243759 - DNA, 626 bp, Homo sapiens
  misc_feature: GYAE6OF01AOZ6I.11.11.A11.1.454.CMB.1.raw
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (258)..(258): a, c, t, g, unknown or other
  misc_feature (258)..(258): n is a, c, g, or t
  modified_base (291)..(291): a, c, t, g, unknown or other
  misc_feature (291)..(291): n is a, c, g, or t
tcagcgagagataccacgaccggtgctcgatttagctacgactgcagggcagcaagatggtgttgcagacccaggtcttcatttctctgttgctctggatctctggtgcctgtgggacatcctgatgacccagtccccagatatcctgcctgtgtctcgtggggcgagagggccaccatcgagtgcaagtccagcganactnttttanatagtgtcaacgataaggacttatttagctttggtatcagacaaaaaccnggacagtcctacctaaactgctctactctccgngggtcaacttccgtaccccgggcaccccggacgtccccgtgaccgattcgagtcggcgaggccgggtctaggggaccaagtcttcaccttcgtccaacccatccgaacgtaccaacccgttgaccgaaggtccgtaggaacgtagttggtacggtctaacggtttattacgtcgttacgagctagttacttagacgtaacggtcctaccggctaccgtaccgtttcggaccgggacggtaccggtggtacggaacgtagtaccgtaggaacccgtaaggtcggttacgggacttcggacccgttacccaagttcccgttacggttcctttaccgg

SEQ ID NO: 243760 - DNA, 783 bp, Homo sapiens
  misc_feature: GYAE6OF01C9FJR.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatatcctgcctgtcgtctcgtgggcgaggacgggccaccagtcgagtgacaacgtccacgcgacgtacttacttttatatagtcgtaacaacgtaagtaacggtacttaagtttagtacgttaggttaactacgaacgaaccaaaaaaccgacggaacacgtacctaaccctaaactcgtactactactccgtaccgtcgggtacctaccgtacccggtaaccccgggacccgtaaccccgggtccggtaccccgtacggtaacccgtacgttacgacggttacggacggacgggtccggggtacgtacggggaaccgtacgtaaccgttacctacctacctaccaacccctagttacccgaaccgtaaccgtaacccgtacgaccgaaccggtacgtaacggaaaggtacgttacggtacggttaacttagtttaacttacgtccgtaacgacgtacgttaaggtagttacggaacggtaccgtccgttacccggtaccgttaccgttaccgggttaccgggacggggtaccggggtacccggtagggtacgtaacggtacgtaaccgtaaggtaccggtaacggttcgacgggtcctacggacctaaccgtacgttccgtccgtttaccttacccg

SEQ ID NO: 243761 - DNA, 656 bp, Homo sapiens
  misc_feature: GYAE6OF01D7XT3.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgtgtctcgtgggcgagacgggccaccatcgagtgcaagtccagcgagacttcttttatattagtgtacaaacgataacggtacttagtttagtcgttggtactacaagaaccaaaaaccgaggaacacgaccctacctaaactcgctactactcctccgtggactacgtccgtacccggccgacccggacgtacctcgaccgtactacgaggtcggcgacggcgggtcgtacgggaactacgactttccgacttcctaccgtacctactacgacgtaccgaaccgtcgaccgtacggtactacgggtaaagtagttcgggtagttaccgttaagttttactacgttgtacgtaggtactaaggttacgttgtaacggtcgtccgtcccgtagttacccgttacggtttccgggacgggtaccggggtaccgaggggtaggtacgacgttcggaacggtaacgtacgtggtacgctcggacctacgtattcgtcgttctaccg

SEQ ID NO: 243762 - DNA, 686 bp, Homo sapiens
  misc_feature: GYAE6OF01BBED6.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatactcctgcctgtgtctcgtgggcgagagggccaccatcgagtgcaagtccagcgagacttcttttatatagtgtacaacgataaggacttagtttagcttggtatcagacaaaaaccaggacagcctacctaaactgctcactctccgtggccacgtccgtacccgggccgaccccgggtacgtcccctacggaccgtacttaccgacggtcggcgacgggtccgggtcggtacgggaaccgtacggtaccttaccgaaccttcctacccaaccacgtaccgacgaccgtaacccgtgaccggtacggtaccgtaaggaagtacgtagggtacgttacgtttacggtttacttacgtacgtacgtagtacgtaagtttagttacgtacggtacgtcccgtccgtcttaccggttaccgggttccggggaccgggtacgggtaccggtggggtacgtaaggtacgtaaccggaacgtacggtaaccggtgggtacggtccgaccggtaccgtaaccttcgtacgtttccggttccttacccg

SEQ ID NO: 243763 - DNA, 734 bp, Homo sapiens
  misc_feature: GYAE6OF01B0I75.11.11.A11.1.454.CMB.1.raw
  modified_base (170)..(170): a, c, t, g, unknown or other
  misc_feature (170)..(170): n is a, c, g, or t
tcagcgagagataccacgaccggtgctcgatttagctacgactgcagggcagcaagatggtgttgcagacccaggtcttcatttctctgttgctctggatctctggtcgcctggtcggggactatcctgactcgacccacgtcccagatactcctgcctgtcgtcgtcgngggacgaggacggccacagtcgagtgacgaacgtcgagcgagtactttattttagtagtagtacgtaacgaaacgtaagttaaggtacttagtttacgtacgtttaggtaactacgaacgaaaccaaaaacggacggaacctaccgtacccttaaccgtaaactcgtacctactacgttccgtccgtcggactaccgtacccgacccgggaccgtacccggtcgtacccgacgtaccgtacgttacgacggtcggacggtacggtcggtacggtacggaacgtcgtacctcctaccgtctacccacctacaccgactaacccgtacgtgaccgacggtacgtaagagtaggtggtacgtaacgtttaaggtttacctacggttacacgtaggtaacgttacgttaggtacgtaacggtacgtcccgttaccgttacccgtccgggttacccggtacggggtaccggggacggtaccggtacgggtacgaccgtaacgccggaaacggtacgtacggttcggtaccggattacccgacttctacgtacttccgttaccgttaccg

SEQ ID NO: 243764 - DNA, 811 bp, Homo sapiens
  misc_feature: GYAE6OF01CKBMV.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgaggacgggccaccatcgagtcgacaacgtccagcgaagtactttacttttaatatagttgtaccaacgaagtaaaggtacttaagtttagcgttggtaactacaacgaaaccaaaaaccgaaggaaccaacgtacccttaacctaaaactcgtcctacctacttcctccggtacggacctacgtaccccggtaccccgggaccgtaaccccgggaccgttcccctacgtaccgtacgttaccgacgggtacggaccggacgggtccggggttacggtacggggaacctaacggtaccgttacctaaccgttacctacccaacctactaccgacgtaccctaaacgttcgacgacggacgtaagaacggtagttgggtacggttacgtttaaggttttacttacgtcgtacgtaacgtaccttaaggtttagtttggaacggtaaccgttcccggttaccccgttaccttaccggggtttaacccgggttacgggggaacccgggggtacgggggtacccggtacggggggttaagaaccggttaagtaacccgggtaacgggaaaccggttaacgggtcgggtaaccgggttccaccggtaaaccccacgtttaccgtttcgttccgttaacccgtttacccg

SEQ ID NO: 243765 - DNA, 781 bp, Homo sapiens
  misc_feature: GYAE6OF01BF9UI.11.11.A11.1.454.CMB.1.raw
tcagcgagagataccacgaccggtgctcgatttagctacgactgcagggcagcaagatggtgttgcagacccaggtcttcatttctctgttgctctggatctctggtgcctggtgggacagtcctgatcgacccacgtcccagtatactcctcgcctgtcgtctcgtgggcgagacggcccacacgtcgagtcgactaacgtccgacggacgacgtactttacttttatagttacgtacgtacgaaacgtaataacggtactttagttagtcgttagtacgtacgtaacgaaacctaaaaaccgagaacctaaccgtacctaaccgtaaactcgtaccttactacttccgtccgttacgggacctacgttaccccgggtacccgggtacccgtacccgggtaccgttaccccgtaccgtaaccgttacgttaccggtacgggttacggaccggtacgggtccgggtacggtaccgggtacgtaaccgtccttaaccgacctccctacctaacccgtacgtaccaacgtacccgtaccggacgacggtaaccgtcgtaaacggtaacgtagtcggggttaacgttagtttaaccgttttacgttacgtcggtaccttaacgtacggttacgtagttacggtaacgtacttacccggtctaccggttacgttaccgggttacgggacgggaccggttaccggagggtcgtaacggacgttacggaacgtaccgttggtacgacgggtcacggtaccctaagttccgtcttcgttcttaccccg

SEQ ID NO: 243766 - DNA, 620 bp, Homo sapiens
  misc_feature: GYAE6OF01AI369.11.11.A11.1.454.CMB.1.raw
  modified_base (450)..(450): a, c, t, g, unknown or other
  misc_feature (450)..(450): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagtacttcttttatatagtgtacaacgataaggactatttagcttagtatcagacaaaaccgaggaacacgacctacctaaactcgctcactcctccgtgggacctactcccggtaccccgggaccgaaccccgggacgttaccccctacggacccgtactttacgacggtcggacgacggtcgggtcgtacggggacacggtacttcgactcctaccacctatacacgaccctaactgacaggtctagaagtntaggtggtacttagtttattacgtgtacagtacgtagttattaggagtactcgtcccgtacgtccgttaccggttcgggaccgggacgggtaccggtgggacggtacgtagtacgaaggtaccgagttcggcggtacgtcggacctacgtacttcgttgttccttacccg

SEQ ID NO: 243767 - DNA, 755 bp, Homo sapiens
  misc_feature: GYAE6OF01CBPHJ.11.11.A11.1.454.CMB.1.raw
tcagcgagagataccacgaccggtgctcgatttagctacgactgcaggggcagcaagatggtgttgcagacccaggtcttcatttctctgttgctctggatctctggtcgccgtggtggggacatcctgactcgacccacgtcccagatactcctgcctgtctctcgtgggcgaggcggccacctagtcgagtcgacgtaacgtccaggacgagtactttactttatagtagtcgtacaaacgtaagtaaggtacttagttagtcgttagtactacgaacgaaaccaaaaaccgaggacctaccgtaccctaacctaaactcgtcctacacttccgtccgtacggcctacgtacccggacccggcccgtaccggtcctcccgtacgaccgtacgtcgaggtcgacgtcggccggtacgtacggacctacgtacctccgtactcctaccaacgtactaccgacgtaccgtaacgtcggaccgtaacggtcgtaacggaacggttcgttacgggtacggttaacgtttaacgttttaaccgttacgtacgggtacaccgttagtttaggttacgttacggtaacggtacccgttcccggtaccgttaccgttaccggttaaccggggttccgggaacggggccgggtacgggtacgggtaggtaccgaacggtacggtaaccgggtaacggttacggttcgggcggttaacccgtacgtacccggtacttagtttcccgttagtttcccgttacccg

SEQ ID NO: 243768 - DNA, 810 bp, Homo sapiens
  misc_feature: GYAE6OF01EQCHZ.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatactcctcgcctgtcgtcgtcgtgggcgaggacggccacagtcgagtgacgaacgtccgagcgagtaaaaccttcgttttaatagttagtttacaacgtaagtaagtacttagtttagtcttaggtatacgaacgaaaccaaaaaccgacggaacaccgtacccttaacctaaacgtcgtactactactccgtccgtacggactaccgttcccggtaccccgggacccgtaccccgggtaccgttccccgtacggtacccgtacgttaccgtaacggttcgggaccgtaccgggtccgggtacggtacgggaacctacggttacctttacccgtaccgttacctacccgtaacctaccgtaaccgaaccgtaacccgtaacccgtacggtacgaccgggtaataacgggtaacgttaggttaccgggtacgtaacgttttaagttttaaccgttacgtcggtaaccgtacgtaggtacgttagtttacgacgtaaccgttccgtcccgttacgttaccggtttaccgggttccggggaacgggtaccgggtaccggtacggggtaacgtacggtacccgaacggtaacggtaaccgggttacgtcgggtcgaccgttaccgacccttacgttcgtttaccgtcgtttcccgtaccttaccccgg

SEQ ID NO: 243769 - DNA, 697 bp, Homo sapiens
  misc_feature: GYAE6OF01CJBSC.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggactatcctgactcgacccacgtccccagatactcctcgcctgtcgtctcgtgggcgaggacggccacagtacgagtcgacaacgtccagacgatactttacttttaatagtagtgtacaacgaataaggtacttattagtcgttagtatacgaagaaccaaaaacgaggacaccgtacctaacctaaactcgacctactaaccttccgtaccgtacgggtacctaccgttacccggtaccccggggacccgtaaccccggtaccgttaccccgtacggtaacccgtacgttacggaacggtcggaccgtacgggccggttacgtacggactacgtaccttcacgtctaccacgactacaacgcctaacgtcgacgtacgtacgtaagtaacgtgtacggttacggtactttaacgggtttactacgtgtactagtacgtaagttgtacggtacgtaaccgccttccgacgttaccgttcggtacgggacgggacggtcggtacggtaagacgttacgacggtaacggtatacggttcggacgtcctacgaccgttactagtttcttccgtgttacccg

SEQ ID NO: 243770 - DNA, 663 bp, Homo sapiens
  misc_feature: GYAE6OF01D1SQS.11.11.A11.1.454.CMB.1.raw
  modified_base (346)..(346): a, c, t, g, unknown or other
  misc_feature (346)..(346): n is a, c, g, or t
  modified_base (359)..(359): a, c, t, g, unknown or other
  misc_feature (359)..(359): n is a, c, g, or t
  modified_base (432)..(432): a, c, t, g, unknown or other
  misc_feature (432)..(432): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgagaggccaccatcgagtgcaagtccagcgagtacttcttttaatatagtgtacaaacgataaaggtacttatttagctttggtatcgaagacaaaaaccaggacacgcctacctaactgctcatcctccgtgggctacgtaccgtacccgggccgacccggtacgtccctagaccgtnttcgagtcggacnggccgggtctgggacagtacttcactcctacaccatcacgaccactcgacgacggtatacggaagtgttcggnggttaccttaagttttacgtacgttcgtactacgtagtacgtttagttcgtaggtaacgtcctacccgggtcttaccgttacccgggtttcggggaccggggtacggggtacccgggtagggtacgggtaacggtaccgttaccggaacgggtaacccggtaggttccggggtagggtcccctacggtaccccgtacgttaaccgttttcgtttccgttccggtttaaccc

SEQ ID NO: 243771 - DNA, 807 bp, Homo sapiens
  misc_feature: GYAE6OF01CL3YE.11.11.A11.1.454.CMB.1.raw
  modified_base (228)..(228): a, c, t, g, unknown or other
  misc_feature (228)..(228): n is a, c, g, or t
tcagcgagagataccacgaccggtgctcgatttagctacgactgcaggggcacgcaagatggtgttgcagacccaggtcgttcatttctctgttgctctggatctctggtgcctggttgggacatcctgatcgacccacgtcccagatactcctgcctgtgtctacgtgggcgagacggccaccacgtcgaacgtgaccaacgtccaacgcgacgtacttacttttanatagtcgtacaacgaataacggacttattgcgttaggtacttcaacgaaccaaaaaccgtacggaacacgtacctaacctaaaacgtgtcctacctaacttccgtacccgtacgggtcctaacgttcccggtaaccccggggacccgtaaccccgggtacccgttaccccgtacggtaaacccgtacttaccggaacggttcgggaccgtacgggtccgggtacgtcggggaactacggtacctacgactccgtacaccgtatcgacgacgtaaccgtgacgtacggcctaaggacgtacgtcggtacgtaccttaagtttacgtacgttacgttaccgaacgtacgtaacgttagttacggaacggtaaccgtaacccgttccgtaccgttaaccgttacccgggtttaacggggacccggggtaccgggaacccggggttcggggtaacgggaaccgtaaccggtaaaccggtaaccgggtaaaacggtaacccggttgggttaccggtaccccggttacggtaaccccgttaacgtaacccgtttcccgttacccggtttaacctttaaccccggg

SEQ ID NO: 243772 - DNA, 617 bp, Homo sapiens
  misc_feature: GYAE6OF01CTA7O.11.11.A11.1.454.CMB.1.raw
  modified_base (209)..(209): a, c, t, g, unknown or other
  misc_feature (209)..(209): n is a, c, g, or t
  modified_base (405)..(405): a, c, t, g, unknown or other
  misc_feature (405)..(405): n is a, c, g, or t
tcagcgagagataccacgaccggtgctcgatttagctacgactgcagggcagcaagatggtgttgcagacccaggtcttcatttctctgttgctctggatctctggtgcctggtggggacatcctgatcgacccagtccccagatactcctgcctgtgtctcgtgggcgagcgggccaccagtcgagtgcaagtccagcgagtaccttnttttatatagtgtacaacgtaataaggtacttatttagctttggtatcgaagaaccaaaaaccgaggaccacgcctacctaaacgtcgctcacttccgtccgtggcacgtcccgtacccgggccacccggacgtaccctcgaccgtagtcgaggtcgcgtaggccgggtacgtgggaccacgtaccttcacctccncaccgatcgacaccactcgacacggctagagtagtggtacggtacttagtttactacgtgtacgacgtacgtagttagttagaggtaaccgtccttccgtcgttccgttaccggttcggggaccgggacgggtaccggtcgggtaaggacgtagtaccgaacgtaccggtaacgttggaccggtctcgacctacgtcttcgttctcgttacc

SEQ ID NO: 243773 - DNA, 575 bp, Homo sapiens
  misc_feature: GYAE6OF01E3APL.11.11.A11.1.454.CMB.1.raw
  modified_base (409)..(409): a, c, t, g, unknown or other
  misc_feature (409)..(409): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggacttatttagcttggtatcagacaaaaaccaggacacgcctacctaaaactgcctcactctccgtggcactctaccccgggcaccccggacgtcccctcgaccgtacttcgaggtggcacggcgggtcgtgggacagacttcactctccaccatcagccaacctgcgaggtctaggaagtntcggtagcttaagtttattctgtcagcctagttagttgtacgactccgtccgtacttcgttaccgttcgggaccgggacggggtaccggcggggtaggacgagttacgaacggtaaccgacggttgggcggctcggaccaccctagttccgttgtttcctttaccg

SEQ ID NO: 243774 - DNA, 635 bp, Homo sapiens
  misc_feature: GYAE6OF01BJN7B.11.11.A11.1.454.CMB.1.raw
  modified_base (211)..(211): a, c, t, g, unknown or other
  misc_feature (211)..(211): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtcgtctcgtgggcgagagggccaccatcgagtgcaagtccagcgagtacttcttttanatagtgtacaacgtataaggactatttagcttaggatcagaacaaaaaccgaggacacgtcctacctaaacgtcgactcgatccgtccgtggcactccgtaacccgggccacccggactcccctggaccgattcgaggtcggaccgacggtcgggtctaggggactaggtcttcgacttcctacaccatcgagacctaaccgtgacgaggtccgtagaacgtgtacggtggtacttaagtttacgttacgtcgtacgtagtacctagttacgttggtacgtaacgtcccgtaccggtcttaccgttaccgggttcgggtaccggaccgggtacgtcggggtaggaacgtcgtaaccgtacggaacggtaaccgttgggacggtaccgtacgtaccgtacccgtattcgttcggtcctttacccg

SEQ ID NO: 243775 - DNA, 855 bp, Homo sapiens
  misc_feature: GYAE6OF01AP0U3.11.11.A11.1.454.CMB.1.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
tcagcgagagataccacgaccggtgctcgatttagctacgactgcaggggcagcaagatggtgttgcagacccaggtcttcatttctctgttgctctggatctctggtcgccgtggtggggacatcctgatcgacccacgtcccagatactcctgcctgtgtctcgtgggcgaggcggccacatcgatgacaagtccagcgatacttnttttanatagtgtacaacgtattaaggtacttagttacgtcgtttaggtaactaccgaacgaaacctaaaaaaccggacggaaccgaaccgtacccttaaccgttaaacgtccgtaccctacctaacgttcccgtttaccgggtcggggtacctaacccggttacccccggggtaaccccggggaccccggtaaccccgggttacccggttacccccgtacggtaaaccccggttacgttaaccggtagggtccgggtaccggtaacggggtccccgggttacgggtaggggaaacccgttaccggttacccttacccgtacctacccgtacctaacctacgtaacgactaacccggtacctcggacgtaacggtacgtaaacggaacggttaacggtggttacggtaacgtttaaggttttacggttaactaccgggttcacggtcgttaaggtttagttcgggacgtaaccgtttccgaccgtttaccgtacccgttaccggggttaccgggaaccggggtcgggtaaccggttcgggtaacggtacccgtaaagttccccgggaaagtaccgggtaaccggttaggtcccgggtaacgaccgtacccgtaacccggttatttcccggtgtttcccgttaacccg

SEQ ID NO: 243776 - DNA, 810 bp, Homo sapiens
  misc_feature: GYAE6OF01ETVRJ.11.11.A11.1.454.CMB.1.raw
  modified_base (444)..(444): a, c, t, g, unknown or other
  misc_feature (444)..(444): n is a, c, g, or t
  modified_base (631)..(631): a, c, t, g, unknown or other
  misc_feature (631)..(631): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatcgaccctacgtccccagatactcctgcctgtcgtctcgtgggcgaggacgggccaccagtcggagtcgactaacgtccgagacgagtacctttacttttatatagtgtacgaaacgtagtaaacggtacttagtttacgtcgtttaggtactacgaaacgaaaccgtaaaaaccgacgggtaaccacgtacccgttaaacctaacgtccgtacttacctacgttcccgtaccggtcggtaccctaccgtaccccggtaaccccgggtacccgtacccgggtacccgttacccgtacggtaccgttacgttaccgngggttaccggacggtaccgggcggggttaacgtacggggaaccctacggtttaacccttcctacccgttacctaaccctaacccgtaacgtaccgaacgtacccgtaaccgcggtacccggtaaggtcgtaaggaacgttacggtcggttacgggtacttttaggttaacctcgttacgtacgttancgttaagttacgttacgacggtacccttcgtcctacgttaccggtttacgggttccggggaaccgggtacgggtcgggtaggtacgggaactaggtaccggtaacgttaaccgggtcggtcgggtaccgtcgtaacccgtaaccgttccttacgtccgtttaaccgtcctttaaccccg

SEQ ID NO: 243777 - DNA, 587 bp, Homo sapiens
  misc_feature: GYAE6OF01AHSRK.11.11.A11.1.454.CMB.1.raw
  modified_base (437)..(437): a, c, t, g, unknown or other
  misc_feature (437)..(437): n is a, c, g, or t
  modified_base (564)..(564): a, c, t, g, unknown or other
  misc_feature (564)..(564): n is a, c, g, or t
tcagcgagagataccacgaccggtgctcgatttagctacgactgcaggggcagcaagatggtgttgcagacccaggtcttcatttctctgttgctctggatctctggtgcctggtgggacatcctgatcgacccacgtccccagatactcctgcctgtgtctcgtgggcgagagggccacatcgagtgacaagtccagcgagtacttcttttatatagtgtacaacgataaggacttattagtcttggtactcacgaacaaaaccaggacacgcctacctaactgactctactcctccgtcggacacgtacccggtacccgggccgacccggtacgtcccgtacgaccgtattcgacggtcggacgacggtcgggtaccgtacgggactagtaccttccacgtcctacacctactcgacgtaccacgtcgagacggntagaagtgtcggtgtactagtttctactcgtacagtacgtagtgtcgagacgtcgtccgtcgttacgtcggttacggacggtacgggacggtcggtgacgtacgacgacgtaccgagtcggacgtcncgtaccactagttctgtcttacg

SEQ ID NO: 243778 - DNA, 816 bp, Homo sapiens
  misc_feature: GYAE6OF01D41Z9.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagacggccaccatcgagtgacaagtccagcgagacttcttttaatagtagtgtacaaacgagtaaaggtacttagtttagcctttaggtaatcgaagaccaaaaaaccgaggtaaccagccctaccgtaaaactcgctacattcctaccgtggggcctacgtcccgtaccccggggcaaccccgggacgtccccgtaggaacccgtaatttccgaaggtcggaccgaggcggggttcctaggggaccaagtaccgttaccaaccgttccctacccgaacctaacgttaccgaacggtaccctaacccgttggaccgaacggtaccgttaggaaaagttacgttacgggttacggtacggtttaaacgtttttaacgtttaaccgttaccggttcgtaacggtacgttaaacggttttatttaggtacggtaaaccggtccccttacccggtacccgtttacccgttaaccgggttttcccggggaccggggtacccgggggttaccgggacccgggggttaaggaccgggtaacgttacccggtaaaacggggtaacccttaaaaccgggttccggggaccgggtttaaccgtcccgggtaaacccttaacccggttacggtttaccgttccgttacccgttttacccg

SEQ ID NO: 243779 - DNA, 763 bp, Homo sapiens
  misc_feature: GYAE6OF01AXHZG.11.11.A11.1.454.CMB.1.raw
tcagcgagagataccacgaccggtgctcgatttagctacgactgcaggggcagcaagatggtgttgcagacccaggtcttcatttctctgttgctctggatctcgtggtcgccgtggtggggacactcctgatcgacccacgtcccagatactcctgcctgtgtctcgtgggcgaggacggaccaccagtcgagtcacgacgtccagacgatactttctttatatacgtgacaacgtaagtaacggtatttagttagtcgttagtactacgaacgaaccaaaaaccgagaacacctacccgttaactaaaccgtcgtacttaccgacttcccgtcggtcggtacctaacccggtcccgtacccggacccgtacccggtaccgtccgtaccgtacgtacgttacgacggtcgacggacggttaccgggtgtacgggaaccgtacgttacccttaccgtaccctacacccgtaaccgaccttaaccgaacgacccgttaaccgacgtcggtaacggtacgtaaggtaacgtaggtcggttaaccggttattttaacggtttacgtacgttacgagtagtacgttagttacgttacgaacgtcgtacccgtcggtaccttaccggggtacggttccggggaacggggtaccggtaaccgggtcggtaaacggggtaactaccggtaaccggtacgggaaacgttaccggcgggttaccgacccacggtaccctacgtagtttcccggttaaccgtttctaacccgg

SEQ ID NO: 243780 - DNA, 714 bp, Homo sapiens
  misc_feature: GYAE6OF01ETJ8A.11.11.A11.1.454.CMB.1.raw
  modified_base (373)..(373): a, c, t, g, unknown or other
  misc_feature (373)..(373): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatatcctgcctgtgtctcgtgggcgaggacggccacagtcgagtgacaagtccagcgagtacttactttatatagtcgtacaacgataacggactttattagcttaggtactacaagaacaaaaaccgaggaaccacgtacctaacctaaacgtgtacctctacttccgtaccggtagggacctaacgtccgtaccccgggaccgaccccggtagtcctacggacctntacgaggtcgacgacggtcggtacgtacgggactcgtaccttcaacgtcctaccgacactcacacctaacgtagcgtagcgtaagaagtagtacgtgtacgttaagtttacttacgtagacgtagtaacttaggttaagttcgtaacgtaccgtccgtcccgttacgttacccgtttaccgttcggggtaaccggggaccggggtaacccggttacgggttacggtaacgtaacgttacccggaaacgggttaaacccgttacggttacgggttacgggaccgttttaaaccggcccgttaaccgtaaccgttttaccgtttaaccggtttccttaacccg

SEQ ID NO: 243781 - DNA, 779 bp, Homo sapiens
  misc_feature: GYAE6OF01C6TBA.11.11.A11.1.454.CMB.1.raw
tcagcgagagataccacgaccggtgctcgatttagctacgactgcaggggcagcaagatggtgttgcagacccaggtcttcatttctctgttgctctggatctctggtcgcctggtggggacatcctgatgacccacgtccccagatatcctgcctgtgtctcgtgggcgagagacgccaccatcgagtgacaagtccagcgagtacctttacttttaagtatacgtgtaccaaacgtagtaaacggtactttagttttacggcgtttagggttaactaccgaacggaaacccgtaaaaaaacccggacgggtaaccgaaccgtacccctaacccttaaaaccttcggtaccttacctaacgttcccgttcccggtcggggtacctaccggtaccccggtaccccggggacccgtaaccccgggtacgtaccccgtacggtaccgtacgttaccgaggtcggccggacggtcgggtacggtaggaacctacgtaccgtactaaccgtcctaccgacctacgtaccgacgtacccaaccgtcggacgtaacgggtaccgtaggaaaccgtggtacgggtacgtacgtttaacgttttaacgtacgtttacgcgtaggttacttaacggttacgttaggtaccgaaccgtccccgtaccgttccgtacggttaccgggtttccggggacggggaacggcccgggttacgggagtagacccggtcgaacggtacggacggttggtcgacgtccgtaacgtacgtacgttccgtaggttaccc

SEQ ID NO: 243782 - DNA, 686 bp, Homo sapiens
  misc_feature: GYAE6OF01EVJ1X.11.11.A11.1.454.CMB.1.raw
  modified_base (559)..(559): a, c, t, g, unknown or other
  misc_feature (559)..(559): n is a, c, g, or t
  modified_base (590)..(590): a, c, t, g, unknown or other
  misc_feature (590)..(590): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatatcctgcctgtgtctcgtgggcgaggacgggccaccatcggagtgacgaacgtccgagcgacgtacctttagttttatagttagtcgtaccaaacggtaataaagggtactttaagtttacgtcgtttaggtatacgaacgaaccaaaaaccgaggacacgtaccctaacctaaactcgacctactacgtccgtccgtggactaccgtcccggtaccccgggaccgtaccccggtacgtcccgtacggaaccgtacgttacgaggtacggcgtacgggtccgggtacggtacgggactacggtaccttaccgtaccttccgtacccacctagtacgaccgacctaaccgtcgaacgtacggacgtaagaacgtaggttcgggacgttacgtttaatttacgtacgtggtacngtacgttagttatggtacacgtcctaccgtnttacggttacgtcggggacggacggtcggtggtacgacgtacgacggaacggtaactaggtcggtcgactcgacgtaccttactcgttgtctaccg

SEQ ID NO: 243783 - DNA, 736 bp, Homo sapiens
  misc_feature: GYAE6OF01D5FA6.11.11.A11.1.454.CMB.1.raw
  modified_base (451)..(451): a, c, t, g, unknown or other
  misc_feature (451)..(451): n is a, c, g, or t
  modified_base (709)..(709): a, c, t, g, unknown or other
  misc_feature (709)..(709): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgtgtctgtgggcgaggcggaccaccagtcgagtgacacgtccagcgaagtactttacttttatagtacgtgtacaacgtataaggtacttatttacgctttaggtatacaagaaccaaaaaccgaggaaccacgtacctaacctaaacgtcgtacctactacttcctaccgtcggggtactacgttcccggtaaccccgggacccgtaaccccgggtacgttcccgtaccgtaccgtacgttaccggaggtccggacgacgggtccggggttcgtacggggactacgtaccttaccnccgttaccaccactactacgacgtaacctaccgtcggacgtacggtactaacggaagtcgtggtacgttaattacgttttagttacgtcggtacgagtacgtagtttacgtagtacgtaaccgtccggtacccgtcgttacggttaccggttaccggggaaccgggtacggggtacccgggtaggttaacgggacgttaccggaacgtaacggtaacccgtaggttcgggaaccgttccaaccggtaccttaacccgngtttaccttcgggttacccttacccgg

SEQ ID NO: 243784 - DNA, 852 bp, Homo sapiens
  misc_feature: GYAE6OF01CDB7S.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatgacccagtcccagatatcctgcctgtgtctcgtgggcgaggacgggccacatcggagtgcaagtccaggcgagtacttcgttttaatagttagtgtaccgaacgtaagtaaacggactttaatttaggaccgtttagggtaactaccgtaagaaaccaaaaaaccgtaacgggaaccaacggtccctaaccctaaaacgtcgtcctacacttcctccggtcgggtaccaacgttcccggaccccggggtacccgaccccggtaccgttccccgtacggacccgtaacttccgaggtacgggaccgacgggtccggggtcgtacggggtaacccaggtaccctttaccggtaccttacccgtaccaaccgtacgtacctaacggacccctaaacccgtacggcccgttaacggggccgttaaacgggtaaacggttacgggttaccgggtttacgggaccttttaaagggtttttttaaccttaccgggtaccgttaacccgtaaggttaccctaaagggttttaagttttaccgggtaggtaacccggttaccccgtccggttacccgttacccgggtttaaccgttttcccgggggggaccgggtaccggggttaccggggtacgggttacggggtacgtaccgtaacggaacgttaaccgggcggttaccgggcggaccgttaccgtacccgaccttcggttatttcccgggtcttacccg

SEQ ID NO: 243785 - DNA, 819 bp, Homo sapiens
  misc_feature: GYAE6OF01DOTCI.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccacgtccccagatatcctgcctgtcgtctcgtggggcgaggacgggcccaccatcggagtgacaagtccagcgagtacttacttttataattacgtgtaccaacgtaacgtaaaggtacttaagtttacgcgttaggttaactacaacgaaccgaaaaaaccgacggaacctacgtaccctacccttaaaactcgtacctactacttccgtaccgtagggacctactaccccgggtaaccccggtcccggaacccggtaccgttaccccgtacgaaccggttaacttaccgaacggtcggcgtacggtccgggttccgggttaggaacccgtacggtaaccttaccctaacccttcccgtaccctaacccgtaactaccgacgaacccgtaacccgtcggaccgtcggtaacctaggaaacgttagtcggtaacggttacgtttaacgtttaacgttacgttcgtacgtaaccgttaagttacggtttacgtacggtacgtaaccgtccccgttaacccgttaccgttaccgtttaccggggtttacgggaacccggggtaccggggtccggtaaccggggtcggaaacccggttagaaccggtaccggtaaacggttacgttaccggggttaggtcccgtacgtacccgttaacctacggtttccgttcccgttccgtttaaaccc

SEQ ID NO: 243786 - DNA, 758 bp, Homo sapiens
  misc_feature: GYAE6OF01EOYDW.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgtgtctcgtgggcgagacgggccaccatcgagtgacaagtccagcgagtaccttcttttaatattagtgtacaacgataaggtacttatttagtcttaggtatacagaaccaaaaaccgaggaacacgaccctaacctaaactcgacctacactcctccggtagggacctaccgtacccggtacccccggggcccaaccccgggtaccgttccccgtaccggtacccgtacgttaccgtaggtcgggacgtacgggtccgggtcgtacggggactacggtacccttactaccttacctaccgaacctactaccgtacgaccctaacccgtggaccgtaacgggcgttaacggaaagttcgtagggtacggtaactttaacggttttacttacgtacggttacgtacgtaacgttagtttactttagggaaccgttaccgtcccggttccgtacctttaccggttaacccgggtttccgggggaccgggtaaccgggggacccgggttccggggtaggtaaacggtactacccggaaacggtacccggtagttcgggtacggcgttaccgacccgtaccgtattacccgtttgtccgtttacccg

SEQ ID NO: 243787 - DNA, 823 bp, Homo sapiens
  misc_feature: GYAE6OF01C89AL.11.11.A11.1.454.CMB.1.raw
  modified_base (619)..(619): a, c, t, g, unknown or other
  misc_feature (619)..(619): n is a, c, g, or t
tcagcgagagataccacgaccggtgctcgatttagctacgactgcaggggcagcaagatggtgttgcagacccaggtcttcatttctctgttgctctggatctctggtgcctggtgggacatcctggatcgacccacggtacccagtacttactcccgtcgtccgttggttcgtctccggtggggaccgagggaccgggacccaaccgtagtacggaggtacggacgtaacggtcccgacggtacgtaacgtacctttacgtttttaataagtagttacgtaccaaagtaagtaaggttaactttgttaggttcttaggtaactacgaaaccgtaaaccaaaaaccggtaacggaactcccgtaacccttaacctaacgtcgtccctactaacgttccgtccggtacggccttaccggtaccccggaccccgggaccggtaacccggtcctaccccgtacggtaacccggtcttacggtagggccggtaacggtccgggttaccgggtggtaacccggggactacggttaaccttcgtacctcccgtaccactacgacacgacctacgcgcggaggtactagagtacgttggtgtaacgtttatttacgtacttacganattacgttaaggttatcgacgttaacgtccgttaccctggttaccgttacgggtaccggggtacgggtcggggtaacggttccgggtagggtaacggtacggtaaccggtaacgggtaggtaaacgggttcccggttagggttacccgtaccggttacccgtaaacccggtttcctaacgggtttccctttcccgttaacccgg

SEQ ID NO: 243788 - DNA, 767 bp, Homo sapiens
  misc_feature: GYAE6OF01AV187.11.11.A11.1.454.CMB.1.raw
  modified_base (608)..(608): a, c, t, g, unknown or other
  misc_feature (608)..(608): n is a, c, g, or t
  modified_base (618)..(618): a, c, t, g, unknown or other
  misc_feature (618)..(618): n is a, c, g, or t
tcagcgagagataccacgaccggtgctcgatttagctacgactgcaggggcagcaagatggtgttgcagacccaggtcttcatttctctgttgctctggatctcgtggtgcctggtgggacatcctgatcgaccacgtcccagatctcctgcctgtctctcgtgggcgagcggccacctagtcggagtcgacgtaacgtccaggtcgacgtacctttactttttaagtattagtacgtaacctaacggtaattaagggtaccttagttttacgacgttttaggtactaccgaacgtaaaccaaaaaccgacgggtacctaccgtacccttaaacccttaaaacggtcctacttacccgtaacttcccgtaccggtacggacctaccgttacccggtaacccccggggcccgaaccccgggtaaccgttcccctaacgggtaaccttataccgtacgggtccggaccggtaggccgggttacgtacggaacgacttacccgttcctactcccgtaccaacccgttcacgtaacggccctaacgtcgacgtacggtaccgtaagacgtacgtcgggtaccttagtttacgtttaacgtttcgagttaccngtaacggttntacgttagacgtacctccgtacgtccttaccggttcggtacggtccggggtacggaccgggttcgtaggtacgtaacctcggaacggccggttaaggttccgggacgttccgaccggttaccactttaggtcccttcgttactaccccg

SEQ ID NO: 243789 - DNA, 688 bp, Homo sapiens
  misc_feature: GYAE6OF01EAW0F.11.11.A11.1.454.CMB.1.raw
tcagcgagagataccacgaccggtgctcgatttagctacgactgcagggggcagcaagatggtgttgcagacccaggtcttcatttctctgttgctctggatctctggtgcctggtggggacatcctgactcgacccacgtccccagatatcctgcctgtgtctcgtggggcgaggacgggcccaccatcggagtgccaaagtccagccgagtacttacttttatatagtcgtacaacgataaggacttatttagcttaggtatacgaacgaaccaaaaaccgaggaaccacgtaccctaacctaaactcgacctacactccgtccgtcgggacctacgtcccggtaccccgggacccgacccggtccgttcccctacgaccgtacttcgaggtcggcgacggtcgggttcgagggactacgtccttaccaccttacacccactagtccaacgaccaaccgtgacgaggtcctaggaagtagtggtacggtattaagtttacgttctagtacagtcgtaagttttagtacggacgtaaccgtccgtaccctcgttaaccggttccgggttacggggaccgggtaccgggtccggtacgggtaggaccgtagtaccggaacggaggtacccggttgggtcccggacctacccggacccttaccgttattccgttccgttcccttacccg

SEQ ID NO: 243790 - DNA, 725 bp, Homo sapiens
  misc_feature: GYAE6OF01APR6I.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatactcctgcctgtcgtctcgtgggcgaggacgggccacatcgagtcgacaagtccagacgagtacttcttttaatatagtagtacaacgtaagtaaggtactttagtttacggtcgtttaggtactacgaacgaaaccgtaaaaacccgaggaaccacgtacccttacctaaacgtcgacctactactccgtccgtcgggcctacgtcccgtaccccgggaccgacccggtaccgtccccgtacgaccgtacttacgacggtcggacgtacggtcgggtacggtacgggaccgtacgtaccttaccgacctcctaccacctacgtaccgacgtacctaaccgtgacgacggtactaggaagtacgtcgggttacgtactttaagtttacttacgtacggtcagtcgttaagttcgtacgtacgacgtcccgtcgtccgtacgttccgggttacgggaccgggtacgggaccggtcgggttacggaacgtacggtaccggaaccggttaacggtacggtccggggtacgtaccgtacgggtaacccttacgtaccgtttccgttccgttaccctttaccg

SEQ ID NO: 243791 - DNA, 796 bp, Homo sapiens
  misc_feature: GYAE6OF01A4OZF.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtcccagtatactcctgtcctgtcgtctcggtgggacgaggacggccactagcggtagtgacaacgtcgagacgagttacttacttttaatagtagtcgtacaaacgtagtaaacggtactttagtttagcgttagtatacgaacgtaaacgaaaaacgacggaactacgtacccttaaccttaaacgtcgtacctactactaccgttccggtacggtaccctacgtacccggtaccccgggacccgtaaccgggtaccgttacccgtacgtaacccgttacgttaccggtaggtacggaccgacggttccggggtacggtacggaaccgtacgtaccttacctaaccgttacctaccaaccgttacgtacccgaaggtaccccgtaaccgtacgacggtaccggtacgtaacggtaaggtacggttagttacggttagtttaaacgtttcgttaacgtcgttacgacgttaagttaatttaggttaccgttaggttaaccgtaccgttccgtaccgttaccggtaccggggtttacgggacggggtaaccggggtcggtaccgggtagtaaccggaagtaaccggtacggtaaccgtagggttcggtaccggtcgttacgtacccttacgtcggttacgttcccgttacgttacccgg

SEQ ID NO: 243792 - DNA, 769 bp, Homo sapiens
  misc_feature: GYAE6OF01ETJUU.11.11.A11.1.454.CMB.1.raw
  modified_base (216)..(216): a, c, t, g, unknown or other
  misc_feature (216)..(216): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatcgacccacgtcccagtatactcctgcctgtcgtctcgtgggcgaggacggccaaccagtcgagtcgacaacgtccagcgagtacttntttataagttacgtcgtacgaaacgtagtaaacggtactttaagtttacgtcgtttaggtatacgaacgtaaaccaaaaaaccgaggaccaacggtccctaaacctaaacgtcgacctactacgttccgtaccgtcggggtacctacgtacccggtaaccccgggaccgtacccggcgttaccccgtacgaccgtacttacgacggtacggcgtaacgggttcggggtacgtacggggaaccacgtttacccttaccaacgttcctacccgaacctacgtaccgaccgtaccctaaaccggtcgaccgagggtaccgtaagggtaaaccgtaggtacggtacggttaacgtttaacgtttaacgtttcgtaacgttcgtaacgtacgttagtttacgtaggtacgtacgtacccgttcccggaacttaccgggtaccggtttccggggacgggtaccgggtaccgggtacgggtagaacgtaccgacggtaaaggaaccggttacgtcgtaccggtacaccgaccgttacttacgtccgttccggtcttaccg

SEQ ID NO: 243793 - DNA, 695 bp, Homo sapiens
  misc_feature: GYAE6OF01AW3SO.11.11.A11.1.454.CMB.1.raw
tcagcgagagataccacgaccggtgctcgatttagctacgactgcaggggcagcaagatggtgttgtagacccaggtcttcatttctctgttgctctggatctctggtgcctgtggggacatcctgatgacccagtccccagatatcctgcctgtgtctcgtgggcgagagggccaccatcgagtgcaagtccagcgagtactacttttatatagtgtcaacgataaggacttattagcttaggtatcagaccaaaaaccaggacagccctacctaaactgactctatctccgtcgggtcacgtccgacccgggccacccgggacctcccgacgtaacccgtacttcgaggtcggaccgaggcgggtcgtcggggaacgacgtactctaccgtactaccaacctataccgacgaccaaccctcgaccgaggtaccgtaaggaacggtgtacggtcgggtactttaacgtttttaacgttaccgttggtacaaggtacgttaagtttaacgtttaggtaacgtacgtacccgttcccgttccttacccggtttaccgggttaccggggaacggggtacccggggacccggtacggggtacgggacgtacgttaccggaacggtaaccgaacggttacgggtcgtaccggtaccgacccttaccgtagttcccgttacgtttccttccgtaacccgg

SEQ ID NO: 243794 - DNA, 613 bp, Homo sapiens
  misc_feature: GYAE6OF01B89XH.11.11.A11.1.454.CMB.1.raw
  modified_base (224)..(224): a, c, t, g, unknown or other
  misc_feature (224)..(224): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatcgacccagtccccagatatcctgcctgtgtctcgtggggcgaggagggccacatcggagtgacaagtccagcgagtacttcttttaatataggtntacaacgaataacggacttaatttagcgttaggtatacaagaaccaaaaaccaggacagtacctacctaaactgctcatcctcgtgggctactcccggtacccgggaccacccggacgtccctaggacctactcgagtcggcgacggcgggtcgtacgggacacgtactcactcctaccacctacgtacacgacctaccgtgacgacggcgtaagaacgtgtagtcggtacttaagtttacttacgtcgtacagtctagttagttgacgtacgtcctccgtctaccgtcggttacgggacgggacggacggtcgggtagacgtaacgtcgaacggtacgtacggttgggcgtacgtacgccgtactcgttccgttcgttccgttacccg

SEQ ID NO: 243795 - DNA, 877 bp, Homo sapiens
  misc_feature: GYAE6OF01AWHCX.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagtactactcctgcctgtgtctcgtggcgaggacggccacctatcgagtgaccaagtccacggacgagtaccttacgttttatagtagttcgtaccaaacggaagttaacggtaacttagttttacggtacgtttaggtacttacgaaacgaaaccgaaaaacccgacggtaacctaaccgtacccttaaccgtaaacgttcgtaccttacctaccgtaccgttaccggtaccggtacctaaccgttaccccggtaacccccggggacccgtaacccccgggtaccgtcccccgtaccggaaccccgttattaccggtacggtcggccgtaacgggtccgggttacggacggaaccgtacgtaaccgttccacgtcccaactaccgactaccgacgacccgtaccgtacgaccgtacggtacgtaagtaaccccccgtagtacggtacggttacgttaacgtttacgttaccgttacgttacgtacgtaccgtaagttacgttacggtaacgtaaccgttaccgtacccgtaccgttaccgggtttacccgggtttaccggggtaacccgggggtacccggggtaccgggttaccgggtacgggtaaccgtaaccggtaaccggtaaaccgggtaacccggtaacgggttccgggtaccggttacccggtaaccggtaaccccgtacccgtttaccgtttacccggtttcccgtttaacccggtttaacccccg

SEQ ID NO: 243796 - DNA, 789 bp, Homo sapiens
  misc_feature: GYAE6OF01B51C0.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagtatactcctcgcctgtgtctcgtgggcgaggacgggccacatcgagtgacaacgtccagcgtagtactttattttatagttagtgtaccaacgtaagtaaggtactttagtttagtcgttaggtactaccgaacgaaaccaaaaaccgacggacgtaccgtaccctaaccttaaacgtcacctactacttccgtccggtacgggacctaccgtacccggtaaccccgggacccgacccgggtaccgtccccgtacggacccgtacttacgaggtcggaccgacgggtcggtcgtacgggactacgtccgtcctacttaccaccactactaccgaccgtacctaaccgtcgacgtacggtacgtaacggtaagtggttacgggtacgttacgttttaaacggtttaccgttaccgtaggtaccgtaacggtaccggtttaagtttacgggttaataaccgggttcccgtacccgttacccgttacccgttaccgggtttaccggggtacgggggcccggggtaccggggacgggttacgggtacgggacgtaaccggggtaacgtaccgggtaacgggttacgtccggggtcgtaccggtaccacggttacttaccggttacccgttctttaacccggttccccg

SEQ ID NO: 243797 - DNA, 779 bp, Homo sapiens
  misc_feature: GYAE6OF01AHZIG.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatactcctgcctgtgtctcgtgggcgaggacggccaccagtcgagtcgactaacgtccagacgagtactttacttttaatagtagtacgtacaaacgtaagtaaacggtacttagtttagtcgtttaggtactacgaacgaaaccaaaaaccaggacacgtaccctacctaaacgtcgtacctactacgtccgtccggtagggacctaccgtacccggtacccgggacccgaccccggtaccgtccccgtacggaccgtacttacggacggtcggaccgacggtccgggtacgacggggtaacctaacgtaacctttccaaccgttacctacccgaacctacgtaccaacgtaccctaaccgtggaccgtaacggtacgtaagaaacggttagttggtacgttacgtttaacgtttacgttacggttacgtactaacggttctaagtttacggtagttaacggaccgtcccgttaccgtacccggttacgttaccgggttaacccgggggacgggttaccggggaccgggtacgggtacggtaacgtaacccggtaccggaacgggttaacgtacggttcggtaccggtaccttaccggacctacccgttacgttcgttcccgttccttacccg

SEQ ID NO: 243798 - DNA, 836 bp, Homo sapiens
  misc_feature: GYAE6OF01C18ZY.11.11.A11.1.454.CMB.1.raw
  modified_base (171)..(171): a, c, t, g, unknown or other
  misc_feature (171)..(171): n is a, c, g, or t
  modified_base (192)..(192): a, c, t, g, unknown or other
  misc_feature (192)..(192): n is a, c, g, or t
  modified_base (412)..(412): a, c, t, g, unknown or other
  misc_feature (412)..(412): n is a, c, g, or t
tcagcgagagataccacgaccggtgctcgatttagctacgactgcagggggcagcaagatggtgttgcagacccaggtcttcatttctctgttgctctggatctctggtcgcctggtgggacatcctgatcgacccacgtcccagatatcctgcctagtcgtctcgtgggngaggacgggccaccagtcggngtcgacagtccgagcgaagtcttcttttatagtagtacgtacaaacgtataaacggtacttagtttacgtcgttaggttaactcgaaacgtaaccaaaaaacgtacggaaccgtacgtaccctaaccgtaaactcgtacctcgtactcctaccgtaggactacgtcccgtacccggccgaaccggtccgtacctcggactacgtacgacggtcggaccgnggtaccggtcggtacgggaaccgttacggtaacctttccgaaccgttccgtaacctaacccggtaacttacccgaaaccgtaacccgtaaccggtacggtaacccggtaggttaaccggtaacgggtaaacgttcggttaacgggttacggttaaccgttttaagggtttaacccgtttacgttaacgggtacctaacgggtttaccgtttaagggtttacgttaccgggttaacggttacccgtacccggttaacccgtttcccggtttccggttaaacccggggtttccggggtaaccgggggtaccggtacccggggtttacggggacgtaaaccggttacgaaccggtaacggaccggttaacgggtggtaacccggtcgtacgtaccgaccttctttaacgtccgtttacttaccccgg

SEQ ID NO: 243799 - DNA, 830 bp, Homo sapiens
  misc_feature: GYAE6OF01EGDDK.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgtgtctgtgggcgaggacggccacatcgagtgacaacgtccagcgagtacttcttttatattagtcgtacaaacgaataaggtacttatttagtcgttaggtatacaagaaccaaaaaccgaggaaccactacccttaaccttaaacgtcgtcctactacttcccgtccgtcggggacctaccgttaccccggtaccccggggaccgtaaccccgggtaccgttccccgtaccggtaaccgtacttaccggaggtccgggacgtacgggtccggggtacggtacggggaacctacggtacctttaccgtacttcccgtaccgacctaactaccgtacgtaccctaaccgtggaaccgtaacggtccgtaaggaacggttgttacgggtacggttaacgtttaacggtttttaacgttaccgtttacgtaacgtacggtacgtttaaagtttacgggtttaggttaacggaaccgttccccgttaccgtacccgtttaccgttaacccggggtttcgggggaaccgggttaacccgggggtacggtaccgggggttaggggaaaccgtaagttaacccgggtaaacgggttaaaccggggtacgttacgggggttaccgcccggggttaaacgtaccctaccgtttacgttcgtttcccgttacccggtttaacccg

SEQ ID NO: 243800 - DNA, 755 bp, Homo sapiens
  misc_feature: GYAE6OF01ANO1R.11.11.A11.1.454.CMB.1.raw
  modified_base (127)..(127): a, c, t, g, unknown or other
  misc_feature (127)..(127): n is a, c, g, or t
  modified_base (725)..(725): a, c, t, g, unknown or other
  misc_feature (725)..(725): n is a, c, g, or t
tcagcgagagataccacgaccggtgctcgatttagctacgactgcaggggcagcaagatggtgttgcagacccaggtcttcatttctctgttgctctggatctctggtcgcctggtggggacatccngatcgacccacgtccccaagatactccgtgcctgtcgtctcgtgggcgagacgggccaccatcggagtcgactaacgtccacggagacgtactttcttttaagtatagtcgtacgaacgtaagtaaggtacttagtttagtcgttaggtatacaacggtaaaccaaaaccgacggaccacgtaccctactaaactcgcctacactccgtcgtggcctacgtcccggtacccgggaccgtaacccggtaccgtccccgtagtacccgttatacggtcggtcggaccgtacgggtccgggtacgttacgggactaaccggttctacgtaccttaccgtaccaacgtacgtacaccgtaccgtaaccgtacggccgaacggtacggtaagtaacgggtacctttagggtaccggttaacttttaacggtttaacgttaccgttacgtaccgaaggttacgtaaacgtttttagggtacgttaaacgggcccgttaccggtacccgttacccggtaccgtttacccggggttaccgggggtaccggacgggtacccggtacgggagacctacggtaacgcggtaacgtacggtgggtcgacncgtacccacttcccgttatgttccgtaccc

SEQ ID NO: 243801 - DNA, 781 bp, Homo sapiens
  misc_feature: GYAE6OF01AYF77.11.11.A11.1.454.CMB.1.raw
  modified_base (93)..(93): a, c, t, g, unknown or other
  misc_feature (93)..(93): n is a, c, g, or t
tcagcgagagataccacgaccggtgctcgatttagctacgactgcaggggcagcaagatggtgttgcagacccaggtcttcatttctctgttnctctggatctctggtcgcctgtggggacatcctgatcgaccacgtcccagatactcctgcctgtgtctcgtggcgagacgggccacatcggagtgacgacgtaccagacgaacgtacttcttttaagtagtaacggttcgtaacgaaacggtaacgttaaagggtaactttaaggttttaacgtaccgttttagggtaactacgtaaacgaaaccgtaaaaaaccgacggaacctaacggtacccttaaccgttaaaacgtctacgtaccttactaccgttaccgtacgggactacgttcccggaacccggaccgtacccggtacgtccctacggtaccgtacgttacgtaggacgtacggacggtcgggtaccgaggaacgtacgtaccgttacgtacctctacctaaccgtactacgacgtaaccacgttacgaccggaagttaccaaggtacgtacggttacggtacggtaaactttaggttttaactaccgttgggtacctaacgggtacgtagttttaagtgtacggtaacccgtaccgtaccgtacgtacccggttaacggggttcggaccgggtaagggtacccggtaagggtacgggaacttacgaacggtaacggaaccgttacgggacgttcgggaaactcggtaaacccacggttattaccggttattcctaaccgg

SEQ ID NO: 243802 - DNA, 723 bp, Homo sapiens
  misc_feature: GYAE6OF01AN8I6.11.11.A11.1.454.CMB.1.raw
  modified_base (151)..(151): a, c, t, g, unknown or other
  misc_feature (151)..(151): n is a, c, g, or t
  modified_base (388)..(388): a, c, t, g, unknown or other
  misc_feature (388)..(388): n is a, c, g, or t
  modified_base (455)..(455): a, c, t, g, unknown or other
  misc_feature (455)..(455): n is a, c, g, or t
  modified_base (708)..(708): a, c, t, g, unknown or other
  misc_feature (708)..(708): n is a, c, g, or t
tcagcgagagataccacgaccggtgctcgatttagctacgactgcaggggcagcaagatggtgttgcagacccaggtcttcatttctctgttgctctggatctctggtcgcctggtggggacatcctgatcgaccacgtcccagatatccngctgtcgtctcgtgggcgaggacgggccaccagtcgagtcgacacgtccgagcgaagtcttacttttatagtagtgacaacgtataaggacttattagtcgttaggtatcaagaaccaaaacgacggacaccgtcctaaccctaatcgtctactactcccgtaccggtgactaaccgtcccgggtaccccgggtaccaaccccggggtccgttccccgtacggaaccgtcttccggngcgggtccgagggtccggggtcgtacggggaccgtacttacgttcccattacccgtaccacgtaacnccgtaacgaccctaccgtgaccggacggtacaggtaacggtagtcggtcgtaacttttacgtactttaacgtcgctaaggtcctaaggtttacgttaggtacggtaacttcccgtacgtacctttaccggtaccgggtttacggggaccgggtaccgggtaccgggtccggggttaggacctaacggtacggtaaccggtaggttaccggttgggacccggtcgtacgtaccccgtacgtaggttacccgttnttacccggtaccccg

SEQ ID NO: 243803 - DNA, 867 bp, Homo sapiens
  misc_feature: GYAE6OF01A4NLU.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatactcctgccttgtgtctcgtgggcgaggacgggccaccatcggagtcgacgaacgtccgagcgacgtacttacttttatatagtcgtacgaacgaagtaacggtacttagtttagcgtttaggtactaccgaacgaaaccaaaaaccgacggtaaccaccggtacccttaacccgtaaaacttccgtaccttacctaacctccgttccggtacgggtacccttaccggttacccccgggttacccccggggaacccggaacccccgggttacccggttacccccgttaccgggtaaaccccgttacgttaccggaacgggtaccggggtaccgggtaaccggggtccgggggtttaccgggtaacgggggtaacctaaccgtttaaccccgtttacccgtaccgttaccccgttaacccaacccttaacgtacccgacccgtaacccgtaacccgttcggaaccggcgggttacctaagggtaaacggtggttacggtaacggtacttttaaacgggttctttacggttcgacgtacggtacctaagtttacgttagtaacggtccggttcgcccgtaccgtttacggtaccggtttcgggggaccggggtacgggaccgggttgggtaccgtacggtacggtaacccgtaggtaaccgtaggggttacgggtcggtacgtacgacccctaagttaccctggttaccctttcgttcccgg

SEQ ID NO: 243804 - DNA, 748 bp, Homo sapiens
  misc_feature: GYAE6OF01C3M9K.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctcgtgggcgaggacggccacatcgagtcgacaacgtccagcgacgtacttacttttatagtagtgtacgaaacgtataaaggtacttaagttttacgcgttaggtaactcgaacggaacctaaaaaaccgaggtaaccaacgtacccttaaccttaaaaccgtgtaccttccgaacttccgtcccgttcggggacctaaccgttacccgtaaccccggggcccgaacccgggtacgttaccccgtaacgaacccggtacttaccgaaggttcggaccgaacggttccggggtacgtacggggaactacggtaacctttcgaaccttccgtaccctaaacgtataccgtaacgaacccgtaacctgggtacaacgggtcctaagggaacgtagttcggtacggtaaccttaggttttaccgtacgtgttaaccagtactaggttattcggtaagaaccgtcctcccgtacgtacgtttaccggttcgggtacgggaccgggtaccggtgggtacgaccgtagtaccgaacggtaacgtacggtgttaccggcgttaacgtacccgtaaccttattcccggtcttccgtaacg

SEQ ID NO: 243805 - DNA, 696 bp, Homo sapiens
  misc_feature: GYAE6OF01BZ5FP.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtgggacatcctgatgacccacgtcccagtatatcctgtcctgtgtctcgtgggcgagacgggccaccgatcggagtgacaacgtccgagcgagtacttacttttaatagtagtcgtacaacgtaataaggtacttaagtttacgcgttaggtactacgaacgaaaccaaaacgacgacctacgtacctaacctaacgtcgtacctactactccgtccggtacggaccgtaccggtacccggtacccgggacccgtacccggtaccgtccgtacggtaccgtacgtacgtacggtacggcggtacggtcggtacgtacggaacgtacgtacctacctacctacctaccaccgtactaccgacgtaccgtaacgtacgacgtacgtacgaaggtacgtagtcggtacgttacgtttaacgtttacgtacgtacgtacgtacgtacgttagttagtacggacgtaccgtaccgtaccgtaccgttaccgtacgggtacgggacgggtacggtacggtacggtagtacgtacgacgtaacggtacgtacggtcggcgtacgtacgacctcgtacgttcgtcgtctcg

SEQ ID NO: 243806 - DNA, 758 bp, Homo sapiens
  misc_feature: GYAE6OF01AJJYM.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtgggacactcctgatcgaccacgtcccagatactccgtgccttgtgtcctcgtgggacgaggacggccaaccacgtacgacgtcgacgtaacgtaccagcgacgtacttcttttagagttagtacgtacgaaacgtaacgttaaggtactttagtttacgtacgtttaggtactacgaacgtaaaacgaaaaaccgacggaactaaccgtaccttaaccgtaaactcgtaccttacaccttaccgtcggtcgacctacgtacccggttaccccgggaccgacccgggtacgtccccgtacgtaccgtacgtacggtaggtcggaccgtacgggtcgggttaccggacggtacgtaacgtacccttaaccgtacctcgtaaccctaacgtaccgtacgaaccgtaccaccgttgaaccggacgtagtaacgtaacggtagttacgggtacgttaacgtttacggtttactaacgtcgtaacgtaacgtggttaacgtttagtacgacgtaaccgtccgttcgtaccgttcgtttacggttcgggtacggaacgggttccgaggaccgtaacgtcggtaaccgtaacgaccggttaaggtcgttaccggtctaacggcctaacgttacgtcttccgtttacgtacc

SEQ ID NO: 243807 - DNA, 624 bp, Homo sapiens
  misc_feature: GYAE6OF01EJI5Z.11.11.A11.1.454.CMB.1.raw
  modified_base (217)..(217): a, c, t, g, unknown or other
  misc_feature (217)..(217): n is a, c, g, or t
  modified_base (358)..(358): a, c, t, g, unknown or other
  misc_feature (358)..(358): n is a, c, g, or t
  modified_base (408)..(408): a, c, t, g, unknown or other
  misc_feature (408)..(408): n is a, c, g, or t
  modified_base (599)..(599): a, c, t, g, unknown or other
  misc_feature (599)..(599): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccacgtccccagatatcctgcctgtgtctcgtgggcgagacgggccacatcgagtgcaagtccagcgagacttcttttatatagtntacgaacgataaaggacttaagtttagcttggtatcagaacaaaaaccaggacacgacctacctaaactcgtctactactcctccgtcgggctacgtccgtaccccgggcgacccggtactcccgtacgaccgtattacgngtcggcgtaggccgggtcgtcgggacacgtacttcactctaccacctacncgacgtaccaacgtcgaccgtaggctaagaagtagtcggtacggttacttagttttactacgttcgtacgtacgtacgtagtttagttcggagaacgtccctccgtccttacgtacggttcggggacggtacggggccggtggtacggataccgtcggaacgtacgaacggttggaccgtcgtccgaaccncgtaacttcgttcgtcccgttaccg

SEQ ID NO: 243808 - DNA, 685 bp, Homo sapiens
  misc_feature: GYAE6OF01B8BZH.11.11.A11.1.454.CMB.1.raw
  modified_base (280)..(280): a, c, t, g, unknown or other
  misc_feature (280)..(280): n is a, c, g, or t
  modified_base (555)..(555): a, c, t, g, unknown or other
  misc_feature (555)..(555): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatcgaccacgtccccagatatcctgcctgtgtctcgtgggcgaggacgggccacctatcgagtgcaacgtccgagcgagtacttcttttatagtattcgtaccaaacggataaggtacttagtttagcgtttggtatcaagaacaaaaaccgngtacgacgcctacctaaatcgacctcactccttaccggcgggtactaccgttacccggtaccccgggccgtaaccccgggtacctcccgtacgacccgtacttcggaggtcgacggacggtcgggtaccgtaggggaacctagtcctttacgacccgttcgtaccaacctacgtaccgacgtacctaccgtcgacgtaggtacgtagaaggtagtcggtacgtagttagtttacgtagtcgtacgagtatagtttacgtcggtagtaaccgtccncggttaccttacgttacccgggtacgggccgggtaagggcccggtagggtaggtactacgtacggaccggtaaggtacccggtaggtccgtacgtcgtaaccctacgtctttcgtcgttaccgttacccg

SEQ ID NO: 243809 - DNA, 755 bp, Homo sapiens
  misc_feature: GYAE6OF01C54BZ.11.11.A11.1.454.CMB.1.raw
  modified_base (225)..(225): a, c, t, g, unknown or other
  misc_feature (225)..(225): n is a, c, g, or t
  modified_base (737)..(737): a, c, t, g, unknown or other
  misc_feature (737)..(737): n is a, c, g, or t
tcagcgagagataccacgaccggtgctcgatttagctacgactgcaggggcagcaagatggtgttgcacgacccaggtcttcatttctctgttgctctggatcctcgtggtgccgtggtggggacatcctgatcgacccacgtcccagactatcctgcctgtgtctcgtgggcgagacggaccacatcgagtcgacaacgtccaggcgagacctttacttttaanatagtgtacaaacgaataaggtacttatttagtctggtaactcaagaaaccaaaaaccgaggacctacgtacccttaaccctaaagtcgacctactacttccgtccgtcgggacctaccggttacccggaacccccggggacccgtaaccccgggtaccgttacccccgtacggtaaaccccgtacgttaccggacgggtcgggtaccgacgggttacccgggggtcgttaacggggaccgtaacgtaccgtttccaccgttcctacccgaacctacgtacgtaaccgacctacccggtagaccgtacggaacgtacgaaagtgttacgggtacggttaaacgtttgtttaacgttaccgtacggttaccgtaacgtacgttaagtttcgtagtacgaaccgttcccggtaccgtcgttaccggttaccggttcggggaccggtacgggtcccggtagggtacgaccgtacgacgacggtaccgtaaggtcggtacgcctactaccgacctnttactccgtcgttacccg

SEQ ID NO: 243810 - DNA, 702 bp, Homo sapiens
  misc_feature: GYAE6OF01DIHW1.11.11.A11.1.454.CMB.1.raw
tcagcgagagataccacgaccggtgctcgatttagctacgactgcaggggcagcaagatggtgttgcagacccaggtcttcatttctctgttgctctggatcttctggtgcctggtggggacatcctgactcgacccacgtccccagattactcctgtcctgtgtctcgtgggcgaggcggccaccatcgagtcgcaacgtccgagcgaagtacctttcttttaatacgtagttgaacgaacgtaagttaaaggtactttagttaggtcgttaggtaactacaacgaaccaaaaaccgacggaccacgtacctaacctaatcgcctctactccgtaccgtggctacgtcccggtacccgggcctacccgggtacgttccccgacggtacctagtcgtcggtcgacggaggtccgggtcgtaggaaccgtacgtaccttacgacctcgtaccacctataccgactaccgtactcgacgtacggtaacgtagaaacttgttcgtacgttaagttacttttaacgtcgtacgtagacgttacgtaacgttgttagtacgacggtccctccgtacgttcgtaccggttccggggacggggtacgggaccggttagggacgggtactaacgtacggaaacggttacgaacggttggtaccggtcgacccgtacctaaacgttctttaccgtcgtttcccgttacccg

SEQ ID NO: 243811 - DNA, 791 bp, Homo sapiens
  misc_feature: GYAE6OF01AZM20.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtgggacatcctgatcgacccacgtccccagatactcctgcctgtgtctcgtgggcgaggacgggcccaccagtccgagtggaccaacgtccagccgaagtaccttcttttaatatagtgtacaacgtataaacggtacttatttacgctttaggtactacgaacgtaaccaaaaacccgaggaaccaacgccctaccttaaacgtcgtacctactacttccgttccgtagggtcctacggttaccccggtacccggggaccgtaccccgggtaccggttaccccgtacggtaccgttaacgtttccgacggttacgggaccgaacgggtccggggttaccgtagggggaaccctaacgggtacccttaccgtacctaccgttacccaacctacgtaccgacgtacccgtaaacccgttcggaaccggacgggtcgttaacggtaaacgtttacggtttttacgtaacgttttacgtttttaccgtacggttacgtaaggtaccgttaagttaacgttaaccggttacgtaccggttacccgttaccgttacgtttaccgggtttacgggaacccgtaagggtaccaagtaaccgtaagaaacctaccgaaacgtccgttaggcgtacgtacacctaccgttactcggttctacccttatacccttccgtacccgtccg

SEQ ID NO: 243812 - DNA, 733 bp, Homo sapiens
  misc_feature: GYAE6OF01AI09G.11.11.A11.1.454.CMB.1.raw
tcagcgagagataccacgaccggtgctcgatttagctacgactgcaggggcagcaagatggtgttgcagacccaggtcttcatttctctgttgctctggatctcgtggtgcctgtggggacatcctgatgaccctacgtccccagtatactcctgtccttgtgtctcgtgggacgaggacggccaacctagtcgagtcgactaacgtccaggtcgagtaccttacgttttatagttagtcgtacgaacgtaagtaaggtacttagtttagaccgtttaggtactacgtaagtaaccaaaaacgacggaactaacgtacctaacctaaacgtcacctcaacttccgtaccgtcggacacttaccgacccggtccgaccggtaccgtaccgacgtacctagttacgagtcggacgacggtccgggtacgtacgggtaactacgtacttaccaccgtcctaccgtaactacgtccaacgacctaaccgtagacgtaacggacctaaggacgtcgttaggtacggtaactttaacgtttactacgtagtaccgtagtaccgtaaggttctagggtaactacggccccgttacgccctttaacggtccgggtttacgggacgggtaaccgggggtcccggtacggtacggtaaacgtccgtaaccggtaacgggtacgtaacggttggtaacccgggtatccgtaacccgacgttacgtttccgtgtttaccgtcccg

SEQ ID NO: 243813 - DNA, 865 bp, Homo sapiens
  misc_feature: GYAE6OF01BTJRW.11.11.A11.1.454.CMB.1.raw
  modified_base (819)..(819): a, c, t, g, unknown or other
  misc_feature (819)..(819): n is a, c, g, or t
tcagcgagagataccacgaccggtgctcgatttagctacgactgcaggggcagcaagatggtgttgcagacccaggtcttcatttctctgttgctctggatctctggtgccgtggtggggacactcctgatcgaccctcgtcccagatactcctcgtcctgtcgtcctcgtgggcggaggacgggccacctagtcgagtcgaccacgtccaggacgatactttactttatatagtacgactaacgagtaaggtacttagtttagtcttggtatacgtaaccgaaaccgtaaaaaccgaggaacctcggtaaccctaccgtaaaacgtcggtactccaaccgttcctcccgggttacgggaccctaccgttaccccgggtaaccccgggggtaccccgtaaccccgggtacccggttacccctaaacgggtacccgttaacgttcgacggggttacgccggggtaacgggttccggggtagggttaaccggggaaacccgttacgtaacccgttccctaccgtaacccgtttacaacccctagtaccggaaccgtacccctaacgtccggccggtacggaacggtaacggtacggtaacggtttacggggaccgtttaaccgtttacggttttaagtttacccggtaacgtcgttaaacggttcggttaaacgttagtttacgggacccgttacgtcccttacccgggttactttacccggttaccgggttttacggggggaacccggtaccggggtacccggggtagggttccccgaaggggtaacccggtagtacccgggttaagtacggttacgggntacccggtcgtaccgtcgttaacggtccctttggtaccccttcccg

SEQ ID NO: 243814 - DNA, 795 bp, Homo sapiens
  misc_feature: GYAE6OF01BCLQT.11.11.A11.1.454.CMB.1.raw
  modified_base (120)..(120): a, c, t, g, unknown or other
  misc_feature (120)..(120): n is a, c, g, or t
tcagcgagagataccacgaccggtgctcgatttagctacgactgcaggggcagcaagatggtgttgcagacccaggtcttcatttctctgttgctctggatctctggtgcctgtgggacntcctgatcgacccacgtcccagatactcctgcctgtgtctcgtggcgaggacggccacatcgagtgaccgtaacgtccagcgagtacttactttatagtagtcgtacaacgtataacggacttaagtttacgctttaggtaatacgaacgtaacaaaaaccgaggacacgtaccgtacctaaacgtgtctcctactccgtccgtcgggtaccacgtaccccggtacccgggacccgtaaccccgggtacgttaccccgtcgtaacccggtagttacgacggttccggccgtaacgggtcccgggttacgggtacgggaaccgtacgtaaccgttaccacccgttacctacccgaaccctataccgaccgtaccctaacgtccgtaaccggacggtacgtaagtaaacgtacggtttacggtacggttaacgtttaacggttttaccgttaaccgtttcggtaccgtaacgttaccggttaaagttttaacggttacgttaccggggaaaccttcccgggttacccgtacggtttaaccccggttacggtttacccgggggaccgggtaacggggccgggttacggacggtacgtacggttaccggaaccgtacgggtaacggtcgggtacgtccgtacccgtacgaccttaacgttccttacgttcccgttaccg

SEQ ID NO: 243815 - DNA, 480 bp, Homo sapiens
  misc_feature: GYAE6OF02IF8H8.11.11.A11.1.454.CMB.1.raw
  modified_base (255)..(255): a, c, t, g, unknown or other
  misc_feature (255)..(255): n is a, c, g, or t
  modified_base (381)..(381): a, c, t, g, unknown or other
  misc_feature (381)..(381): n is a, c, g, or t
  modified_base (413)..(413): a, c, t, g, unknown or other
  misc_feature (413)..(413): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctcctaaactgctcatctcctgggcatcctacccgggcacccggagtccctgaccgattcagtggcagcgggtctgggacagacttcactctcaccatcagcaacctgcaggctgaagntgtggctagtttattactgtcagctagtatgngaagctccgctcacgtttcgggcggaggccgnggtgagntcgagacatgtgctgcacatctgtcttc

SEQ ID NO: 243816 - DNA, 480 bp, Homo sapiens
  misc_feature: GYAE6OF02FGP7V.11.11.A11.1.454.CMB.1.raw
  modified_base (208)..(208): a, c, t, g, unknown or other
  misc_feature (208)..(208): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagcaaaaaccaggacagcctcctaaactgctcatctcctggcatctacccgggcacccggagtccctgaccgattcagtggcagcgggtctgggacagacttcactctcaccatcagcaacctgcaggctgaagatgtggcagttattactgtcagcagtatgtgagctccgctcactttcggcggacgggcgcggtggagatcgaagacgaactgtggctgcaccatctgtcttc

SEQ ID NO: 243817 - DNA, 499 bp, Homo sapiens
  misc_feature: GYAE6OF02IUQY0.11.11.A11.1.454.CMB.1.raw
  modified_base (208)..(208): a, c, t, g, unknown or other
  misc_feature (208)..(208): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctagaagatgtggctagtttatactgtcagctagtattgtgaagtctccgctcacgtttcgggcggagggaccgcgggtggagatcgaaggaaccgaacgttggtggctgccaccatcctgtcttc

SEQ ID NO: 243818 - DNA, 489 bp, Homo sapiens
  misc_feature: GYAE6OF02FZG1O.11.11.A11.1.454.CMB.1.raw
  modified_base (444)..(444): a, c, t, g, unknown or other
  misc_feature (444)..(444): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggctagtttattactgtcagcagtattgtgaagctccgcttcacgtttcggcggaggccgnggtgagatcgagacgaactgtggctgccacctagtcctgtcttcg

SEQ ID NO: 243819 - DNA, 619 bp, Homo sapiens
  misc_feature: GYAE6OF02HYROE.11.11.A11.1.454.CMB.1.raw
  modified_base (354)..(354): a, c, t, g, unknown or other
  misc_feature (354)..(354): n is a, c, g, or t
tcagcgagagataccacgaccggtgctcgatttagctacgactgcagggggcagcaagatggtgttcgcaggaccccaggtcttcactttctctgttgctctggatctctggtgcctgtgggacatcctgatgacccagtcccctagatatcctgccctgtcgtcctctgggcgagagggcccaccgatcaactcgccaagtccagtcaggaactcttttagacgtattccactaagagagattttgtagtttggtaccaacagaagccaggccaggccctaccaaagcagctactatttattgggactacttctaccgtcggggactttccggggtccctgaccgattcccgnggcaggtggactcgtggggactaaatttcaacttctacaccctatccaattcgcctgacaggctagaacgatggtaggctagctttaatttattcgttcgagactaattaattactacttacttaccttccgtacttcgtacgttttcggaccgtacgggggaaccacgggacgttacgggacgtactaccggaaggtaccggtaaacgttcggtacggtccgtacggaccgtaaccctacgttcccttcggtaccttttacccg

SEQ ID NO: 243820 - DNA, 482 bp, Homo sapiens
  misc_feature: GYAE6OF02G5QOE.11.11.A11.1.454.CMB.1.raw
  modified_base (379)..(379): a, c, t, g, unknown or other
  misc_feature (379)..(379): n is a, c, g, or t
  modified_base (442)..(442): a, c, t, g, unknown or other
  misc_feature (442)..(442): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggatccctgaccgattcagtggcagcgggtctgggacagacttcactctcaccatcagcaacctgcaggctgaagntgtgctagtttattactgtcagcagtattgtgaagctccgctcacgtttcggcggaggaccgnggtggagatcgaagacgactggtgctgcaccatctgtctc

SEQ ID NO: 243821 - DNA, 480 bp, Homo sapiens
  misc_feature: GYAE6OF02ID4F9.11.11.A11.1.454.CMB.1.raw
  modified_base (255)..(255): a, c, t, g, unknown or other
  misc_feature (255)..(255): n is a, c, g, or t
  modified_base (378)..(378): a, c, t, g, unknown or other
  misc_feature (378)..(378): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctactaaactgctcatctcctgggcatcctacccgggcacccggagtccctgaccgattcagtgcagcgggtctgggacagacttcactctcaccatcagcaactgcagctgaagntgtgctagtttatactgtcagcagtatgtgaagctccgctcgacgtttggcggaggaccgcggtggacgatcgaagacgagtgtgctgcaccatctgtcttc

SEQ ID NO: 243822 - DNA, 507 bp, Homo sapiens
  misc_feature: GYAE6OF02H96EB.11.11.A11.1.454.CMB.1.raw
  modified_base (387)..(387): a, c, t, g, unknown or other
  misc_feature (387)..(387): n is a, c, g, or t
  modified_base (401)..(401): a, c, t, g, unknown or other
  misc_feature (401)..(401): n is a, c, g, or t
  modified_base (505)..(505): a, c, t, g, unknown or other
  misc_feature (505)..(505): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaaacgataaggactatttagcttggtatcagacaaaaaaccaggacagcctactaaactgctcatctcctgggcatctacccgggcacccggagtccctgaccgattcagtggcagcgggtctgggacagacttcactctacaccatcagcaacctgcaggctgaagatgnggctagtttatacngtcagctagtatttgatttgttactaatccggctaccttcggaccgaaagggccctaggtgtaggaaatcgaaaacgtactggtggctgccacattctgtcttnac

SEQ ID NO: 243823 - DNA, 501 bp, Homo sapiens
  misc_feature: GYAE6OF02G0JZH.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggacatctacccgggcacccggatccctgaccgattcagtggcagcgggtctgggacagacttcactctcaccatcagcaacctgcaggctgaagatgtggcagtctattactgtcagcagtattgtgaagctccgctctactttcgggcggtacgggaccgcgggtggacgagtcgaaggaaccgtaacgtggtggcctggccaccattcgtgtcc

SEQ ID NO: 243824 - DNA, 482 bp, Homo sapiens
  misc_feature: GYAE6OF02HY7DQ.11.11.A11.1.454.CMB.1.raw
  modified_base (408)..(408): a, c, t, g, unknown or other
  misc_feature (408)..(408): n is a, c, g, or t
  modified_base (440)..(440): a, c, t, g, unknown or other
  misc_feature (440)..(440): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctctaaactgctcatctcctgggcatctacccgggcacccggatccctgaccgattcagtggcagcgggtctgggacagacttcactctcaccatcagcaacctgcaggctgaagatgtggctagtttatactgtcagcagtatgngaagctccgctcacgtttcggcggaggaccgnggtggagatcgaggacgaactgtacgctgcaccatctgtctc

SEQ ID NO: 243825 - DNA, 508 bp, Homo sapiens
  misc_feature: GYAE6OF02JEFBH.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtgctagtttatactgtcagcagtattgtgaagctccgctctacgtttcgggcggtacgggaccgcgggttggagtatcgaacggacgtaacgtggtcggactcggcaccctagtcgtgtccttacc

SEQ ID NO: 243826 - DNA, 703 bp, Homo sapiens
  misc_feature: GYAE6OF02H54EL.11.11.A11.1.454.CMB.1.raw
  modified_base (207)..(207): a, c, t, g, unknown or other
  misc_feature (207)..(207): n is a, c, g, or t
  modified_base (254)..(254): a, c, t, g, unknown or other
  misc_feature (254)..(254): n is a, c, g, or t
tcagcgagagataccacgaccggtgctcgatttagctacgactgcagggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggctatttagcttggtatcagacaaaaaccnggacagcctacctaaactgactcatcctccgtgggcatccgtacccgggcaaccccggacgttccctacgaacccgtacttaccgaggttcggacacggtccggggttactcgggggaacacggtactttaccgaccttcctaccaacccgtaacttccgaaacgcctaaacccgttgaccgtaacgggccttaaggaaacgtagttcgggtacggtaccttaaggtttttaacttaacgttggttaccagtaccgtaggtttaattcggtaggtaaacgtcccgttacccgtacgttaccgtaaccggttttccgggaccggggtaacgggaaccccgggttcggggttaggaacggttaccgtacggaacggtaaaccggtaacgttgggttacgggccttacggtacccgaacccgttaagtttccgttacgttccgtttaacccg

SEQ ID NO: 243827 - DNA, 481 bp, Homo sapiens
  misc_feature: GYAE6OF02GVI5N.11.11.A11.1.454.CMB.1.raw
  modified_base (420)..(420): a, c, t, g, unknown or other
  misc_feature (420)..(420): n is a, c, g, or t
  modified_base (442)..(442): a, c, t, g, unknown or other
  misc_feature (442)..(442): n is a, c, g, or t
  modified_base (478)..(478): a, c, t, g, unknown or other
  misc_feature (478)..(478): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaaactgctcatctcctgggcatctacccgggcacccggagtccctgaccgattcagtggcagcgggtctgggacagacttcactctcaccatcagcaacctgcaggctgaagatgtggcagtttatactgtcagcagtatgtgaagctccgntcactttcgggcggaggaccgnggtgagatcagacgaactgtggctgcaccatctgtnttc

SEQ ID NO: 243828 - DNA, 497 bp, Homo sapiens
  misc_feature: GYAE6OF02GZTU7.11.11.A11.1.454.CMB.1.raw
  modified_base (416)..(416): a, c, t, g, unknown or other
  misc_feature (416)..(416): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggctagtttattactgtcagcagtattgtgaanctccgctcacgtttcgggcggagggaccgcgggtggagatcgaacggacgaacgtgtaggcttggcaccatcgtgtcttcg

SEQ ID NO: 243829 - DNA, 490 bp, Homo sapiens
  misc_feature: GYAE6OF02HDZXA.11.11.A11.1.454.CMB.1.raw
  modified_base (255)..(255): a, c, t, g, unknown or other
  misc_feature (255)..(255): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctcctaaactgctcatctcctgggcatctacccgggcacccggatccctgaccgattcagtggcagcgggtctgggacagacttcactctcaccatcagcaacctgcaggctagaagatgtggctagtttatactgtcagcagtattgtgaacgctcgcttctacgtttcggcggacggaccgcgggtggagatcgaagacgaacgtgtcgctgccacatctgtcttc

SEQ ID NO: 243830 - DNA, 486 bp, Homo sapiens
  misc_feature: GYAE6OF02H7TXJ.11.11.A11.1.454.CMB.1.raw
  modified_base (255)..(255): a, c, t, g, unknown or other
  misc_feature (255)..(255): n is a, c, g, or t
  modified_base (381)..(381): a, c, t, g, unknown or other
  misc_feature (381)..(381): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagcaaaaaaccnggacagcctcctaaactgctcatctcctgggcatcctacccgggcaccccggagtccctgaccgattcagtggcagcgggtctgggacagacttcactctcaccatcagcaacctgcaggctgaanatgtggctagtttattactgtcagcagtatgtgaagctccgctcacgtttcggcggagggaccgcggtggagatcgagacgaatgtggctgcacatctcgtcttc

SEQ ID NO: 243831 - DNA, 527 bp, Homo sapiens
  misc_feature: GYAE6OF02HJAXD.11.11.A11.1.454.CMB.1.raw
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagacaaaaaccaggacagcctctaaactgctcatctcctggcatccgtacccggcacccggatccctgaccgattcagtgcagcgggtctgggacagacttcactctcaccatcagcaacctgcagctagaagntgnggctagtttatactgtcagcagtatgtgaagtcctccgctctacgtttcgggcggtagggaccgcgggtaggacgtactcggaaggaccgtaaacgttcgggtacggccttcggacctaacccgtagttcgttacggttccttaccg

SEQ ID NO: 243832 - DNA, 485 bp, Homo sapiens
  misc_feature: GYAE6OF02G91ZC.11.11.A11.1.454.CMB.1.raw
  modified_base (442)..(442): a, c, t, g, unknown or other
  misc_feature (442)..(442): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaactgcaggctgaagatgtgctagtttatactgtcagcagtatgtgaagctcgctctacgtttcgggcggacgggccgngggtgagatcgagacgaactgtggctggcacctatctgtcttc

SEQ ID NO: 243833 - DNA, 540 bp, Homo sapiens
  misc_feature: GYAE6OF02GVC9S.11.11.A11.1.454.CMB.1.raw
  modified_base (387)..(387): a, c, t, g, unknown or other
  misc_feature (387)..(387): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatcctacccgggcacccggagtccctgaccgtattcagtggcaggcgggtctgggacagtacttcactctacaccatcagcaacctgcaggctgaagntgtgctagtttattactgtcagctagtattgtgaagtctccgctcgtacgtttcgggcgggtacgggacccgtcgggtggagtacgtacgaacggtaaccggtaacgtcggttacggcttcggacctaccgtagttccgttcggttcttaccg

SEQ ID NO: 243834 - DNA, 485 bp, Homo sapiens
  misc_feature: GYAE6OF02F5T6C.11.11.A11.1.454.CMB.1.raw
  modified_base (255)..(255): a, c, t, g, unknown or other
  misc_feature (255)..(255): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctcctaaactgctcatctcctgggcatcctacccgggcacccggatccctgaccgattcagtggcagcgggtctgggacagacttcactctcaccatcagcaacctgcaggctgaagatgtggcagcttattattgtcagcaatattatacttctcttccgatctactttcgcctagggaccaggctggagtatcagacgtaactgtcggctgcactatctcg

SEQ ID NO: 243835 - DNA, 495 bp, Homo sapiens
  misc_feature: GYAE6OF02IVU9M.11.11.A11.1.454.CMB.1.raw
  modified_base (256)..(256): a, c, t, g, unknown or other
  misc_feature (256)..(256): n is a, c, g, or t
  modified_base (382)..(382): a, c, t, g, unknown or other
  misc_feature (382)..(382): n is a, c, g, or t
  modified_base (451)..(451): a, c, t, g, unknown or other
  misc_feature (451)..(451): n is a, c, g, or t
  modified_base (487)..(487): a, c, t, g, unknown or other
  misc_feature (487)..(487): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccnggacagcctacctaaactgctcatctcctgggcatccgtacccgggcacccggatccctgaccgattcagtggcagcgggtctgggacagacttcactctcaccatcagcaactgcaggctagaantgtgctagtttatactgtcagcagtattgtagaagtcctccgctcgtacgtttcgggcggacgggccgnggtggagacgtcgaagacgaactggtcgctgcaccntctgtctc

SEQ ID NO: 243836 - DNA, 484 bp, Homo sapiens
  misc_feature: GYAE6OF02GXHS2.11.11.A11.1.454.CMB.1.raw
  modified_base (419)..(419): a, c, t, g, unknown or other
  misc_feature (419)..(419): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggctagtttatactgtcagcagtatgtgaagctcgntcactttcgggcgagggaccgcggtgagtatcgaaggacgaactggtggctgcaccatctgtctc

SEQ ID NO: 243837 - DNA, 520 bp, Homo sapiens
  misc_feature: GYAE6OF02GEFV0.11.11.A11.1.454.CMB.1.raw
  modified_base (208)..(208): a, c, t, g, unknown or other
  misc_feature (208)..(208): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagcaaaaaccaggacagcctcctaaactgctcatctcctgggcatcctacccgggcacccggagtccctgaccgattcagtggcagcgggtctgggacagacttcactctcaccatcagcaacctgcaggctgaagatgtggctagtttattactgtcagcagttattgtgaagctccgctcacgtttcggcggagggaccgcgggtaggagtatcgaaggtaccggtaacgtgggtacggcttggaccctaaccgtagttccgttggtcccttac

SEQ ID NO: 243838 - DNA, 490 bp, Homo sapiens
  misc_feature: GYAE6OF02INFOM.11.11.A11.1.454.CMB.1.raw
  modified_base (255)..(255): a, c, t, g, unknown or other
  misc_feature (255)..(255): n is a, c, g, or t
  modified_base (473)..(473): a, c, t, g, unknown or other
  misc_feature (473)..(473): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctctaaactgctcatctcctgggcatctacccgggcacccggagtccctgaccgattcagtcgcagcgggtctgggacagacttcactctcaccatcagccaacctgcaggctagaagatgtggctagtttattacgtgtcagtcagtatgtagaagctccgctctactttcgggcggacggccgcggtggagatcgaagacgactgtcgntgacaccatctgtctcg

SEQ ID NO: 243839 - DNA, 787 bp, Homo sapiens
  misc_feature: GYAE6OF02IENSX.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggacgggccaccatcgagtgcaagtccagcgagacttcttttatatagtgtacaacgataaggacttattagcttggtatcagacaaaaaccaggacacgcctacctaaactgctcatctccgtgggctatccgtacccgggccaccccgggacgttcccacggaccgtacttcgaggtcggacgacggtccggggtcgtacggggacacgtaccttcgacctcctacacctactaccgacgacccaaccgtgaccgaggtcctaaggaaacgtagttacgggtagggtaccgtttaaaggtttttaacgtttaaccgttacggttaccgtaacggtaccgtttaaacggtttagttttaacgggttaacggtaaaccgggttcccgttacccccggtaccgttttacccggtttaacccggggtttttcccgggggaacccgggggggttaaaccgggggtaccccggggttacggggggttacgggtaacgggttaaccggttaccgggaaaccgggttaaacccggttaacgggttcgggttaccgggtacccgttacgggtaacccgtaacccgttacggtttacccgtttccgggtttacccttttaaccccgg

SEQ ID NO: 243840 - DNA, 529 bp, Homo sapiens
  misc_feature: GYAE6OF02IS1YN.11.11.A11.1.454.CMB.1.raw
  modified_base (358)..(358): a, c, t, g, unknown or other
  misc_feature (358)..(358): n is a, c, g, or t
  modified_base (387)..(387): a, c, t, g, unknown or other
  misc_feature (387)..(387): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatcctacccgggcacccggagtccctgaccgtattcgagtggcagcgggtctgggacagacttcactcncaccatcacgcaacctgcaggctagaagntgtgctagtttatatgtcagctagtatgtagaagcctccgcttcgacgtttcgggacgggtacgggaccgcgggttaggagtacgtcgaaggaccgtaacgtggtacggctcggacctaccgtagtcccttgttccttaccg

SEQ ID NO: 243841 - DNA, 536 bp, Homo sapiens
  misc_feature: GYAE6OF02JEBLX.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctggcatccgtacccgggcacccggatccctgaccgattcagtggcaggcgggtctgggacagacttcactctcaccatcagccaactgcaggctagaagatgtggctagtttattactgtcagctagttattgtgaagtcctccgctctacgtttcgggacggtacgggaccgcgggtaggagtacgtccgaaggtaccggtaacgttggtacggtccgtcggtaccaaccgtattcgttcgttccttaccg

SEQ ID NO: 243842 - DNA, 494 bp, Homo sapiens
  misc_feature: GYAE6OF02HIR30.11.11.A11.1.454.CMB.1.raw
  modified_base (385)..(385): a, c, t, g, unknown or other
  misc_feature (385)..(385): n is a, c, g, or t
  modified_base (452)..(452): a, c, t, g, unknown or other
  misc_feature (452)..(452): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaaccaggacagcctcctaaactgctcatctcctgggcatcctacccgggcaccccggagtccctgaccgattcagtggcagcgggtctgggacagacttcactctcaccatcagccaacctgcaggctgaagntgtggctagtttattacgtgtcagcagtattgtgaagtctccgctctacgtttgggccggaggccgnggtggagatacgagacgacgtgcgcngcactntctcgtnttc

SEQ ID NO: 243843 - DNA, 483 bp, Homo sapiens
  misc_feature: GYAE6OF02H5PG1.11.11.A11.1.454.CMB.1.raw
  modified_base (208)..(208): a, c, t, g, unknown or other
  misc_feature (208)..(208): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaaacgataaaggactatttagcttggtatcagcaaaaaaccaggacagcctctaaactgctcatctcctgggcatctacccgggcacccggagtccctgaccgattcagtgcagcgggtctgggacagacttcactctcacatcagcaactgcaggctgaagatgtggcagttttatactgtcagcagtatgtgaagctccgctcactttcggcggaggaccgcggtgagatcgaagacgaactgtggctgcaccagtctgtcttac

SEQ ID NO: 243844 - DNA, 527 bp, Homo sapiens
  misc_feature: GYAE6OF02GUKGF.11.11.A11.1.454.CMB.1.raw
  modified_base (422)..(422): a, c, t, g, unknown or other
  misc_feature (422)..(422): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactattagcttggtatcagacaaaaaccaggacagcctacctaaactgctcatctcctgggcatccgtacccgggcaccccggagtccctgaccgattcagtggcaggcgggtctgggacagtacttcactctcacatcagcaacctgacaggctagaagatgtggctagtttatacgtgtcagctagttattgngaagtcctccgctctacgtttcgggcgggacgggccgtgggtaggagacgtacgaaggaaccgtaacgtggtacggtcgtcgaccaccgtatcttcgtcttaccg

SEQ ID NO: 243845 - DNA, 504 bp, Homo sapiens
  misc_feature: GYAE6OF02GHALW.11.11.A11.1.454.CMB.1.raw
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
  modified_base (448)..(448): a, c, t, g, unknown or other
  misc_feature (448)..(448): n is a, c, g, or t
  modified_base (493)..(493): a, c, t, g, unknown or other
  misc_feature (493)..(493): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctggcatcctacccgggcacccggatccctgaccgattcgagtggcagcgggtctgggacagacttcactctcaccatcagcaactgcaggctgaagntgtggcagtctattacngtcagctagtattgtagaagtcctccgctctacgtttcggcggtagggccgnggtaggagacgtcgaagaccgaacgttgtcggcttcggaccaccnttccgtgttcc

SEQ ID NO: 243846 - DNA, 562 bp, Homo sapiens
  misc_feature: GYAE6OF02GZ1ME.11.11.A11.1.454.CMB.1.raw
  modified_base (256)..(256): a, c, t, g, unknown or other
  misc_feature (256)..(256): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
  modified_base (387)..(387): a, c, t, g, unknown or other
  misc_feature (387)..(387): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgtataaggactatttagcttggtatcagcaaaaaccnggacagcctcctaaactgctcatctcctggcatcctacccgggcaccccggngtccctgaccgnttcagtgcaggcgggtctgggacagtacttcacttcgtccaccatcgagcaacctgcaggctgaagntggtcgactagtttattctgtcagctagtattgagaagtctccgctcgtacgtttcgggcgggtacggaccggtcgggtagggagtactacggaaggtaacccggtaaacgttcgggtacgggtccgttacggaccctaacccgttacgtttaccgttcggttaccctttaaccg

SEQ ID NO: 243847 - DNA, 541 bp, Homo sapiens
  misc_feature: GYAE6OF02GXZEE.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctctaaactgctcatctcctggcatctacccgggcacccggagtccctgaccgattcagtggcagcgggtctgggacagacttcactctcaccatcacgcaacctgcaggctagaagatgtggctagtttattactgtacagctagttattgtagaagtcctccgtctcgtacgtttcgggacgggtacgggtaccgcgggtaggacgtacgtacgaaggtaaccgaacgttggtacggtcgtacggacctaaccgtattccgttggttaccttaccg

SEQ ID NO: 243848 - DNA, 539 bp, Homo sapiens
  misc_feature: GYAE6OF02H57ZZ.11.11.A11.1.454.CMB.1.raw
  modified_base (208)..(208): a, c, t, g, unknown or other
  misc_feature (208)..(208): n is a, c, g, or t
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
  modified_base (382)..(382): a, c, t, g, unknown or other
  misc_feature (382)..(382): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagacaaaaaccaggacagcctactaaactgctcatctcctggcatctacccgggcaccggagtcccngaccgattcagtggcaggcgggtntgggacagacttcactctcaccatcagccaactgctaggctaggaantgtcggactagttttattactgtacagactagtattggtagtaacgccttccgcttcgtaccgttttcgggccgggtaacgggaccgtcgggtagacggtatccggacggaaccgtacgtggttacggcgtcgaccaccgtagtcttcgtacttacc

SEQ ID NO: 243849 - DNA, 527 bp, Homo sapiens
  misc_feature: GYAE6OF02HDBW7.11.11.A11.1.454.CMB.1.raw
  modified_base (315)..(315): a, c, t, g, unknown or other
  misc_feature (315)..(315): n is a, c, g, or t
  modified_base (332)..(332): a, c, t, g, unknown or other
  misc_feature (332)..(332): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (465)..(465): a, c, t, g, unknown or other
  misc_feature (465)..(465): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagactcttttatatagtgtcaacgataaggactattagcttggtatcagacaaaaaccaggacagcctactaaactgctcatctctggcatccgtaccggcaccggcgtccctgaccnttcagtgcaggcggtcngggacagtacttcactctcaccatcagcaacctgcgaggctagaacgntgngactagtttatacgtgcagctagtattgagaacgtcctccgtactcgtaccgtttgggaccggacgggaccgcggtaggganacgtacgaaggtaccgtaagtcggtggcctacggaccctaccgtagttcgttagtccttacg

SEQ ID NO: 243850 - DNA, 502 bp, Homo sapiens
  misc_feature: GYAE6OF02FHB5J.11.11.A11.1.454.CMB.1.raw
  modified_base (209)..(209): a, c, t, g, unknown or other
  misc_feature (209)..(209): n is a, c, g, or t
  modified_base (255)..(255): a, c, t, g, unknown or other
  misc_feature (255)..(255): n is a, c, g, or t
  modified_base (378)..(378): a, c, t, g, unknown or other
  misc_feature (378)..(378): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttanatagtgtcaacgataaggctatttagcttggtatcagcaaaaaccnggacagcctctaaactgctcatctcctggcatctacccgggcacccggatccctgaccgattcagtggcagcgggtctgggacagacttcactctcaccatcagccaacctgcaggctgaagntgtggctagtttattactgtcagctagtattgtagaagcctcgctctacgtttcgggacggagggaccgcggtaggagactcgaagacgaacgtggtacggctgccaccgtatctcgttcttcc

SEQ ID NO: 243851 - DNA, 538 bp, Homo sapiens
  misc_feature: GYAE6OF02HMW6V.11.11.A11.1.454.CMB.1.raw
  modified_base (377)..(377): a, c, t, g, unknown or other
  misc_feature (377)..(377): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagcaaaaaccaggacagcctcctaaactgctcatctcctgggcatctacccgggcacccggagtccctgaccgattcagtggcagcgggtctgggacagacttcactctcaccatcagcaactgcagctgaagntgtgctagtttatactgtcagtcagtattgtgaagtcctccgcttccgtacgttttcgggaccgggtacgggacccggtgggtagggacgtacgttcgaaggaccgtaaacgtggtacggtcgtcggaccgaaccgtacgtttcgttacgttcctttaccg

SEQ ID NO: 243852 - DNA, 582 bp, Homo sapiens
  misc_feature: GYAE6OF02F4TQK.11.11.A11.1.454.CMB.1.raw
  modified_base (212)..(212): a, c, t, g, unknown or other
  misc_feature (212)..(212): n is a, c, g, or t
  modified_base (346)..(346): a, c, t, g, unknown or other
  misc_feature (346)..(346): n is a, c, g, or t
  modified_base (393)..(393): a, c, t, g, unknown or other
  misc_feature (393)..(393): n is a, c, g, or t
tcagcgagagataccacgaccggtgctcgatttagctacgactgcaggggcgagcaagatggtgttgcagacccaggtcttcatttctctgttgctctggatctctggtgcctgtgggacatcctgatgacccagtccccagatatcctggcctgtgtctctgggcgagagggccaccatcgagtgcaagtccgagcgagacttcgttttanatagtgtcaacgataaggactatttagcttaggtatcgagactaaaaaccaggacagcctacctaaactgctcactctcctgggcactcctacccgggcacccggatccctgatcgatcagtggcaggcggtcngggacagtacttcactctcaccatcagacaacctgccaggctagaangtggtggctagtttatacgtgtacagctagttatgtagaagtccgttaccgcttaccgtaccgtttcgggaccggtaacgggacccggtcgggttaggacggtacggttccggaacgggtaaccggtaaccgttgggtacggaccgttacggtacccgtaacccgtacgttcccgttacggttaccccg

SEQ ID NO: 243853 - DNA, 634 bp, Homo sapiens
  misc_feature: GYAE6OF02I3V6J.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatgacccacgtccccagatatcctgcctgtgtctcgtgggcgaggagggcccaccatcgagtgcaacgtccagcgagtacttcttttatatagtgtacaacgataaggacttattagcttggtatcagacaaaaaccaggacagccctacctaaactgctcatcctccgtgggctactcccgtacccgggccaccccggacgtccctcgaccgtattccgagtcggccgacggccggggttcgtacggggacacggtaccttcaccttcctccaccctataccacgaccaaccgtgaccgtacggctaaggaagtagttcgggtggtacttaagttttacgttacgtgttacgagtactagttacgttggacgtaagtcctccgtcttaccgttaccgttcgggaccgggtacgggaccgtcggggtaggacgtacgtacggaacggaaccgtacggttggtacgggcctacggcctaaccgtacgttcgttacggttcttaacccg

SEQ ID NO: 243854 - DNA, 505 bp, Homo sapiens
  misc_feature: GYAE6OF02HQDKV.11.11.A11.1.454.CMB.1.raw
  modified_base (310)..(310): a, c, t, g, unknown or other
  misc_feature (310)..(310): n is a, c, g, or t
  modified_base (428)..(428): a, c, t, g, unknown or other
  misc_feature (428)..(428): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgcctctgggcgagagggccaccatcgagtgcaagtccagcgagactcttttatatagtgtcaacgataaggactattagcttggtatcagacaaaaaaccaggacagcctacctaaactgctcatctcctgggcatcgtacccgggcaccccggngtcccctgaccgattcagtggcagcgggtctgggacagacttcactctcacatcagccaacctgacaggctagaagatgtggctagtttatactgtcagcagtattgtgaagctccgntctacgtttcgggcggacggaccgtgggtggagactcgaaggaccgaacgtggtcggctggccaccatctgtcttac

SEQ ID NO: 243855 - DNA, 566 bp, Homo sapiens
  misc_feature: GYAE6OF02HVV4Q.11.11.A11.1.454.CMB.1.raw
  modified_base (404)..(404): a, c, t, g, unknown or other
  misc_feature (404)..(404): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgactcatctcctgggcatccgtaccccgggcaccccgggagtcccctggaccgtattcaggtgggcaggcggggtctcgggacaggtaccttcactctccaccatccagccaacctgcaggctagaagtntgtggacttagttttacttacgtgttcagtctagtttattggagaacgcctccgcttccgtacgtttccgggacgggacgggccgtcgggtggagtagtccgaaggtaacccgaacgtggtaccgggcttacggacctacccgtattccttcgtcctttacc

SEQ ID NO: 243856 - DNA, 487 bp, Homo sapiens
  misc_feature: GYAE6OF02HTHST.11.11.A11.1.454.CMB.1.raw
  modified_base (380)..(380): a, c, t, g, unknown or other
  misc_feature (380)..(380): n is a, c, g, or t
  modified_base (445)..(445): a, c, t, g, unknown or other
  misc_feature (445)..(445): n is a, c, g, or t
  modified_base (478)..(478): a, c, t, g, unknown or other
  misc_feature (478)..(478): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaaccaggacagcctctaaaactgctcatctcctgggcatcctacccggcacccggagtccctgaccgattcagtggcagcgggtctgggacagacttcactctcaccatcagcaactgcagctgaagntgtgctagtttatactgtcagctagtatgtagaagcctccgctctacgtttcggcgggaggccgnggtgagatcgaagacgaatgtacgctgccactntctgtctcg

SEQ ID NO: 243857 - DNA, 497 bp, Homo sapiens
  misc_feature: GYAE6OF02F6I2R.11.11.A11.1.454.CMB.1.raw
  modified_base (407)..(407): a, c, t, g, unknown or other
  misc_feature (407)..(407): n is a, c, g, or t
  modified_base (483)..(483): a, c, t, g, unknown or other
  misc_feature (483)..(483): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggctagtttatactgtcagcagtntgtgaagctccgctcacgtttcgggcggagggaccgcgggtggagagtcgaaggacgaactggtggctgaccaccngtccttgtcttacg

SEQ ID NO: 243858 - DNA, 537 bp, Homo sapiens
  misc_feature: GYAE6OF02HJN7P.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaaacgataaggactatttagcttggtatcagaccaaaaaaccaggaacagcctacctaaactgctcatcctccgtggcatccgtacccgggcacccggagtccctgaccgattcgagtgcaggcggtcgtgggacagacttcactctacaccatcagcaactgacagctagaagatgtagctagtttattactgtacagctagttattcggtagaacgtcctcgcttacgtacgtttcggacgggacggccggtggtaggacgacgtacgaacggtacgtaacgtggtcggctaggccaacgtagtccgttgtccttaccg

SEQ ID NO: 243859 - DNA, 528 bp, Homo sapiens
  misc_feature: GYAE6OF02HZHGH.11.11.A11.1.454.CMB.1.raw
  modified_base (408)..(408): a, c, t, g, unknown or other
  misc_feature (408)..(408): n is a, c, g, or t
  modified_base (456)..(456): a, c, t, g, unknown or other
  misc_feature (456)..(456): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatccgtacccgggccaccccggacgtcccctcgaccgattcaggtggcaggcgggtcgtgggacagacttcactctcaccatcagcacctgcagcagaagatgagctagtttatctgtnagctagttatgtgaagcctccgctctacgttcgggacgggaggaccgngggtagagacgtcgaaggtaccgaacgtggtacggcgtacggccaccgtacttcgttacggttcctttaccg

SEQ ID NO: 243860 - DNA, 554 bp, Homo sapiens
  misc_feature: GYAE6OF02JHNTT.11.11.A11.1.454.CMB.1.raw
  modified_base (255)..(255): a, c, t, g, unknown or other
  misc_feature (255)..(255): n is a, c, g, or t
  modified_base (389)..(389): a, c, t, g, unknown or other
  misc_feature (389)..(389): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggaacagcctcctaaactgactcatctcctgggcatcctacccgggcaccccggatcccctgaccgattcagtggcaggcgggtctgggacagacttcactctcaccatcagcaacctgcaggctagaagatgnggactagttttatactgtcagctagttattggtgaagccttccgcttccgtacgttttcggggcgggacggggacccgtcgggttagggacgtagtcgaacgggaaccgtaacgttgggtacgggcttacggacccaaccgtatttccgttacggttctttaccg

SEQ ID NO: 243861 - DNA, 620 bp, Homo sapiens
  misc_feature: GYAE6OF02HB6TH.11.11.A11.1.454.CMB.1.raw
  modified_base (209)..(209): a, c, t, g, unknown or other
  misc_feature (209)..(209): n is a, c, g, or t
  modified_base (601)..(601): a, c, t, g, unknown or other
  misc_feature (601)..(601): n is a, c, g, or t
tcagcgagagataccacgaccggtgctcgatttagctacgactgcaggggcagcaagatggtgttgtagacccaggtcttcatttctctgttgctctggatctctggtgcctgtggggacatcctgatgacccagtccccagatatcctgcctgtgtctctgggcgagagggccaccatcgagtgcaagtccagcgagacttcttttanattagtgtacaaacgaagtaaggtacttatttagcttaggtatcagaacaaaaaccaggaacacgacctacctaaatgctcactcctccgtggactacgtccgtacccgggccacccggacgtccccgtcgaccgtattcgaggtcggacgaggcggtcgtacggacgacgtacttcactccactaccatacacgaccacgtcgacgagctaagaacgagttcggtggtacttaagttttaacttacgtagttacgacgtacttaagttacgtttaggtaacgacggtccttacccggtaccttaccgttaaccggtttcgggacgggtaacgggtccggacgggtaggacgacgtacgacgtacgtaacgttggacgccgtagccaacgtnttcgtcttacctcgtaccc

SEQ ID NO: 243862 - DNA, 496 bp, Homo sapiens
  misc_feature: GYAE6OF02HXMLO.11.11.A11.1.454.CMB.1.raw
  modified_base (255)..(255): a, c, t, g, unknown or other
  misc_feature (255)..(255): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (479)..(479): a, c, t, g, unknown or other
  misc_feature (479)..(479): n is a, c, g, or t
  modified_base (487)..(487): a, c, t, g, unknown or other
  misc_feature (487)..(487): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagacaaaaaccnggacagcctactaaactgctcatctcctgggcatccgtacccgggcacccggacgtcccctgaccgattcagtggcagcgggtctgggacagtacttcactctacaccatcagccaacctgcaggctagaagtatgtgctagtttattactgtcagtcagtatgtagacgctccgctctacgtttcggcggaggccgnggngagntacgagtacgactggtcgntcgcaccntctcgtctc

SEQ ID NO: 243863 - DNA, 595 bp, Homo sapiens
  misc_feature: GYAE6OF02I5UT1.11.11.A11.1.454.CMB.1.raw
  modified_base (207)..(207): a, c, t, g, unknown or other
  misc_feature (207)..(207): n is a, c, g, or t
  modified_base (323)..(323): a, c, t, g, unknown or other
  misc_feature (323)..(323): n is a, c, g, or t
  modified_base (493)..(493): a, c, t, g, unknown or other
  misc_feature (493)..(493): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctctgggcgagagggccaccatcgagtgcaagtccagcgagactcttttanatagtgtcaacgataaggacttatttagcttggtatcagacaaaaaccaggacagcctactaaactgactcatctcctggcacgtcctacccgggcacccggagtccctgaccgtnttcagtggcaggcggtctagggacaggacttcactcctacaccatcacgaccaacctgaccaggcctagaagactgtggactagttttaattcgtagtcagtcagttagttgtagaacgtccgtaccgtcttacgtaccgttttcggggaccggtaacggggtacccggngggtaacgggtagtaacgttaccgaaacgggtaccggtaacgttagggtcggtacctacggtacccgtaaccgttacgtcgttttccgtacccgtttacccg

SEQ ID NO: 243864 - DNA, 560 bp, Homo sapiens
  misc_feature: GYAE6OF02I1YXH.11.11.A11.1.454.CMB.1.raw
tcagcgagagataccacgaccggtgctcgatttagctacgactgcagggggcagcaagatggtgttgcagacccaggtcttcatttctctgttgctctggatctctggtgcctgtggggacatcctgatgacccagtccccagatatcctgcctgtgtctctgggcgagagggccacatcgagtgcaagtccagcgagactcttttatatagtgtcaacgataaggactatttagcttggtatcagacaaaaaccaggacagcctcctaaactgctcatctcctgggcatccgtacccgggcaccccggagtccctgaccgattcagtgcagcgggtctgggacagacttcactctcaccatcagccaactgaccaggctagaagatgtcggctaagttttatacttgtacagctagtattgtagaacgtcctccggtacttccgtacgttttccgggacgggacgggtacccgtcgggttaggagtacgtacggtaacggaaaccggtaacgtggtacggcctacggacctaaccgtatccgtttacgtccctttaccg

SEQ ID NO: 243865 - DNA, 522 bp, Homo sapiens
  misc_feature: GYAE6OF02F4FV8.11.11.A11.1.454.CMB.1.raw
  modified_base (257)..(257): a, c, t, g, unknown or other
  misc_feature (257)..(257): n is a, c, g, or t
  modified_base (511)..(511): a, c, t, g, unknown or other
  misc_feature (511)..(511): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagcaaaaaaccnggacagcctacctaaactgctcatctcctggcatctacccgggcacccggatccctgaccgattcagtggcaggcgggtctgggacagacttcactctcaccatcagcaacctgcagctagaagatggtgactagtttatctgtacagcagttattggtagaacgccttccgtcttacgtaccgttttccgggacggtacggggaccgtcgggtggagatacgaacgacgaacgtggtcggctcggccaaccgntcgttgtcttc

SEQ ID NO: 243866 - DNA, 580 bp, Homo sapiens
  misc_feature: GYAE6OF02JLTT0.11.11.A11.1.454.CMB.1.raw
  modified_base (207)..(207): a, c, t, g, unknown or other
  misc_feature (207)..(207): n is a, c, g, or t
  modified_base (347)..(347): a, c, t, g, unknown or other
  misc_feature (347)..(347): n is a, c, g, or t
  modified_base (399)..(399): a, c, t, g, unknown or other
  misc_feature (399)..(399): n is a, c, g, or t
  modified_base (491)..(491): a, c, t, g, unknown or other
  misc_feature (491)..(491): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactctttanatagtgtcaacgataaaggactatttagcttggtatcaagacaaaaaccaggacagcctacctaaactgctacatcctccgtggcactcgtacccgggcaccccggactccctagaccgtattcgagtggcaggcgggtntgggacagacttcactctcacctatcagcaaccgtgccgaggctaggaagtntgcggacttaggtttactactgtacaggactacgttattgtagaacgtccttccggacttacgtacgtttcggggacggacgggtacccggnggttaggacgtacgtacggaacggtaacggtaccgttgggtacgtaccgtgtacccgaccgttagttccggtttagttacccttaccgg

SEQ ID NO: 243867 - DNA, 558 bp, Homo sapiens
  misc_feature: GYAE6OF02IVZ0O.11.11.A11.1.454.CMB.1.raw
  modified_base (392)..(392): a, c, t, g, unknown or other
  misc_feature (392)..(392): n is a, c, g, or t
  modified_base (413)..(413): a, c, t, g, unknown or other
  misc_feature (413)..(413): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagcaaaaaccaggacagcctcctaaactgctcatctcctgggcatccgtacccgggcaccccgggagtcccctgaccgattcaggtggcaggccgggtctgggacagacttcactctcaccatcacgcaacctgcaggctgaagatggngctagtttattactgtcagtntagtattggagaacgtcctccgcttaccgtacgtttccggggacggtacgggaccgcgggttaggagtacgttaccgaaggtaacccggtaacgttgggtcggaccttcggaccctaccgtagttccgttacgttcctttacccg

SEQ ID NO: 243868 - DNA, 518 bp, Homo sapiens
  misc_feature: GYAE6OF02JC4C0.11.11.A11.1.454.CMB.1.raw
  modified_base (207)..(207): a, c, t, g, unknown or other
  misc_feature (207)..(207): n is a, c, g, or t
  modified_base (254)..(254): a, c, t, g, unknown or other
  misc_feature (254)..(254): n is a, c, g, or t
  modified_base (389)..(389): a, c, t, g, unknown or other
  misc_feature (389)..(389): n is a, c, g, or t
  modified_base (423)..(423): a, c, t, g, unknown or other
  misc_feature (423)..(423): n is a, c, g, or t
  modified_base (460)..(460): a, c, t, g, unknown or other
  misc_feature (460)..(460): n is a, c, g, or t
  modified_base (471)..(471): a, c, t, g, unknown or other
  misc_feature (471)..(471): n is a, c, g, or t
  modified_base (489)..(489): a, c, t, g, unknown or other
  misc_feature (489)..(489): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcagagggccaccatcgagtgcaagtccagcgagactcttttanatagtgtcaacgataaggctatttagcttggtatcagacaaaaaccnggacagcctacctaaactgctcatctcctggctatcgtaccccgggcaccccggacgtccctgaccgattcgagtggcaggcgggtctgggacagacttcactctcaccatcagcaacctgacaggctagaagtntggtcgactgtttaatctgtcagtcagttatganagtcctccgatcgacgtttcgggcgggacggtccggnggtggacgtancgaaggaccgaagtcggngtcgtcgaccacctgttccgtgttctacc

SEQ ID NO: 243869 - DNA, 532 bp, Homo sapiens
  misc_feature: GYAE6OF02IEEWI.11.11.A11.1.454.CMB.1.raw
  modified_base (337)..(337): a, c, t, g, unknown or other
  misc_feature (337)..(337): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctctaaactgctcatctcctgggcatcctacccgggcacccggagtccctgaccgtattcgagtgcagcgggtntgggacagacttcactctcaccatcagccaacctgcgaggctagaagatgtggctagttttatactgtcagctaagtatgtagaagtcctccgtctacgtacgtttcgggacgggtacgggccgtcgggtaggagactacgaaggtaccgtaacgtggttacggcgtacggccaccgtactcgttcgtcttaccg

SEQ ID NO: 243870 - DNA, 560 bp, Homo sapiens
  misc_feature: GYAE6OF02I0DKA.11.11.A11.1.454.CMB.1.raw
  modified_base (368)..(368): a, c, t, g, unknown or other
  misc_feature (368)..(368): n is a, c, g, or t
  modified_base (531)..(531): a, c, t, g, unknown or other
  misc_feature (531)..(531): n is a, c, g, or t
  modified_base (546)..(546): a, c, t, g, unknown or other
  misc_feature (546)..(546): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagaggccaccatcgagtgcaagtccagcgagactcttttatatagtgtcaacgataaggactattagcttgtatcagacaaaaaccaggacagcctacctaaactgctcaatcctccgtgggccatccgtacccgggccaccccggacgtccctcgaccgtattcgagtggcaggcgggtcgtgggacagtacttcgactcncaccatacacgacaacctgcaaggctagaacgtatcggtaggaccttaaggttttacttactgtacagtctaagttacgttgtagaacgtctaccgactcgttaccggtttcgggaacgggcgggtaaccgcggggtagagacgtacgaggtaaccgacgtgnggcacggctaaccgnttcgtgtaccttcg

SEQ ID NO: 243871 - DNA, 539 bp, Homo sapiens
  misc_feature: GYAE6OF02IBEE7.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaaccaggacagcctacctaaactgctcatctcctgggcatccgtacccgggcacccggagtccctgaccgtattcagtggcacggcgggtctgggacagacttcactctacacatcagcaacctgcaggctagaagatgtgactagtttatactgtcagctagtatgtagaacgtctccgcttcctacgtttcgggcgggtaggtaccggttgggtggagtacgtccgaaggtaccggtaacgtggtcggccttggcccgtaaccgtacgttcgtcggttccttaccg

SEQ ID NO: 243872 - DNA, 661 bp, Homo sapiens
  misc_feature: GYAE6OF02GCTV8.11.11.A11.1.454.CMB.1.raw
  modified_base (147)..(147): a, c, t, g, unknown or other
  misc_feature (147)..(147): n is a, c, g, or t
  modified_base (215)..(215): a, c, t, g, unknown or other
  misc_feature (215)..(215): n is a, c, g, or t
tcagcgagagataccacgaccggtgctcgatttagctacgactgcaggggtcagcaagatggtgttgcagacccaggtcttcatttctctgttgctctggatctctggtcgcctgtggggacatcctggatcgacccagtccccagntatcctgcctgtgtctctgggcgagagggccaccatcgagtgcgaagtccagcgagacgttcttttanatagtgtacaacgataaggactatttagcttaggtatcaagacaaaaaccaggaccagcctacctaaaactggcctacactacctcctagggcctacgtccgtaaccccggggactaccccgggagtccccgtacgaccgtatttccgaggtggcaggcgggtctaggacacgacctcgctctacgacctataccgagacctaacgtcgacgacggtctaggtaagtattggttagggacgttaagttttacttacgttacgacgtagcgtaaggttacgtttagacgtaacgtccgtaccgtacgttaccgttaccggtttcggggaccgggtaaccgggtccgtaccgggtaggacgtacgtaacggaacggtaaccgtacgttacgggtccgtaccctacgggtacctaaccccgttagtaccgtttacgtccgtttaacccg

SEQ ID NO: 243873 - DNA, 506 bp, Homo sapiens
  misc_feature: GYAE6OF02HZQXY.11.11.A11.1.454.CMB.1.raw
  modified_base (256)..(256): a, c, t, g, unknown or other
  misc_feature (256)..(256): n is a, c, g, or t
  modified_base (385)..(385): a, c, t, g, unknown or other
  misc_feature (385)..(385): n is a, c, g, or t
  modified_base (388)..(388): a, c, t, g, unknown or other
  misc_feature (388)..(388): n is a, c, g, or t
  modified_base (456)..(456): a, c, t, g, unknown or other
  misc_feature (456)..(456): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccnggacagcctcctaaactgctcatctcctgggcatccgtacccgggcaccccggagtccctgaccgattcagtggcagcgggtctgggacagacttcactctcaccatcagcaacctgcaggctagaagntgngctagtttattactgtcagctagttatggtagaagtcctccgctcgtacgtttcgggcggagggccgngggtagagatcgaagaccgtactggtcgctcgcacctatcgtgtcttacc

SEQ ID NO: 243874 - DNA, 503 bp, Homo sapiens
  misc_feature: GYAE6OF02GJ8EK.11.11.A11.1.454.CMB.1.raw
tcagcgagagataccacgaccggtgctcgatttagctacgactgcaggggcagcaagatggtgttgtagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggatccctgaccgattcagtgcagcggtctgggacagacttcactctcacatcagcaacctgcaggctgaagatgtggctagtttatactgttcagcagttatgtagaagtctccgctctacgtttcgggacggacgggaccgcgggtggagtatcgaggaacgtaacgtggtcggctgccaccagtcctgttcttctac

SEQ ID NO: 243875 - DNA, 573 bp, Homo sapiens
  misc_feature: GYAE6OF02IF5P4.11.11.A11.1.454.CMB.1.raw
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (444)..(444): a, c, t, g, unknown or other
  misc_feature (444)..(444): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagacaaaaaccaggacagacctacctaaactgctcactcctcctgggcactccgtacccgggccaccccgggacgtccctcgacccgtattcgaggtcggacgaggcggggtctggggaccagtacttcacttctaccaccatcacgcaacctgcgaggctagaagtntgnggtactagtttattactgtacagctagttnttggtacgtaagtccgttccgcttcgtaccgtttcgggaccgggtagggccggtgggtaggagtacgtacgaaggtaccgaacgttgggtacggtcgtacggacctaccgacttccgtcgttccttacg

SEQ ID NO: 243876 - DNA, 589 bp, Homo sapiens
  misc_feature: GYAE6OF02FTXLO.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctactaaactgctcatctctgggcatcctacccgggcacccggagtccctgaccgattcagtcggcaggcgggtctgggacagacttcactctcacatcagcaacctgacaggctagaagatggtgactagtttattactgtcagctagttattggagtaacgccttaccgtcttaccgtaccgtttccggggacgggtacggggacccggtacggggttaggacggtacgtaccggaaacgggtaacccggtaaacggttcgggtacgggaccgttacggacccgttaaccccgtagtttacccggttcggttccctttaacccg

SEQ ID NO: 243877 - DNA, 666 bp, Homo sapiens
  misc_feature: GYAE6OF02G6VEI.11.11.A11.1.454.CMB.1.raw
tcagcgagagataccacgaccggtgctcgatttagctacgactgcaggggcagcaagatggtgttgcagacccaggtcttcattttctctgttgctctggatctcgtggtgccgtggtggggacatcctgatcgacccacgtccccagatactcctcgcctgtgtctcgtgggcgaggacggcccaaccagtcgagtcgactaacgtccgagcgagtactttacttttaatatagtgtacaacgaagtaaggacttattagtcgttaggtatcagaaccaaaaaccgaggacacgccctacctaaactgctcactcctcgtggcactcccgtacccgggccgacccggcgtcctcgaccgtattcgaggtcggcgacggcgggtcgtaggggacacggtacttccgaccttctaccgacctactacgacgaccaaccgtgaccgacggactaggaaacgtgttggtacggtactttaagtttacttacgtcgtactaagacgttaagttagtttgtaggtaacgtccgttccgtcttcgttacggttttccggggaccgggtaacgggtcccggtgggtagggacgtactacggaaccggtaacggtaacgttgggtacggtccgtacggaccctaaccttaccgttcggttccgttaccttaccg

SEQ ID NO: 243878 - DNA, 517 bp, Homo sapiens
  misc_feature: GYAE6OF02H59V9.11.11.A11.1.454.CMB.1.raw
  modified_base (344)..(344): a, c, t, g, unknown or other
  misc_feature (344)..(344): n is a, c, g, or t
  modified_base (367)..(367): a, c, t, g, unknown or other
  misc_feature (367)..(367): n is a, c, g, or t
  modified_base (468)..(468): a, c, t, g, unknown or other
  misc_feature (468)..(468): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagaggccaccatcgagtgcaagtccagcgagactcttttatatagtgtcaacgataaggactatttagcttggtatcagacaaaaaccaggacacgacctcctaaactgctcatcctctgggcatccgtacccgggccacccggacgtccctgacccgattccagtggcaggcgggtntgggacagacttcactctcaccntcagaccaactgacaggctgaagatgtggctagttttatactgtacagctagtatgtagaagcctccgcttctacgtttcggacgggtacgggaccgtggnggagagtcgaagacgacgtggtcggactgacaccattcgtacgtcttac

SEQ ID NO: 243879 - DNA, 567 bp, Homo sapiens
  misc_feature: GYAE6OF02HDJ4H.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaaactgctcatctcctggcatctacccgggcacccggatccctgaccgattcagtgcagcgggtctgggacagacttcactctcaccatcagcaacctgcaggctagaagatggtggactagttttactacgtgtacagtctaagttattgtagaacgtccgtcccgacttcctacgttttccgggacgggtacgggacccgtcggggttaggacgtaacgtcgaacggtaccggtaacgttcggtcggaccgttcggaacccgtaccgtaacgtttcccgttaggttccctttaccg

SEQ ID NO: 243880 - DNA, 558 bp, Homo sapiens
  misc_feature: GYAE6OF02IDUXH.11.11.A11.1.454.CMB.1.raw
  modified_base (338)..(338): a, c, t, g, unknown or other
  misc_feature (338)..(338): n is a, c, g, or t
  modified_base (381)..(381): a, c, t, g, unknown or other
  misc_feature (381)..(381): n is a, c, g, or t
  modified_base (435)..(435): a, c, t, g, unknown or other
  misc_feature (435)..(435): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctctaaaactgctcatctcctgggcatcctacccgggcacccggatccctgaccgtattcagtggcagcgggtcngggacagactcactcacaccatcagcaactgcaggctagaacntgtggctagtttatacgttgtacagtctaagttacgtgtagaacggtctcccgngttccgtacgttttcgggaccgggtagggaccgtcgggtaggacgtagttaccgaaggtaaccggaacttagggtcggtaccctagggacctacccgaacgtttcgtacgttccgtttacccg

SEQ ID NO: 243881 - DNA, 484 bp, Homo sapiens
  misc_feature: GYAE6OF02FHUUC.11.11.A11.1.454.CMB.1.raw
  modified_base (378)..(378): a, c, t, g, unknown or other
  misc_feature (378)..(378): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactctttatatagtgtcaacgataaggactatttagcttggtatcagcaaaaaccaggacagcctctaaactgctcatctcctggcatctacccgggcacccggagtccctgacccgattcagtggcagcgggtctgggacagacttcactctcaccatcagcaacctgcaggctgaagntgtggctagtttattactgtcagcagtattgtagagctccgctcacgtttcggcgacgggccgcggtggagatcgaagacgaactggtcgctgcaccatctgtctc

SEQ ID NO: 243882 - DNA, 560 bp, Homo sapiens
  misc_feature: GYAE6OF02HVTI4.11.11.A11.1.454.CMB.1.raw
  modified_base (254)..(254): a, c, t, g, unknown or other
  misc_feature (254)..(254): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactctttatatagtgtcaacgataaggactattagcttggtatcagacaaaaaccnggacagcctacctaaatgctcatctcctgggcatcgtacccggcaccccggagtccctgaccgattcagtggcagcgggtctgggacagtaccttcactctaccaccatccagccctaaccgtgaccagggcctaggaagatggtcggctagtttattactgtcagtctagtattgtagagtctccgacttccgtacgtttcgggacgggtacggacccggtcgggtaggagtacgtacgaacggtaaccggaacgttcgggtacggcttacggcctaaccctagttaccgttcgttcctttaccg

SEQ ID NO: 243883 - DNA, 521 bp, Homo sapiens
  misc_feature: GYAE6OF02GDT8S.11.11.A11.1.454.CMB.1.raw
  modified_base (208)..(208): a, c, t, g, unknown or other
  misc_feature (208)..(208): n is a, c, g, or t
  modified_base (380)..(380): a, c, t, g, unknown or other
  misc_feature (380)..(380): n is a, c, g, or t
  modified_base (411)..(411): a, c, t, g, unknown or other
  misc_feature (411)..(411): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagcaaaaaccaggacagcctcctaaactgctcatctcctgggcatctacccgggcacccggagtcccctgaccgattcagtggcagcgggtctgggacagacttcactctcaccatcagcaactgcaggctgaagntgtgctagtttatacttgtcagcagtattgngaagctccgctcgtacgtttcggcggtaggaccgtggtggagtatacgaaggaaccgtaacgtggtacgggccttacggacctaccgtattccgttacggtcctttaccg

SEQ ID NO: 243884 - DNA, 666 bp, Homo sapiens
  misc_feature: GYAE6OF02J2PW6.11.11.A11.1.454.CMB.1.raw
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (355)..(355): a, c, t, g, unknown or other
  misc_feature (355)..(355): n is a, c, g, or t
tcagcgagagataccacgaccggtgctcgatttagctacgactgcagggcgagcaagatggtgttgcagacccaggtcttcatttctctgttgctctggatctctggtgcctgtgggacatcctgatgacccagtccccagatatcctgcctgtgtctcgtgggacgagagggccaccattcgagtgcaagtccagcgagacttctttatatagtgtcaacgataaaggctatttagcttgtatcagcaaaaacngacagctacaactgcncatacncgtaggctatccgtacccggcgacccggagttccccaggacccgagttccaaggttgggacccaggtcccggggttcncggggtaaccaaggtcctttacaacgtccttaccaaaccccagttaccaacgggccctaaaccgtcgtcgacggtcgtaggtaaagacgtgttacgggcttaaggtttaattcgtacgtaccgaaggtacctagggttaactggttaacggtaacgccgttcccgtaaccggttccttaaccgggttttaccgggccgggtaaacgggggtccccggttaggggtcgggtaagtaccgttacgtaaccggggaccgtaaacgtcgggttacggcccgttagccccgaagtacgttccgtagttaccgttac

SEQ ID NO: 243885 - DNA, 518 bp, Homo sapiens
  misc_feature: GYAE6OF02ILZQV.11.11.A11.1.454.CMB.1.raw
  modified_base (207)..(207): a, c, t, g, unknown or other
  misc_feature (207)..(207): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagactcttttanatagtgtcaacgataaggactatttagcttggtatcagacaaaaaccaggacagccctctaaactgctcatctcctgggcatccgtacccgggcaccccggatcccctgaccgattcagtgcagcggtctggacagtacttcactctcaccatcagacaactgcaggctagantgngctagtttntactgtcagctagtntcgtagagtccttccgctcgtacgttcggcgggacgggtaccgcgggtagacgtacgtcgaagtaaccgtacgtggtacggctacggctacccgtatcgttcgtccttacg

SEQ ID NO: 243886 - DNA, 563 bp, Homo sapiens
  misc_feature: GYAE6OF02HXLZJ.11.11.A11.1.454.CMB.1.raw
  modified_base (257)..(257): a, c, t, g, unknown or other
  misc_feature (257)..(257): n is a, c, g, or t
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
  modified_base (387)..(387): a, c, t, g, unknown or other
  misc_feature (387)..(387): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggactatttagcttggtatcagacaaaaacnggacagcctacctaaactgctcatcctcgtggcatcctacccgggcacccggagtcccngaccgtatcaggtcggcaggcgggtntgggacagcttcacttctcaccatcagacacctgcaggctgaagnttggtaggacttagttttactactgttacagctagttatggtagacgtcctccgtctactacggttcggacgggtaggacccggtgggtacggagtaccgttacgaacggtaaccggtaacttgggtaccggccgttaggacccgtacctagtttcgttaccggttaccttacccg

SEQ ID NO: 243887 - DNA, 546 bp, Homo sapiens
  misc_feature: GYAE6OF02G7OCP.11.11.A11.1.454.CMB.1.raw
  modified_base (306)..(306): a, c, t, g, unknown or other
  misc_feature (306)..(306): n is a, c, g, or t
  modified_base (382)..(382): a, c, t, g, unknown or other
  misc_feature (382)..(382): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggngtccctgaccgattcagtggcagcgggtctgggacagacttcactctcaccatcagacaacctgcaggctagaagntgtggctagtttatacgtgtcagcagttacttgagaacgcctccgcttcgtacgtttcgggcgggacgggacccgcgggttagggagtcgtacgaacggaaccgtaaacgttcggtacggtcgttacgacccgaaccgtacgtttccgtacggttcccttaccg

SEQ ID NO: 243888 - DNA, 511 bp, Homo sapiens
  misc_feature: GYAE6OF02FZOTM.11.11.A11.1.454.CMB.1.raw
  modified_base (255)..(255): a, c, t, g, unknown or other
  misc_feature (255)..(255): n is a, c, g, or t
  modified_base (380)..(380): a, c, t, g, unknown or other
  misc_feature (380)..(380): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccnggacagcctcctaaactgctcatctcctgggcatctacccgggcacccggagtccctgaccgattcagtggcagcgggtctgggacagacttcactctcaccatcagcaacctgcaggctgaagntgtggctagtttattactgtcagcagttattgtagaagctccgcttcgtacgtttcgggcggacgggccgtcgggtaggagatcgaaggaccgaacgtgtcggctcggcctaccgagtcgttgtccttacg

SEQ ID NO: 243889 - DNA, 579 bp, Homo sapiens
  misc_feature: GYAE6OF02IEGX7.11.11.A11.1.454.CMB.1.raw
  modified_base (259)..(259): a, c, t, g, unknown or other
  misc_feature (259)..(259): n is a, c, g, or t
  modified_base (412)..(412): a, c, t, g, unknown or other
  misc_feature (412)..(412): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggacttatttagcttggtatcaagacaaaaaccnggacagcctactaaactgctcactctccgtgggactactaccgtacccgggccaccccggacgtcccctaggacccgattccaggtcggcgacggccggggtctcgggacacgtacttcactcctacaccatcagccaacctgcagctagaangtgtacggactagttttatacttgtacagtctagtagttgtaggaacgtcctccgtctaccgtaccgtttcgggccggggtacggtccggagggtggaacgtcgtacgaacggacgtaacggttggtacggtcgtcgaccctaaccgtgttccttcggtccttaccg

SEQ ID NO: 243890 - DNA, 708 bp, Homo sapiens
  misc_feature: GYAE6OF02ICB97.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccacgtccccagatatcctgcctgtgtctcgtgggcgagacgggccaccatcgagtgcaagtccagcgagtacttcttttatatagtgtacaacgaataaggactattagtcttaggtatcagaacaaaaaccgaggacacgtacctacctaaactgctacatcctccgtggcactccgtaccccgggcgacccggtacgtcccgtacgaccgtacttcgaggtggacgacggcgggtcgtagggacacgtacttacacgttcctacccaactactaccacggacctaaccgtggaccgtaaggctaaggaaagtagttgggtaggtaccttaaggttttaactttaacgtcgttacgacgtacgtaaggtttattcggtaacggaacgtcccgttaccgtaccgtttaccggttaaccggttttccggggggaaccgggtaacgggggtaccgttaccgggggtaggggtaacgtaccgttaccggtaaacgggtaaacccgttacggttcggggtacggttcccgttaccggaccctaaccgtacgggtttacccttacggtttccctttaaccg

SEQ ID NO: 243891 - DNA, 528 bp, Homo sapiens
  misc_feature: GYAE6OF02GH2WI.11.11.A11.1.454.CMB.1.raw
  modified_base (464)..(464): a, c, t, g, unknown or other
  misc_feature (464)..(464): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctactaaactgctcatctcctggcactccgtacccgggcaccccggagtccctgaccgattcgagtggcaggcgggtctgggacagacttcactctcacatcagcaacctgacaggctagaagatgtggactagttttatacgttgtcagctagtattggtgaacgtctccgtctctacgtttcgggcggtacgggaccgngggtaggacgtagtacgaaggaccgtacgtggtacggtctcgaccacgtacgtcttcgtccttc

SEQ ID NO: 243892 - DNA, 621 bp, Homo sapiens
  misc_feature: GYAE6OF02IRTVV.11.11.A11.1.454.CMB.1.raw
tcagcgagagataccacgaccggtgctcgatttagctacgactgcaggggcgagcaagatggtgttcgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggacttatttagcttggtatcaagacaaaaaccaggacagcctacctaaaactgctctactcctccgtgggcactccgtaccccggggccaccccgggacgtcccctaggacccgtattccgaggtcggacgacggcggggtcgtggggactacgtacttcactcctaccacctactccacgaccaaccgtcgccgaggccgtaggaaacgtgttcggtggaccgttagttttacttacgtgtactagacttagttattgtagaacgtccgtaccgtcttacgtacgtttccgggacgggtacgggccgtggggtaggagtacgtccggaaggtaccgtaacggttggtacggtatcggtaaccctaccgtattccgttacgttccttacccg

SEQ ID NO: 243893 - DNA, 567 bp, Homo sapiens
  misc_feature: GYAE6OF02I9XA1.11.11.A11.1.454.CMB.1.raw
  modified_base (325)..(325): a, c, t, g, unknown or other
  misc_feature (325)..(325): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactaatttagcttggtatcagacaaaaaccaggacagcctacctaaactgctcatctcctggcatccgtaccccgggcacccggagtcccctgaccgtnttcagtggcaggcggtctgggacagtacttcactctcaccatcagcaacctgcaggctagaagtatggtcgtactagtttattacgtgttcagtactagttatggtacgaagtcctaccggtccttacgttaccgtttcgggccgggtaacgggacccgtgggtagggacgtaagtccgaacggacgtaaacggttggtacgggcgtcggaccctacctagttccgttaggttccttacccg

SEQ ID NO: 243894 - DNA, 545 bp, Homo sapiens
  misc_feature: GYAE6OF02G0LKU.11.11.A11.1.454.CMB.1.raw
  modified_base (273)..(273): a, c, t, g, unknown or other
  misc_feature (273)..(273): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtacaacgataaggactatttagcttggtatcagacaaaaaccaggacagcctctaaacngctcatctcctggcatcctacccgggcacccggatccctgaccgattcgagtggcaggcgggtctgggacagtacttcactctcaccatcacgcaacctgacaggctgaaagatggtaggctagtttattactgttacagtctagtattgtagaacgtcctccgctcgtacgtttcgggaccgggtagggacccgtgggtggagtacgtacgaacggaacgtaacctgggtacggacttacgccctaaccgtgttaccgttgttaccttccg

SEQ ID NO: 243895 - DNA, 522 bp, Homo sapiens
  misc_feature: GYAE6OF02GEROM.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaacaggacagcctacctaaactgctcactcctccgtgggcactccgtacccgggccaccccggagtcccctgaccgattcagtggcaggcgggtctgggacaggacttcactctcaccatcagcaacctgcaggctagaagtatggtcggactagtttattacttgtacagctagtattggtagacgctccgtcttcctacgtttcgggcggaggaccgtggtgagagcgaagacgacgtgtacggctcgaccaccgtatcgttgtcttac

SEQ ID NO: 243896 - DNA, 492 bp, Homo sapiens
  misc_feature: GYAE6OF02F8QX1.11.11.A11.1.454.CMB.1.raw
  modified_base (379)..(379): a, c, t, g, unknown or other
  misc_feature (379)..(379): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcagctgaagntgtggctagtttattactgtcagcagtattgtgaacgctccgctcgtacgtttcggcggtacggccgcgggtggagatcgaaggacgaactgtggctgcacctatctgtcttc

SEQ ID NO: 243897 - DNA, 595 bp, Homo sapiens
  misc_feature: GYAE6OF02JCMQH.11.11.A11.1.454.CMB.1.raw
  modified_base (215)..(215): a, c, t, g, unknown or other
  misc_feature (215)..(215): n is a, c, g, or t
  modified_base (265)..(265): a, c, t, g, unknown or other
  misc_feature (265)..(265): n is a, c, g, or t
  modified_base (467)..(467): a, c, t, g, unknown or other
  misc_feature (467)..(467): n is a, c, g, or t
tcagcgagagataccacgaccggtgctcgatttagctacgactgcagggggcagcaagatggtgttgcaggacccaggtcttcatttctctgttgctctggatctctggtcgcctggtggggacagtcctgatgacccagtccccagatatcctgcctgtgtctctgggcgagagggccaccgatcgagtgcaagtccagcgagacttcttttanatagtgtacaacgataaggactatttagcttggtatcagtacaaaaccgnggacacgacctactaaactgctacgactctcctggactatcgtaccggcaccggactccgtgaccgtattcgagtcggtcaggcgggtctacgggacagtcgttacacttctacaccgatacacgctaaccgtcgacaggtctaggaaacgtgtcgtggctaggtttactacgttggtcagtctagttacgtggtagtaacnccgtcgtacttcgtaccgtttcggggacggtacggtaccgtgggtacggtagtacgtcggtaagggaaccgtacgttagggtacgaccgtcgtaaccgtacccgagtccgttacggttacccttacgg

SEQ ID NO: 243898 - DNA, 675 bp, Homo sapiens
  misc_feature: GYAE6OF02HYG4V.11.11.A11.1.454.CMB.1.raw
  modified_base (432)..(432): a, c, t, g, unknown or other
  misc_feature (432)..(432): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgaggagggccaccatcgagtgcaagtccagcgagacttcttttatatagtgtacaacgataaggacttatttagcttggtatcagacaaaaaccaggacagccctacctaaactgctcatcctcctgggacactccgtaccccggggaccaccccgggacgtccccgtagaacccgtattccgaggtggccgaggccggggtctagggacagtacttacactcctacaccatccgagaccaccgtgaccgaggtcgtaggaaacgtntcggtcggtacttaaggtttttaactttacgtgttaccgagtctaacgggttatttacgggtagaacgtcccgttccccgacgtttaccggttaaccggttttcccgggggaccggggtaaccggggtaccggtcggggttacgggtaagtacgtacgaacgggtaacccggtaaacggttcggtaccggtaccgttaccggtaccgaccccgttagtttcccgttaccggttcctttacccg

SEQ ID NO: 243899 - DNA, 565 bp, Homo sapiens
  misc_feature: GYAE6OF02GU9F5.11.11.A11.1.454.CMB.1.raw
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggacttatttagcttggtatcagacaaaaaccaggacagcctacctaaactgctcatctccgtggcatccgtacccgggccaccccggacgtccctagacccgtattccgaggtggacaggccgggtctgggacagtacttcgactctacaccatcagcaacctgcaggctagaanatgtgntagtttatacttgacagctaagttgttaggagaacgtcctccgtcttacgtacgtttccggggacgggtaacgggtaccgggtcgggtaggacgtacgtaccggaaggtaaccggaacgttggacggctcgaccaccgtattcgttcgttccttacc

SEQ ID NO: 243900 - DNA, 545 bp, Homo sapiens
  misc_feature: GYAE6OF02I8GVX.11.11.A11.1.454.CMB.1.raw
  modified_base (209)..(209): a, c, t, g, unknown or other
  misc_feature (209)..(209): n is a, c, g, or t
  modified_base (254)..(254): a, c, t, g, unknown or other
  misc_feature (254)..(254): n is a, c, g, or t
  modified_base (313)..(313): a, c, t, g, unknown or other
  misc_feature (313)..(313): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
tcagcgagagataccacgaccggtgctcgatttagctacgactgcagggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggctattagcttggtatcagcaaaaaccnggacagcctcctaaactgctcatctcctgggcatcgtacccggcaccccggagtccccngaccattccagtgggccaggcggtctggggacagacttcactctcacatcacgcaacctgcaggctgantgngacagttatcgtgtcagtcagttatgagaacgtcctacccgcttcgtaccgtttcggggaccgggtacgggaccgcgggtaggagtacgtccgaagggtacccgaaacgttgggtacgacgttcggaccctaaccttaggtccttacggttccttacccg

SEQ ID NO: 243901 - DNA, 506 bp, Homo sapiens
  misc_feature: GYAE6OF02FTDRI.11.11.A11.1.454.CMB.1.raw
  modified_base (257)..(257): a, c, t, g, unknown or other
  misc_feature (257)..(257): n is a, c, g, or t
  modified_base (455)..(455): a, c, t, g, unknown or other
  misc_feature (455)..(455): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaaccnggacagcctacctaaactgctcatctcctgggcatcctacccgggcacccggagtccctgaccattcagtcggcaggcgggtctgggacagacttcactctcacatcagcactgcaggctagaagatgtgctagttatagtgtcagctagtattgtagacgctccgctctacgtttcggcggacggccgcggtagganagtacgaacggtacgacgtggtcgacgtcgccaccgatcgttcgtcttacg

SEQ ID NO: 243902 - DNA, 704 bp, Homo sapiens
  misc_feature: GYAE6OF02JTHAY.11.11.A11.1.454.CMB.1.raw
  modified_base (257)..(257): a, c, t, g, unknown or other
  misc_feature (257)..(257): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctggcgagacgggccaccatcgagtgcaagtccagcgagacttcttttatatagtgtacaacgataaggactatttagcttggtatcagacaaaaaccngacagcctactaactgctcatctccgtggctactccgtacccgggaccgacccggacgtcccgtacgaccgtattccgacggtcggacgacggtccggggtcgtacggggacctaacggtacctttaccgaacgttccctaccaaccctagttacccgaacgtaccctaaccgtcggaccgaacgggtcgtaaggaaacgtacgttggtacggtacctttaaggttttaacttacgttcggtacgtaacggttaccgttaagtttagtttcggtaacgtaaccgttcccgttaccggtaccctttaccggttaccggtttccggggacgggtaacggggttaccggccgggttaggacgtaacgtaccggaaacggtaaccgtacgggttaggttcccggtggtaccgaccgtaacccggtatttcccggttacgttccgtaacccg

SEQ ID NO: 243903 - DNA, 595 bp, Homo sapiens
  misc_feature: GYAE6OF02FGVDW.11.11.A11.1.454.CMB.1.raw
  modified_base (208)..(208): a, c, t, g, unknown or other
  misc_feature (208)..(208): n is a, c, g, or t
  modified_base (259)..(259): a, c, t, g, unknown or other
  misc_feature (259)..(259): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanattagtgtacaacgataaggactatttagcttggtatcagacaaaaaaccnggacagcctacctaaactgctcatctcctggcatcctacccgggcacccgggacgtccctgaccgattcaggtggacaggcgggttctgggacaggtaccttcacctctcaacccatcagcaaccgtgcgaggctaggaacgagtgtcggacttagtttattacttggtcagtactagttattggtagaacgtccttccgtacttccgttacgtttaccggggccgggtaacggggcccggtacggggttaggacgtacgtacggaacggtaaccggaacgttcgggtacggccgtacgaccctaaccgtagttccgttcggtttaccttaacccg

SEQ ID NO: 243904 - DNA, 634 bp, Homo sapiens
  misc_feature: GYAE6OF02IFEKE.11.11.A11.1.454.CMB.1.raw
  modified_base (211)..(211): a, c, t, g, unknown or other
  misc_feature (211)..(211): n is a, c, g, or t
tcagcgagagataccacgaccggtgctcgatttagctacgactgcagggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagacgagacttcttttanattagtgtacaacgataaaggacttatttagcttaggtatcagacaaaaaccaggacagcctacctaaactgactacatctcctgggctagtaccgtacccggggaccaccccggtagtcccctacgaccgtattacgacggtggactaggccggggtctagggaccagtacttcacgtcctacaccatcgagtccaaacctggacccgtagggcctaggaaacgagttggtcggtacttaaggttttaacttaacgttcgtacaggtactaagtacttaggtagaacgtccttccggacttacgtacgtttccgggacgggaacggggtaccggtagggtaggacgacgtaccgaaggtaaccgtaacggttcgtaggtaccgtcggaaccctaccgtatttcccgtcgtttaccgttaccc

SEQ ID NO: 243905 - DNA, 609 bp, Homo sapiens
  misc_feature: GYAE6OF02JBE9A.11.11.A11.1.454.CMB.1.raw
  modified_base (257)..(257): a, c, t, g, unknown or other
  misc_feature (257)..(257): n is a, c, g, or t
  modified_base (313)..(313): a, c, t, g, unknown or other
  misc_feature (313)..(313): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggactatttagcttggtatcagacaaaaaccnggacagcctacctaaactgctcatctcctgggcatccgtacccgggcaccccgggngtcccctgacccgtattcaggtcggcaggcgggtctggggacagacttcactctcaccatcacgccaacctgcagggctgaagagtgtcggctagtttattacgttgtacacgctagttagttgtgaacgtccgtcccgtctaccgttaccggtttccggggaccgggtaaccggggtacccgggtacgggttacgggacggtaacgtaccggaaacggtaccggtaaaccggttcgggtacggtaccgtacggtacccgaacccgttacggtttccgttacggtttcccttaccg

SEQ ID NO: 243906 - DNA, 562 bp, Homo sapiens
  misc_feature: GYAE6OF02GZE84.11.11.A11.1.454.CMB.1.raw
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
  modified_base (381)..(381): a, c, t, g, unknown or other
  misc_feature (381)..(381): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaaggactattagcttggtatcagacaaaaaccnggacagcctcctaaactgctcatctcctggcatcctacccgggcacccggntccctgaccgattcagtgcagcgggtctgggacagacttcactctcaccatcacgcaactgcaggctagaagngtgtggactagtttatactgtcagctagttacttggtagaacgtcctccggcttccgtaacgtttcgggaccgggtagggtaacccgtggggtaggacgtactaccggtaacggaaccggttaacgttgggtcggtacgttacggaccctaaccgtagttccggttgttaccctttacccg

SEQ ID NO: 243907 - DNA, 557 bp, Homo sapiens
  misc_feature: GYAE6OF02IB3SS.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgaccccagtccccagatatcctgcctgtgtctctgggcgagagggccaccatcgagtgcaagtccagcgagacttcttttatatagtgtacaaacgataaggactatttagcttggtatcagacaaaaaccaggacagcctacctaaactgctcatctccgtggccatccgtacccgggcacccggacgtccctgacccgtattcgagtcggcaggcggggtctgggacagtaccttcactcctacacctatccacgccaacctgaccgagggctagaagtatggtagtacttagtttacttacgtgtctagactagttatgtagaacgtcctccgcttcgtaccgtttcgggcgggacggccgtgggaggactgtccgaaggtaccgtaacgtcggtcgcgttcgacctacctgtcctcgtcttaccg

SEQ ID NO: 243908 - DNA, 635 bp, Homo sapiens
  misc_feature: GYAE6OF02H1XRK.11.11.A11.1.454.CMB.1.raw
  modified_base (316)..(316): a, c, t, g, unknown or other
  misc_feature (316)..(316): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgctgtgtctcgtgggcgagaggccacatcgagtgcaagtccagcgagtactcttttatatagtgtacaacgaataaggacttatttagcttggtatcagacaaaaaccaggacagcctacctaaactgctcatctctgggcatcgtacccggcacccggacgtcccngaccgtattcagtggcgagcgggtctgggaacagacgttcactcctcaccatcagaccaacctgaccaggtacctaggaaagtacgtggtacggtaccttagttttaacttacgtcgttacaagtaccttaagtacgttagttaaggaacgttaccgtcccgtaccgtttaaccgtaccggttttaccgggccggggtaaaccggggtaccggtacgggttcggaacgtaacgttccgaaacgggtaacccgtaaacggttgggttacggaccgtacgtacccgaaccgttaacgtccgtttcccgtactttaacccgg

SEQ ID NO: 243909 - DNA, 569 bp, Homo sapiens
  misc_feature: GYAE6OF02FS51W.11.11.A11.1.454.CMB.1.raw
  modified_base (208)..(208): a, c, t, g, unknown or other
  misc_feature (208)..(208): n is a, c, g, or t
  modified_base (255)..(255): a, c, t, g, unknown or other
  misc_feature (255)..(255): n is a, c, g, or t
  modified_base (307)..(307): a, c, t, g, unknown or other
  misc_feature (307)..(307): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagcaaaaaccnggacagcctactaaactgctcatctccgtggcatcctacccgggcacccggntccctgaccgattcagtggcaggcgggtctgggacagacttcactctcaccatcagcaactgacaggctagaagatggtaggctaggtttacttacgtgtacagctaagttattggtagaacgtccttaccgtcttcgtacgttttccggggacgggtacgggtacccgtgggtacgggagtacgttacgaacggaaccggtaaacggttgggtacgggccgttacggcctaacccgtagtttccgttacgttcctttaccg

SEQ ID NO: 243910 - DNA, 563 bp, Homo sapiens
  misc_feature: GYAE6OF02JEWIQ.11.11.A11.1.454.CMB.1.raw
  modified_base (208)..(208): a, c, t, g, unknown or other
  misc_feature (208)..(208): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtcaacgataaggactatttagcttggtatcagacaaaaaccaggaacagcctactaaactcgactcaatctctggcatcctacccgggcacccggatccctgaccgattcagtggcaggcggtctgggacagacttcnctctcacctanctagcaacctgactaggctaggaagtagtgtaggtactaagttttagttactggtacacggctagtattcgtagaacgtcgtccgtctacgtaccggtttcggcgggacgggaaccgtcgggtaggacggtaactcggaacggtaccgaagttcggacggtcgtacggaccctaccgtagttccgttacggtccttacgg

SEQ ID NO: 243911 - DNA, 572 bp, Homo sapiens
  misc_feature: GYAE6OF02G40P8.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctgggcagtccgtacccgggcacccggagtccctgaccgtattcagtgacaggcggtctgggacagtacttcactctcaccatcacgccaacctgacaggctaggaagtagtggtggtactagttttattacgtgttaccgagtcgtagttattgtagtaacgtcctccggtaccttccgttaccggtttcgggaccggggtacgggtacccggtcgggtacggagacgtcgaacggtaccggtaacgttgggtcggtctcggacctacgtacgtcgttcgttcttaccg

SEQ ID NO: 243912 - DNA, 546 bp, Homo sapiens
  misc_feature: GYAE6OF02HOREM.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaaccaggacagcctacctaaaactgctcaatctcctgggcatccgtacccgggccacccggagtcccctgacccgtattcagtcggcaggcgggtctgggacagtacttcactctacaccatcagccaacctgaccaggctagaagatggtggactagtttattactgtcagtacagttatgtagtaacgctccgcttccgacgtttcgggaccgggaggaccggcggttaggacgtatacgaaggaccgtaacgtggtacggctcgaccaccgtagttcttacgttcttaccg

SEQ ID NO: 243913 - DNA, 563 bp, Homo sapiens
  misc_feature: GYAE6OF02GYCUM.11.11.A11.1.454.CMB.1.raw
  modified_base (498)..(498): a, c, t, g, unknown or other
  misc_feature (498)..(498): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagacaaaaaaccaggacagcctcctaaactgctcatctcctggcatcctacccgggcacccagacgtccctgaccgattccgagtcggcaggtcggggtcgtaggggacaggtaccttcactctacaccatcacgccaacctcgaccaggctaggaagtatggtaggtctaacgtttattaacttggtcagacctagtacttgtagaacgtccgtccgcttacgtaccgtttccgggacgggtaacgggccgngggtagggacgtacgtcgaaggacgtaacgtggtggtacgtcgccgtaccgtactcgtacgttcc

SEQ ID NO: 243914 - DNA, 582 bp, Homo sapiens
  misc_feature: GYAE6OF02IM8JK.11.11.A11.1.454.CMB.1.raw
  modified_base (207)..(207): a, c, t, g, unknown or other
  misc_feature (207)..(207): n is a, c, g, or t
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (364)..(364): a, c, t, g, unknown or other
  misc_feature (364)..(364): n is a, c, g, or t
  modified_base (439)..(439): a, c, t, g, unknown or other
  misc_feature (439)..(439): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagaggccaccatcgagtgcaagtccagcgagactcttttanatagtgtcaacgataaggactattagcttggtatcagacaaaaaccnggacagcctactaaactgctacatcacctggcatctaaccggcaccggagtcccngaccgattccagtggcacggcgggtctagggacagacttcactctacacatcgancaacctgactaggctagaagtacgtggtcgacttagtttattaccgtggtacctagacctaagttattaggttanaacggtccttcccggtacttaccgtacggttttaccgggcgggtaacgggaaccggtcgggttaggacgtagttccgaaacggtaccgtaacgtggtacggtaccgtcggaccaaccgtacgttcgttacggtctttaacccg

SEQ ID NO: 243915 - DNA, 533 bp, Homo sapiens
  misc_feature: GYAE6OF02IN8CH.11.11.A11.1.454.CMB.1.raw
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagacaaaaaccagacagcctactaaactgctacatctcctgggcagtccgtacccgggcacccggacgtccctagaccgtattcgagtcggcaggtcgggtctgggacagtacttcactctacacatcagcacctgcaggtcagaagntgnggacttagtttatacgtgtcagactagtactgtagaacgtctccgtctactacgtttcgggacgggtacggccgtaggtaggacgactacgaagacgtaacgtggtacggactcgaccgtacacgttctcgttcttacg

SEQ ID NO: 243916 - DNA, 770 bp, Homo sapiens
  misc_feature: GYAE6OF02FEUBD.11.11.A11.1.454.CMB.1.raw
  modified_base (219)..(219): a, c, t, g, unknown or other
  misc_feature (219)..(219): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatcgacccagtccccagatactcctgcctgtgtctcgtgggcgagacgggccaaccagtcgagtgacaacgtccagcgagtacctttactttanagttagtacgtacaacgtagtaacggtactttagttacgtcgtttaggtaactacgaacgtaaccaaaaaccgcggaacctaccgtacccttaaccgtaaacgtcgtacctactacgttcccgtaccgtacgggtacctaccgttaccccggtaccccgggaccgtaccccgggtaccgtacccgtaacggtaccgttacgttacggaggttcgggaccgtacgggtccgggtacgtacggaccgttacgtcttaccactacctaccacctagtaccgacgacctaccggtcgacgacggtacgtaacggtaacgttacggtaggttaccgttaacgtttaagttttaccgttacgtggtaacttaacggactttaaggttacgttcggaacgttacccgtccgttacccggtaccgtttaccgggttaccggggttaccggggaacggtaacgggtccggtaacggtacgacgtacgtaccggtaaacggtaccgtaacggttcggtcgactccgaccctaagttccttccgttaccgtttcctaacccg

SEQ ID NO: 243917 - DNA, 532 bp, Homo sapiens
  misc_feature: GYAE6OF02JCBXB.11.11.A11.1.454.CMB.1.raw
  modified_base (252)..(252): a, c, t, g, unknown or other
  misc_feature (252)..(252): n is a, c, g, or t
  modified_base (489)..(489): a, c, t, g, unknown or other
  misc_feature (489)..(489): n is a, c, g, or t
tcagcgagagataccacgaccggtgctcgatttagctacgactgcagggcagcaagatggtgttgcagacccaggtcttcatttctctgttgctctggatctctggtgcctgtgggacatcctgatgacccagtccccagatatcctgcctgtgtctctgggcgagagggccaccatcgagtacaagtccagcgagactctttatatagtgtcaacgataaggactattagcttggtatcagacaaaaaccnggacagcctacctaaactgactcatctccgtggcatcctacccgggcacccggatccctgaccgattcagtggcaggtcgggtactgggacacgacttcactctacaccagtccagcaacctgcagctagaagtatgtgctagtttactactgtacagctagtattgtagaacgtctaccgtcgtactacgtttcgggcggtagggaccgtcgggagacgatcgacgaacgtaacgnggttcggaccttgacccgactagtcgttcgtaccgttataccg

SEQ ID NO: 243918 - DNA, 536 bp, Homo sapiens
  misc_feature: GYAE6OF02JI5SW.11.11.A11.1.454.CMB.1.raw
  modified_base (385)..(385): a, c, t, g, unknown or other
  misc_feature (385)..(385): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagcaaaaaccaggacagcctcctaaactgctcatctcctggcatccgtacccgggcaccccggacgtccctgaccgattcaggtcgcagcgggtctgggacagacttcactctcaccatcagcaacctgcaggctagaagtntgtgactagtttattacgtgtcagctagttntggtanagtcctcgtactccgtacgtttcgggacgggacggaccggtcgggtaggacgtagtaccgaggtaaccgtaacgtggtaccggctcggacacccgtagtccttggtccttaccg

SEQ ID NO: 243919 - DNA, 572 bp, Homo sapiens
  misc_feature: GYAE6OF02GRT7P.11.11.A11.1.454.CMB.1.raw
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggactatttagcttggtatcagacaaaaaccaggacagcctacctaaactgctcatctcctggcactcctacccgggcacccggcgtccctgaccgattcagtgcagcgggtctgggacagacttcactctcaccatcagcaacctgcaggctagaagntgnggtactaggtttattacgtgtaccagtctaagtttacgttggtagaagtccgttacccgcttccgtaccgttttccggggacgggtaacgggtaccggtcgggttagggagtacgtacgaacggtaaccgtaacgttggtcggtcctcggacctaacccgtacttcggttccgttactttacccg

SEQ ID NO: 243920 - DNA, 631 bp, Homo sapiens
  misc_feature: GYAE6OF02JWAGR.11.11.A11.1.454.CMB.1.raw
  modified_base (254)..(254): a, c, t, g, unknown or other
  misc_feature (254)..(254): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccacatcgagtgcaagtccagcgagactctttatatagtgtacaacgataaggtactatttagcttggtatcagcaaaaaccnggacagcctactaaatgctcatctccgcgggcctatccgtacccggggccaaccccgggactccccgtgacccggtattaccgaggttcggcacggtccggtcgtgggaccaggtacttccacgtcctcaccatcgacgtaccaaccgtgcgtaggctaagagactggtcgtacttagtttaactcgttgttaccgagtctaaggttacttacggtaagtcgtaccgtcccgtaaccgttcctaccgggtttccgggacgggtaccggggtacgtacgggtcggtaacgtcgtacggaaaggtacccggtaattcggggtacggtcccgtacgggtacctaaacccggttcgtttaccgttcccgttacgttaaccc

SEQ ID NO: 243921 - DNA, 652 bp, Homo sapiens
  misc_feature: GYAE6OF02H2YLQ.11.11.A11.1.454.CMB.1.raw
  modified_base (213)..(213): a, c, t, g, unknown or other
  misc_feature (213)..(213): n is a, c, g, or t
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
  modified_base (463)..(463): a, c, t, g, unknown or other
  misc_feature (463)..(463): n is a, c, g, or t
  modified_base (490)..(490): a, c, t, g, unknown or other
  misc_feature (490)..(490): n is a, c, g, or t
tcagcgagagataccacgaccggtgctcgatttagctacgactgcagggcagcaagatggtgttgcagacccaggtcttcatttctctgttgctctggatctctggtgcctgtggggacatcctgatcgacccacgtccccagatatcctgcctgtgtctcgtgggcgaggacgggccaccagtcgagtgcaagtccagcgagacttctttanatagtgtacaaacggataaggacttatttagcttaggtatcgagaaccaaaaaccaggtacagccttacctaaactgctacatcctaccgtggtccatcccgtacccggaccacccggtacgttcccngaaccctatccgaagtcggaccaaggcccggggttacncgggggaactacggtaaccctttccgaaccgttccgaccaaccagtaccgaagtacccaaccgtcgaccgtaggcctaagaagntggcggtactagtttatacgtgtacgngtactagttatcgggtagaaccgtccgttcccgattcccggtagtttacccgggacgggagggacccgtacggggttaggacgtacttaccggaacggtaaccggttgttacgggaccggtcgacggaacccacccggttaattccggttccgttacctacg

SEQ ID NO: 243922 - DNA, 745 bp, Homo sapiens
  misc_feature: GYAE6OF02GX3NL.11.11.A11.1.454.CMB.1.raw
tcagcgagagataccacgaccggtgctcgatttagctacgactgcagggcagcaagatggtgttgcagacccaggtcttcatttctctgttgctctggatctctggtgcctgtggggacatcctgatgacccagtccccagatatcctgcctgtgtctctgggcgagagggccaccatcgagtcgcaagtccagcgagacttcttttatatagtgtcaacgataaggactatttagcttggtatcagacaaaaccgagacagacctacctaaactgctcactctcgtggctactaccgtacccgggccgaccccgggacgtcccgtacgacccgtattccgaggtcggacgaggtccggggtcgtacggggaactacgtaccttacaccgttacctaccaccctaagtaccgacgtaccctaacccgttaggaccgtacgggtacctagggtaaacggtagttagggtacggtactttaaggttttaccgtttaacggtttacggttaccgtaacggtccgttaaaggttttacggtttaggttaaccggtaaccggttcccggttacccggttccgtttacccggttaacccgggtttttccgggggaaccgggtaccggggtaaccccgggtaggggttacgggacggttacgtaccggtaaccgggaaccgttaaccggttggttccgggtaccgttacggacccgttaacgtaccgtttccgttcggttacctttacccgg

SEQ ID NO: 243923 - DNA, 617 bp, Homo sapiens
  misc_feature: GYAE6OF02G9HFQ.11.11.A11.1.454.CMB.1.raw
  modified_base (420)..(420): a, c, t, g, unknown or other
  misc_feature (420)..(420): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtacaacgataaggacttatttagcttggtatcagacaaaaaccaggacacgcctacctaaactgcctcatcctccgtgggcactccgtacccgggccacccggacgtccctaggaccgtattccgagtcggcacggtcgggtcgtcggggacaggtacttaccactcctccaccatcacgccaacctgacaggcctaggaagtntaggtggtacttagttttatacgttgtacagtctaagttagttgtagaacgtccgttaccgtcttacgttaccggtttccgggacggggtaaccgggaccggtcgggtagggacgtacgtaccggtaacggaacccggtagttcgggtacggcccgttcggacctacccgtacgtttcgttcggttcctttaacccg

SEQ ID NO: 243924 - DNA, 620 bp, Homo sapiens
  misc_feature: GYAE6OF02HD5FS.11.11.A11.1.454.CMB.1.raw
  modified_base (210)..(210): a, c, t, g, unknown or other
  misc_feature (210)..(210): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagacgggccaccatcgagtgcaagtccagcgagacttcttttanatagtgtacaacgataaggacttatttagcttggtatcagacaaaaaccaggacagcctacctaaactcgactcatcctccgtgggccacgtccgtacccgggccacccgggactcccgtcgaccgtattccgagtcggcacggtcgggtacgtgggaccagtacttcactcctacaccactcgacgtaccaccgtcgacgtaggctagaacgtgtggtacggtacttaaggtttacttacgtacgtcgacgtcgtagttacttacggtagaaccgtcctccgtccttacggttaccgttcgggacgggaccgggtaccggtgggtacggacgtagtaccggaacggtaaccgtacggtaggtacggtaccgtacggaccgtaccgtacgtccgtttacgtccttacccg

SEQ ID NO: 243925 - DNA, 669 bp, Homo sapiens
  misc_feature: GYAE6OF02GMM7T.11.11.A11.1.454.CMB.1.raw
  modified_base (215)..(215): a, c, t, g, unknown or other
  misc_feature (215)..(215): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtntacaacgataaggactatttagcttggtatcagacaaaaaccaggaacagcctacctaaactgctacatctccgtgggcacgtccgtaccccgggccaaccccgggacgtccccgtacgacccgtattcgagtggcaggccggggttctggggacacggtacttcactcctacacctactcacgaccaaccctcgacgaggtccgtaggaaacgtgttcggtagggtactaaggtttttaacttaacgttggtacagtactaagtttacgtggtagaccgtcctccggtacttacccgttacggtttcggggaccgggtacgggaacccggtggggtacggtacgtacgtaaccggaaacgggtaacccgtaacgggtttcgggtaccgggtacccgttaccggacccgttaacccgttaacggtttccgtttaccgggttaccctttacccgg

SEQ ID NO: 243926 - DNA, 570 bp, Homo sapiens
  misc_feature: GYAE6OF02IJO1M.11.11.A11.1.454.CMB.1.raw
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
  modified_base (396)..(396): a, c, t, g, unknown or other
  misc_feature (396)..(396): n is a, c, g, or t
tcagcgagagataccacgaccggtgctcgatttagctacgactgcagggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggactatttagcttggtatcaagacaaaaaaccgaggacacgcctacctaaactgctcatctcctgggcagtccgtacccggggcaccccggagtccctgaccgtattcagtgcaggcgggtntgggacagacttcactctcacntcacgcaactgcaggctagaacgngtagtggactagttttatactgtacagctagttattggtagtaacgtccttccgtcttaccttacggttccgggacgggtacgggaccggtcgggtacgggagtacgtacgaaggtaaccgtacgtggtacggcgttcggaccctaccgtactttccgttcgtacccgtttacc

SEQ ID NO: 243927 - DNA, 550 bp, Homo sapiens
  misc_feature: GYAE6OF02IVIV9.11.11.A11.1.454.CMB.1.raw
  modified_base (370)..(370): a, c, t, g, unknown or other
  misc_feature (370)..(370): n is a, c, g, or t
tcagcgagagataccacgaccggtgctcgatttagctacgactgcagggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtacaacgataaggactatttagcttggtatcagacaaaaacagacagcctactaaactgctcatctcctgggctactccgtacccggcacccggatccctgacctattcaggtcgcaggcggtctagggacagtacttcactctacaccatcganaccaactgacaggctagaagagtggtgtacttaagtttacttacgtgtacagtctaaggttatagtagaacgtcctccgtactaccgtacgggttcggacgggacggacggcgggtaggagtacgtcggaaggaccgtaagtcggtacggactcgacctaccgagttcttcgtactaccg

SEQ ID NO: 243928 - DNA, 713 bp, Homo sapiens
  misc_feature: GYAE6OF02IA2LI.11.11.A11.1.454.CMB.1.raw
tcagcgagagataccacgaccggtgctcgatttagctacgactgcaggggcagcaaaggatggtgttgtagacccaggtcttcatttctctgttgcctctggatctctggtgcctggtggggacatcctgatcgacccagtccccagatatcctgcctgtgtctcgtgggcgagcgggccaccatcgagtcgcaagtccagcgacgtacttctttatatagtgtacgaaacgagtaaacggacttagtttagccgtttagggtaacttcaacggaaccaaaaaaccgaggaaccacggtaccctaacctaaacgtcgacctacaacttctcccgttagggtacctacgttacccgtacccgggaccgaccccgggtacgtccccgtacgaccgtagttccgaggtcggcgtacgggtcgggtcggtacgggaacgtaggtaccgttacgactacctcctacctatccgacgacctaaccgttcgacgacggtacgtaacggtaagtacggttacggtaggtacgtttaaacggttttaattacggttcggttaaccgtacgtacgttaagttagtaggtacgtacgtccgtaccgtctacggttccgttcgggacgggtaccgggaccggtcgggtacggtagtacgtacgtaacggtcgtaacgttggccggtacgcgtacctacgtacgttcgtcgttacctcgttacccg

SEQ ID NO: 243929 - DNA, 505 bp, Homo sapiens
  misc_feature: GYAE6OF02FS35Z.11.11.A11.1.454.CMB.1.raw
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggacttatttagcttggtatcagcaaaaaaccaggacagcctacctaaactgctcatctctgggcatcctacccgggcacccggatccctgaccgattcagtggcaggcgggtctgggacagacttcactctcacntcagcaacctgacagctagaagtntgtggctagtttattacttgtcagtctagttattgagaacgctaccgctctacgtttcggcggtacgggccgngggtggagntcgaaggacacgtggngtcngcctacntctcgtcttac

SEQ ID NO: 243930 - DNA, 728 bp, Homo sapiens
  misc_feature: GYAE6OF02FTO6I.11.11.A11.1.454.CMB.1.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (272)..(272): a, c, t, g, unknown or other
  misc_feature (272)..(272): n is a, c, g, or t
tcagcgagagataccacgaccggtgctcgatttagctacgactgcagggggccaaagcaacgatgggtgttagccagacccaggtcttcatttcctctgttgcgtctggactcgtctggtgccttgtggggacatcctgatgacccgagtcccccagactatcctgcctgtgtctctgggcgagagggccaccatcgagtcgcgaagtccagcgagccttctttanatagtntcaagataaggactatttagcttgtatctagcaaaaaccnggacacgtcctacctaaaactggtctacgaagttcctccggtgggctaatccgtaccccggggcgaaccccgggtagtcccctggacccgatttaccaagttcggctacgcggggtctaggggaccagggtacttcgaaccttctaccgaaccctagtaccaacggaccaaacccgttgaccgtacggtaccgtacggaaacggtaacgtcggtacgggacgttacggttttaactttacggttacgtaccgtacgtacgtaggtttacgtttggtacggtaaacgtcccgttaccccggtcgtttaccgttaccggtttttccgggacggggtaacggggtacccggtggggtacgggtagtaccggtaacggtaacggttaaccgtaaccgtttgggtacggttccgttacggaccctaaccggtacgtcccggttacggttaccctttaccgg

SEQ ID NO: 243931 - DNA, 519 bp, Homo sapiens
  misc_feature: GYAE6OF02GRWPS.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttgtatcagcaaaaacagacagcctactaaaactgctcatctcctggcatctacccgggcacccggatccctgaccgattcagtgcagcgggtctgggacagacttcactctcaccatcagcaactgcaggctgaagatgtggctaagttttataactgtacagctagtaatttgtagaagtctaccggcttactaaccgtttcggcggggaagggacccgcgggtggtagatcgaacgaacggaaactgttaggctcggccaaccgattccgtgttcttacc

SEQ ID NO: 243932 - DNA, 659 bp, Homo sapiens
  misc_feature: GYAE6OF02GFDSO.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttctttatatagtgtacaacgataaggactattagcttgtatcagacaaaaacaggacacgcctacctaaactgttacatcctccgtggctacgtccgtacccgggccgacccggtacgtccccgtcgaacccgtatttcgaggtcggcaggccggtcgtggggaccacggtactttccactcctacaccatcacgaccaactgacgtaggctagaacgtagttgtacgtacttagtttactttacgtgttacagtagtaacgttagttggtaacgtaacgtcccgttaccgtccgttacgttaccggtttcccgggaacggggtaccgggtaccgggtaagggttcgggtaaccgtacgtaaccggtaaacggtaaccggtaaccggtagggttccggtacgtccggacccgttaaccgtaccgtttaccttccggtttaccttacccgtttaacccg

SEQ ID NO: 243933 - DNA, 559 bp, Homo sapiens
  misc_feature: GYAE6OF02IW4NP.11.11.A11.1.454.CMB.1.raw
  modified_base (263)..(263): a, c, t, g, unknown or other
  misc_feature (263)..(263): n is a, c, g, or t
  modified_base (406)..(406): a, c, t, g, unknown or other
  misc_feature (406)..(406): n is a, c, g, or t
tcagcgagagataccacgaccggtgctcgatttagctacgactgcaggggcagcaagatggtgttgcagacccacggtcttcatttctctgttgctctggatctctggtgcctgtggggacatcctgatgacccagtccccagatatcctgcctgtgtctcgtgggcgagagggccaccatcgagtgcaagtccagcgagacttcttttatatagtgtcaacgataaggactattagcttgtatcagacaaaaaccaggacancctacctaaactgctcatcctcgtgggcactccgtacccgggcaccccggatcccctagaccgtattcaggtcggcaggcggggtctgggaacagtaccttcacttcctcaaccataccacgaccaactgcaggctagaagtntggtggacttagtttatacgttgtcacgtctaagttatttcggagaactcctccgcttccgttacgttcggggaacggccgggtaaccgcgggtagagtactacggaacggtaacgtacgtggtcgctaggccaacctgtccttagtccttac

SEQ ID NO: 243934 - DNA, 582 bp, Homo sapiens
  misc_feature: GYAE6OF02GIFC9.11.11.A11.1.454.CMB.1.raw
  modified_base (209)..(209): a, c, t, g, unknown or other
  misc_feature (209)..(209): n is a, c, g, or t
  modified_base (335)..(335): a, c, t, g, unknown or other
  misc_feature (335)..(335): n is a, c, g, or t
  modified_base (391)..(391): a, c, t, g, unknown or other
  misc_feature (391)..(391): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagacgggccaccatcgagtgcaagtccagcgagactcttttanatagtgtacaacgataaggactaatttagcttggtatcaaccaaaaacaggacagcctactaaatgctcatctctggcatccgtaccggcacccggagtccctgaccgattcaggtgcaggcggtntggggacacgtacttcgacttcacaccgatcagccaacctgacagctgaagtatgngctagttatatagtcagactattagttgtagagtccgtcgcgttactaacggtttccgggacgggttaaccggggaccggtacgggggttaggaacggtacgtaacgtaagggtaacccggttaacgtagggtacgggttaccgtgaacccgtaccgtagtttccggtcgtttaccgttacgttaacccgg

SEQ ID NO: 243935 - DNA, 559 bp, Homo sapiens
  misc_feature: GYAE6OF02FKT9P.11.11.A11.1.454.CMB.1.raw
  modified_base (399)..(399): a, c, t, g, unknown or other
  misc_feature (399)..(399): n is a, c, g, or t
  modified_base (482)..(482): a, c, t, g, unknown or other
  misc_feature (482)..(482): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctccgtggcatccgtacccgggcacccggagtcccgtgaccgattccgagtggcaggcgggttcgtgggacagacttcactctaccaccactcacgcaacctgcaggtcaggaagatggngactagtttatacttgtcagctagttattggtagaagccttaccgtactccgttaccgtttcgggaccggtaagggtcccggngggttgggacgtagtaccgaaggaaccggtaacgttgggtcggtcgtcgacctaccagtttccgtacgttcttaccg

SEQ ID NO: 243936 - DNA, 526 bp, Homo sapiens
  misc_feature: GYAE6OF02IRCK5.11.11.A11.1.454.CMB.1.raw
  modified_base (312)..(312): a, c, t, g, unknown or other
  misc_feature (312)..(312): n is a, c, g, or t
  modified_base (387)..(387): a, c, t, g, unknown or other
  misc_feature (387)..(387): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagacaaaaaccaggacagcctacctaaactgctcattctccgtgggcatccgtacccgggcaccccggngtcccctgaccgattcagtgcaggcggtctgggacagacttcactctcaccatcagccaacctgcagctagaagntggcgctagtttattctgtctagctagttattgagaacgtcctccgcttcgtacgtttaccgggcggacggggccgtcgggtgacgatccgaaggaaccgtaacgtggtcgtcgtacgctaccgatccgttagtcttac

SEQ ID NO: 243937 - DNA, 643 bp, Homo sapiens
  misc_feature: GYAE6OF02IQDJX.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttacttttatatagtgtcaacgataaggactatttagcttaggtatcaagacaaaaaccaggaacacgacctacctaaactgctcactctccgtgggactacgtccgtacccggggccgaaccccgggacgttcccctaggacccgtacgttacaggtggccgacggcggggtctaggggaccagtacttcacttcctacacccatacgacgtacctaaccgtgacgaaggtctaaggaagagttggtacggtacttaagttttacgttacgtagtacaggacttaacgttatttcggtacgtaacgtccgttcccgtacgttaccgttaccggtttccgggacgggtaccgggtaccggtacgggttaggacgtacgttacgaacggtaaccgaacgttcggtacggtacgttcgactacctagttcgttacgttcttaccg

SEQ ID NO: 243938 - DNA, 652 bp, Homo sapiens
  misc_feature: GYAE6OF02HFYNZ.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagaggccacatcgagtgcaagtccagcgagacttcttttatatagtgtacaacgataaggactagtttagcttaggtatcagacaaaaaccaggacacgtcctactaaactgactcatcctcctggcatccgtacccggccacccggacgtccctgaccgtattccgaggtcggacacggtcgggtcgtacggggactacggtacttcgaccttccgtaccacctaacgtcccaagacccaaccgtggaccgaacggtccttaaggaaagtgtacggtacggacttaagttttacttacgttacgttacgagttaacgtagtttacgttagggtacgtaaacgtccgtacccgtacgtaccgttacggtttccggggaccggggttacggacccgggtcggggtacggaacgtcgtacgaacggtaaccggtaacgtcggtacggacgttcgaccctaccgtacgttcgttaccgtcttaacccg

SEQ ID NO: 243939 - DNA, 648 bp, Homo sapiens
  misc_feature: GYAE6OF02IVUM0.11.11.A11.1.454.CMB.1.raw
  modified_base (250)..(250): a, c, t, g, unknown or other
  misc_feature (250)..(250): n is a, c, g, or t
  modified_base (315)..(315): a, c, t, g, unknown or other
  misc_feature (315)..(315): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccacatcgagtgcaagtccagcgagactctttatatagtgtcaacgataaggactattagcttggatcagcaaaaacnggacagcctactaaactgctcatctccgtggctatccgtacccggcaacccggatccctgaccgnttccagtcggcaggcggtctgggacagtacttcgactccgtacaaccgtatccgagacctaaaccgtgccgtaaggccttacggaaagtacgtggtacggacttaacggttttattaaaccgtcgttacgaacgtacctaggtttaacttgttaggaaacgtccgttcccgacttaccgtaaccggttttccgggaacggggaacggtacccgggcgggttacggggtaacgtacgttaaccggaacggtaaacccggtaaaccgtttggggtaccgggtaccgttacggaccgtaaccccgttaattccggttacggtttcctttaacccgg

SEQ ID NO: 243940 - DNA, 783 bp, Homo sapiens
  misc_feature: GYAE6OF02JDBP0.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccacgtccccagatactcctgcctgtgtctcgtgggcgagagggccacactcgagtgacaagtcccgagacggacgtaacctttctttttaagtaattaggtcgttaaccaaacggtaagttaaacgggtaactttaagttttaacggtccttttaggggttaattaccaacggaaaccaaaaaaaccgagggaaacctaacggtaccccttaacctaaaaccttcggtaccttactaacctcccttaccgtaccggggcctaacgttccccggtaaccccggggtcccgaaccccgggtaccgtccccgtaccggacccgtaacgtttcaacgggttcgaccgtacgggtccggggttaccacggggactaacgggtacccttccgtaccgttcctacctaacccgtactccgaaccgtaccaaaccgttccgaacgacggtacgtaagaaggtacgtagtggtacttaagtttacttacgttagtctagtacgtagttattggaacgtcgtaccttccgacttccgtaccggtttcgggaacgggtaccggaccgggtacggtacgggtacgtcgtacggaaacggtaaccggtaggtacgggttcgtaacctcgggacctaccctagtcccgttacgtttaccttaccg

SEQ ID NO: 243941 - DNA, 689 bp, Homo sapiens
  misc_feature: GYAE6OF02H8W7O.11.11.A11.1.454.CMB.1.raw
  modified_base (288)..(288): a, c, t, g, unknown or other
  misc_feature (288)..(288): n is a, c, g, or t
  modified_base (557)..(557): a, c, t, g, unknown or other
  misc_feature (557)..(557): n is a, c, g, or t
tcagcgagagataccacgaccggtgctcgatttagctacgactgcaggggcagcaagatggtgttgcagacccaggtcttcatttctctgttgctctggatctctggtgcctggtgggacatcctgatgacccagtccccagatatcctgcctgtgtctcgtgggcgaggacgggccaccatcgagtgcaagtccagcgagaccttcttttatatagtgtcaacgataaggactattagcttggtatcagacaaaaccagacacgcctacctaactgctcatcctcgnggctactccgtacccgggccgaccccggtacgtccccgtcgacccgtattcgaggtcggcgacggtccggggtacgtacgggaaccgtacgtacccgttacctaccttcctaccgaacctacgtaaccgacgacctaaacccgtgacccgacgggtaccgtaggaaacgggtacttcgggtacggttaactttaacggttttaacgtttaaccggttctaccgtaaggtaccttaggtttagttcggtagtacgtcccgttaccccgtnttacccggtttacgggttaccgggccggggaaacgggtccggtaccggggtaggaccgtaacgtaggaacggaccggttaacggtcggtacggaccctcggacctaaccgtacttcgttcgttaaccctccg

SEQ ID NO: 243942 - DNA, 709 bp, Homo sapiens
  misc_feature: GYAE6OF02IVEJL.11.11.A11.1.454.CMB.1.raw
  modified_base (209)..(209): a, c, t, g, unknown or other
  misc_feature (209)..(209): n is a, c, g, or t
  modified_base (265)..(265): a, c, t, g, unknown or other
  misc_feature (265)..(265): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatgacccagtcccagatatcctgcctgtgtctcgtgggcgagaggccacatcgagtgcaagtccagcgagtacttcttttanatagtgtacaacgataaaggactagtttagcttaggtatacaacggacaaaaacgnggacacgtacctactaaactcgactactactcgtaccgtggactacttaccgaccgggtaccgacccggtacgttacccctacggaaccgtacgtttaccgacggtacggaccgtacgggtccggggttacgtacggggtaaccacgggttaacccttacgtacccttactaccaacccgtagtacccgaacggtaaccctaacccgttgaccgtaacgggaccgttaacgggaaactacgggttcgtacgggtaactttaacggtttaagtttaccgtacggttaacgacgtacctaagggtttacgtaggtacgaacgtccgtaccgtctacgtaccggttacggcggggacggtacggtcggttaggacgttaacggtaccgaacgggtaactaccgtgggtccgacttacggacctacgttacgtcgtacgtccttaacg

SEQ ID NO: 243943 - DNA, 697 bp, Homo sapiens
  misc_feature: GYAE6OF02GASRN.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccacgtccccagatatcctgcctgtgtctctgggcgaggagggccaaccatcgagtgacaagtccagcgagtacttcttttatatagtgtacaaacgataaggacttagtttagctttaggtatcaacgaacaaaaaccgaggacacgcctacctaaactgctactactcctccgtggcacgtccgtacccgggccacccggtacgtcccgtacgaccgtattcgagtcggcgacggtcggggtcgtacgggactacgtaccttaccacttcctaccaccctaacgtacgacgaccctaaccgtcgaccgacggacgtaggaagtacgttcggtacggtacgttaacgttttaacgtttacgttagtacgtaacgtacgtaagtttagttgggtacgtaacggtccgttcccgtaccttaccgttacccgggtttacgggaccggggtaccggggtaccggggtacggggtacgggtacggtacgtaacggaaacgggtaaaccgttaacggtagggttacggtaccgtacgacctaaccgtacttaccgttacgttccttaaccg

SEQ ID NO: 243944 - DNA, 582 bp, Homo sapiens
  misc_feature: GYAE6OF02GL1CA.11.11.A11.1.454.CMB.1.raw
  modified_base (207)..(207): a, c, t, g, unknown or other
  misc_feature (207)..(207): n is a, c, g, or t
  modified_base (255)..(255): a, c, t, g, unknown or other
  misc_feature (255)..(255): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactctttanatagtgtcaacgataaggactatttagcttggtatcagacaaaaaccnggacagcctacctaaactgctacatcctaccgtgggcatccgtacccgggcaccccggacgtccctgaccgattcgagttcggcaggcgggtctggggacaggtacttcactctcaccatcagccaactgcaggctagaagtactggtcgactaagtttacttacgtgtaccaggtacctaagttactttggtagaaacgtccgttccggacttccgtaccggttttcgggacgggtacgggtaccgcgggttaggacgtatacggaaggaccgtaacgtggttacggcgttacggcctaaccgtacgtccgttcggttccttaccg

SEQ ID NO: 243945 - DNA, 682 bp, Homo sapiens
  misc_feature: GYAE6OF02HNOOD.11.11.A11.1.454.CMB.1.raw
  modified_base (226)..(226): a, c, t, g, unknown or other
  misc_feature (226)..(226): n is a, c, g, or t
tcagcgagagataccacgaccggtgctcgatttagctacgactgcaggggcagcaagatggtgttgcagacccaggtcttcatttctctgttgctctggatctctggtgcctggtggggacagtcctgatcgacccacgtccccagatactcctgcctgtgtctcgtgggcgaggacgggcccaccatcggagtcgacaacgtccaggcgagtacctttcttttanattagtgtacaacgtagtaaggtacttaatttacgcgtttaggtactacgaagtaaaccaaaaaacgacggaacacggaccctaacctaaacgtcactaccacttcctccgtggacctactacccgtacccgggcccacccgggtaccgtacccgtacgaccgtacgttacgacggtcggacacggtcgggttctacggggaactacggtacccgttcaaccgttcctacgaaccctatacccgagacccgtaaccgtcgcgtaacggctaaggaacgtagtcgtacgggacttagtttaatcggtactagacgtacttagtcttagaaggtacctaccctcgaccgtttcctaacggttcgggccgggaagtcccggtggaggacgacgtccgaaggaacccgttaggtcgggtacgtcgaccggtaccaccggttatccggttacctgtttccg

SEQ ID NO: 243946 - DNA, 612 bp, Homo sapiens
  misc_feature: GYAE6OF02FNF12.11.11.A11.1.454.CMB.1.raw
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagcaaaaaccaggacagcctacctaaactgctcatcctcctgggcacgtctacccgggcacccggacgtccctagaccgattcgagtcggcagcgggtctgggacagacttcactctcaccntcacncaacctgcacggctagaagntggtgcgtatttattactgtacagactagttattgtagaacgtcctcccggtcttaccgtacgtttaccggggaccggggaacggggtacccggtacggggttacgggacgtacgtaaccggtaaaccgggtaccggtaaaccggtttgggtaccgggttaccgtaccggtaacccgacccgttaacgttccccgttttacgggttacccttttaaccccgg

SEQ ID NO: 243947 - DNA, 594 bp, Homo sapiens
  misc_feature: GYAE6OF02GWY15.11.11.A11.1.454.CMB.1.raw
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (391)..(391): a, c, t, g, unknown or other
  misc_feature (391)..(391): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagacaaaaaccaggacagcctacctaaactgctcatctccgtggcactctacccgggcaccccggagtccctgaccgnttcagtggcaggcggtntgggacagtcttcactcncaccatcanccaacctgacgacggctagaagtntgtggacttagtttatacttgtcagtctagttatgtagagtccttccgcgttccgtacgtttccgggaccgggtacgggacccggtcgggtaggtacgtacggtacgtaacgggtaaccggtaacgttcgggtacgggtacccgttaccggtacccgtaacccgttacgtacccggtttcggtttaccccgttttaaccccgg

SEQ ID NO: 243948 - DNA, 553 bp, Homo sapiens
  misc_feature: GYAE6OF02HBL58.11.11.A11.1.454.CMB.1.raw
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
  modified_base (429)..(429): a, c, t, g, unknown or other
  misc_feature (429)..(429): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggcccaccatcgagtgcaagtccagcgagacttcttttatatagtgtcaacgataaggactatttagcttggtatcagcaaaaaccaggacagcctcctaaaactgcctcatcctcctgggcactccgtacccgggccaccccgggagtcccctgacccgtattcagtggcaggcgggtctgggaccagaccttcnctctcaccntcagcaacctgcaggcagaagntgnggctagttattacgtgtacgagctagttnttggagacgtcctccgcttccgtacgtttcgggacgggacgggtacccggcggtggacgagtaccgagaccggtaacgtggtacggcttacggaccaaccgttacgtcttcggttccttacccg

SEQ ID NO: 243949 - DNA, 653 bp, Homo sapiens
  misc_feature: GYAE6OF02I7DD4.11.11.A11.1.454.CMB.1.raw
  modified_base (368)..(368): a, c, t, g, unknown or other
  misc_feature (368)..(368): n is a, c, g, or t
  modified_base (397)..(397): a, c, t, g, unknown or other
  misc_feature (397)..(397): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctccgtgggcactccgtacccgggcacccggacgtccctgaccgattcgagtcggcaggtccgggtctggggacacggacttcactcncaccatcacgcaacctgcagctagaacgntgtggcttagtttacttacgtgtacgacgtctaagttatttcggtaggaaaccgtcccgttacccggtccgtttaccgttaaccggttttccgggggaaccggggtaccggggtaaacccgggtccggggttaggggtaccggtagtttaacccgggaaacgggtaacccggttaaaccggttggggttacccggtccgttaccggacccgttaacccgtaacggttttcgtttaccggttacccttttaccccgg

SEQ ID NO: 243950 - DNA, 553 bp, Homo sapiens
  misc_feature: GYAE6OF02HQA8Q.11.11.A11.1.454.CMB.1.raw
  modified_base (256)..(256): a, c, t, g, unknown or other
  misc_feature (256)..(256): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttatatagtgtacaacgataagactatttagcttggtatcagacaaaaaccnggacagcctacctaaactgctcatctccgtggcatccgtacccgggcaccccggagtcccctgaccgtattcaggtggcaggccgggtcgtgggacagtccttcactctcaccatcagccaacctgcaggctagagatgtgactagtttactctgtactagcgagttattggtagtaacgtccttccgcttacgtacgtttcgggacgggtacgggccggtacgggtacggacgtacgtacgaacggtaccggtaacgttggtacggctcgacctactactcgttcgttccttaccg

SEQ ID NO: 243951 - DNA, 619 bp, Homo sapiens
  misc_feature: GYAE6OF02F1BPI.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccacatcgagtgcaagtccagcgagtacttcttttatatagtgtcaacgataaggacttattagcttggtatcagacaaaaaccaggacagcctacctaaactgctcatctccgtgggctagtccgtacccgggccacccgggtacgtccctaggacccgtattcgaggtcggcgaggtcgggtctagggacctagtacttcactctaccacctatcacgccaacgtcgacaggctaaggaacgtagttggtcgtacgttaacgttttacttacgttacgtacgtacgtactaaggtttattaggtacggaacgtcctccgtacttaccgtacggtttccggggacgggacgggtccggtagggtacggacgacgtacggaacggtaacgtacggttacggtcggtaccgtcgaccgtaccgtacgttcttaccggtctttacccg

SEQ ID NO: 243952 - DNA, 583 bp, Homo sapiens
  misc_feature: GYAE6OF02GNL8T.11.11.A11.1.454.CMB.1.raw
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
  modified_base (431)..(431): a, c, t, g, unknown or other
  misc_feature (431)..(431): n is a, c, g, or t
  modified_base (508)..(508): a, c, t, g, unknown or other
  misc_feature (508)..(508): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagacgggcccaccatcgagtgacaagtccagcgagtacttcttttanatagtgtacaacgataaggacttatttagcttggtatcgaanacaaaaaccaggaacagcctacctaaactgcctacatctccgtggactactccgacccgggcacccggactccctacgaccgtatcgaggtcgcgaggccgggttcgcgggactacgtacttcgactcaccacctataccgacgaaccacctgacgacggctagaagtagttaggnggtactagttacttacgtgtacgagctagttagtgagacgtcctccgtatccgtacgttcggcgggacggtaccggnggtaggacgtagaccggtaaggaacgttacgtaggtagtccgtacgaccctaccgtatccgttagtacttacccg

SEQ ID NO: 243953 - DNA, 776 bp, Homo sapiens
  misc_feature: GYAE6OF02GF35S.11.11.A11.1.454.CMB.1.raw
tcagcgagagataccacgaccggtgctcgatttagctacgactgcagggggcagcaagatggtgttgcagacccaggtcttcatttctctgttgctctggatctctggtgcctgtgggacatcctgatgacccagtccccagatatcctgcctgtgtctcgtcgggcgaggacgggcccaccatcggaagtgcaacgtccagcgagacttcttttatagtagtcgtacaaacgtagtaaacggacttaagtttacgcgttggtaactcgaagaaccaaaaaccgaggaccacgccctacctaactcgtcctacacttcctaccgtgggactacgtaccgtaccccgggccgaaccccgggtacgtcccgtacgaccgtattacgacggtcggccgtacggtcggggtcgtaggggaactacggtacccgttcaacccgttcgtaccaccgtactaccgaacgtcccgtaaccgtcggaccgtaagggcctaggaaacgtgttacgggtacggtaccgttaaaggttttaactttagttacggtaccgtaagttacgttaaagtttacgtttaggtaccgtaaagttccccttcccggtatttacccggtttaccggtttaaccgggggaccggggtaaaccggggtcccggttacggggggtaaccgacgttaacgtaccggtaagggtaaaccccggttaaggttccgggttaccggaaccctttacgggaccccttaaccggttccgttccgttttacgttaccccgtttaccg

SEQ ID NO: 243954 - DNA, 716 bp, Homo sapiens
  misc_feature: GYAE6OF02JVCN8.11.11.A11.1.454.CMB.1.raw
  modified_base (199)..(199): a, c, t, g, unknown or other
  misc_feature (199)..(199): n is a, c, g, or t
  modified_base (265)..(265): a, c, t, g, unknown or other
  misc_feature (265)..(265): n is a, c, g, or t
  modified_base (386)..(386): a, c, t, g, unknown or other
  misc_feature (386)..(386): n is a, c, g, or t
  modified_base (421)..(421): a, c, t, g, unknown or other
  misc_feature (421)..(421): n is a, c, g, or t
  modified_base (447)..(447): a, c, t, g, unknown or other
  misc_feature (447)..(447): n is a, c, g, or t
tcagcgagagataccacgaccggtgctcgatttagctacgactgcagggcagcaagatggtgttgcagacccaggtcttcatttctctgttgctctggatctctgtgcctgtgggacatcctgatgacccagtccccagactatcctgcctgtgtctctgggcgaggacgggccaccatcgagtgacaagtccagcganacgttcttttatatagtcgtacaacgtataaggaccttattagctttggtatcaagacaaaaaccnggacacgtacctacctaaatcgcctcaactcctaccgcggtacaccttaccggaccccggggtctaccccggattccccgacggtaccgtaattccgagtcgggacacgggtccggtacgngggaccagtccttacacttccactacactccgacnccgaacctacgcgaacggtcaggaanactggtaacgggtcttaacgttttactaacgttacgtactaggtaaccgttagtttaacggttacgtacgtaacggtcccgttacccgtccgtttaccggtaccggtttccggggggaccggggtaaccgggtacccggggtacgggttaccggacgggttaccggttaacggtaacccgggtacggttaaaccggtcggggtttaacggaccgttaccgggtaccccttaccggttaacctttccggttacggtttccccttacccgg

SEQ ID NO: 243955 - DNA, 676 bp, Homo sapiens
  misc_feature: GYAE6OF02FVIX0.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagagggccaccatcgagtgcaagtccagcgagtacttcttttatatagtgtacaacgataaggacttatttagcttgtatcagacaaaaaccaggacagccctactaaactgctcactctccgtggcctatccgtacccgggccaccccgggacgtccctacgacccgtattcaggtcgcgaggtcggggtcgtgggaccagtacttcacctcctaccacctactccaaccgaccaaccgtcgacgacggtcgtacgaaaggtactagggtcggacctttaggttttaacctttacgttacggttaccgacgttaccgtaagttttcgttagggttacggtaacggttcccgtttacccggaccgttttaccgtaccgggttttccgggaccggggtaccggggtaccgggtccggggtacggaggtacgtacggtaacggaaccggtaacggttcggtacggtcgtaccgtaccgtaaccgtcgtttaccgtacgttccctttaacccg

SEQ ID NO: 243956 - DNA, 542 bp, Homo sapiens
  misc_feature: GYAE6OF02J0VIY.11.11.A11.1.454.CMB.1.raw
  modified_base (205)..(205): a, c, t, g, unknown or other
  misc_feature (205)..(205): n is a, c, g, or t
  modified_base (250)..(250): a, c, t, g, unknown or other
  misc_feature (250)..(250): n is a, c, g, or t
  modified_base (309)..(309): a, c, t, g, unknown or other
  misc_feature (309)..(309): n is a, c, g, or t
  modified_base (390)..(390): a, c, t, g, unknown or other
  misc_feature (390)..(390): n is a, c, g, or t
  modified_base (440)..(440): a, c, t, g, unknown or other
  misc_feature (440)..(440): n is a, c, g, or t
  modified_base (510)..(510): a, c, t, g, unknown or other
  misc_feature (510)..(510): n is a, c, g, or t
tcagcgagagataccacgaccggtgctcgatttagctacgactgcagggcagcaagatggtgttgcagacccaggtcttcatttctctgttgctctggatctctggtgcctgtggggacatcctgatgacccagtccccagatatcctgcctgtgtctctgggcgagagggccacatcgagtgcaagtcagcgagactcttttanatagtgtcaacgataaggactattagcttggtatcagcaaaaacnggacagcctactaaatgctcatctctggcatcgtacccggcacccggatccctgaccgnttcaggtcggtaccaggtccgggtctaggggaccaggtaccttcgacgtcctacacccatcagccaactgcacggcagaantggcgactagtttatacgtgccagtctagtatggtagacgtccttccggntaccgttcgttcgggacggtcgggaaccgtcgggtagacgtcgacgtacggaacgtaactgggtccgtanccgtacgacttacggtcctaggttccttaccg

SEQ ID NO: 243957 - DNA, 653 bp, Homo sapiens
  misc_feature: GYAE6OF02HOSW7.11.11.A11.1.454.CMB.1.raw
  modified_base (237)..(237): a, c, t, g, unknown or other
  misc_feature (237)..(237): n is a, c, g, or t
  modified_base (277)..(277): a, c, t, g, unknown or other
  misc_feature (277)..(277): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (398)..(398): a, c, t, g, unknown or other
  misc_feature (398)..(398): n is a, c, g, or t
  modified_base (432)..(432): a, c, t, g, unknown or other
  misc_feature (432)..(432): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggacgaggacggccgaccagtcgagtgacgaagtccagcgagtacttcttttatatagtagtacaaacgttttanaaggtacttagtttagtcttggtatccagacaaaaaaccnggacagcctacctaaactgctcactcgcctgggcatccgtacccgggcacccggngttcccngaccgtattcgagtggctacggcgggtctggggacaagtcttcactactccgaaacctntaccagacccaaccgtcgccgaggacctaggaanagtggtacgtacgtagttttaactacgttacgtacgtacgtcgtagttattacgggttacgtaacggtccgtacccgtcgttaccgttaccggttttacccggggacgggttaaccggggaccgggtccgggttgggacgtacgttaccggaagtaacccggtaacggtcggtacggtcgtacgacccgttaaccgtcgtttcgttaccgttccgtttacc

SEQ ID NO: 243958 - DNA, 690 bp, Homo sapiens
  misc_feature: GYAE6OF02I6R0O.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggactatttagcttggtatcagacaaaaaccaggacagcctacctaaactcgctacattacctcccgtgggaccaacgttccgtaaccccgggccgaccccggtacgtccccgtacgaacccgtatttccgaaggttcggcgacgggtccggggttcctaggggaacctaggtacctttaccaaccgttcctaccaacccataccaacgacctaaacccgtgacacggtcgtaagaacgtattggtacgtacgttagttttaacttaccgtgtacgtaacgcgttaagttatttaggaacgtaaacgtccctccggtacttacccgttaacggttttccggggaacgggtaccggggtacccgtacggggtttacggagtaacgtacggaacggtaaccgtaacggttgggacggtaccgttacggacccgtaaccgttacgttaccgttcgttcccttaaccg

SEQ ID NO: 243959 - DNA, 731 bp, Homo sapiens
  misc_feature: GYAE6OF02H1RHL.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgagagggccaccatcgagtgcaagtccagcgagacttcttttaatattagtgtacaacgataaggacttatttagcttggtatcagacaaaaaccaggacacgcctacctaaactgcctacactcttccgtgggctactcccgtaccccgggaccaccccgggacgtccccaggaccgtattccgaggtcggacgacggtccgggtcgtacggggacctacggtaaccttccgtaccgtcctaccacctacttcgaccggacctaaaccgtggaccgtaggtccgtaaggaaagtagttcggggtacgtacttaagtttttacgttaacgttcggttacagtacgtaagtttacgttacgggtagtaaccggtccttacccggtcctttacccggttaccgggttttacggggaccggggtaaccgggtacccggggtacggggttacgggtacggtaacggttacggtaaaccggtaaccggttaaaccgggtggttacgggtacccgtaccgggtacccacccggttaaccgttttccgtttaccggttccctttaaccccg

SEQ ID NO: 243960 - DNA, 767 bp, Homo sapiens
  misc_feature: GYAE6OF02H4ED0.11.11.A11.1.454.CMB.1.raw
  modified_base (272)..(272): a, c, t, g, unknown or other
  misc_feature (272)..(272): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgacaaggtccagcgacgtacttctttttaatattaggtcgtacaaacgaataaaggactatttaagctttggtatcagacaaaaacnggaacacgtcctacctaaactgccttacacttcccttccgtcggggtacctaacgttacccgtaacccccggggtacccaacccccgggtaacgtccccgttaacggacccgtaacgtttaccgaaggtcgaaccgacgggtccgggggttcgtacgggggaactacggtaccctttacgaaccttccctaaccaacccgtaacttacccgaacggtacccctaaaacccggtttcgaccggaacgggtaccttaacgggaaacggtaagttcggggttaacggtccgtttaaacggttttttaactttaaccggttcgtaccgttaacgacttaacggttagtttagggtacgaagttccctacccggtcttacccgttacgtttaccggggcgggaacggggtacccgtggggtacgtaggtaccgtacgaacggtaaccgaacggttcggttcggactacggacctacgttacttacgttcgttacctaccg

SEQ ID NO: 243961 - DNA, 683 bp, Homo sapiens
  misc_feature: GYAE6OF02JH1IG.11.11.A11.1.454.CMB.1.raw
  modified_base (150)..(150): a, c, t, g, unknown or other
  misc_feature (150)..(150): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
tcagcgagagataccacgaccggtgctcgatttagctacgactgcaggggcgagcaagatggtgttgcagacccaggtcttcatttctctgttgctctggatctctggtgcctgtggggacatcctgatgacccagtccccagatatccngcctgtgtctcgtgggcgaggacgggccaccatcgagtgcagtccagcgagacttntttantagtgtacaacgagtaaggacttagtttagcgtttggtatcagacgaaaaaccaggaacacgtcctacctaaactcgactctaatctccgtggccactccgtacccgggtaccgaccccggtaccgtcccgtacggaccgtacttacgtacggtcgtccggacggtcggggttccggtacgggggactacgggtaccttaccgaaccttccgtacccaccgtaactaccgaaccaccgaacccgtaggcccgaacggtcgtaagggaaacgtacgttgggtacgggtacgtttacgttttagttaaccgttcgtacgtagtactagttacggtgtagtaacgtcctcggtacttaccgtacggtttcgggtacccggggtacggacccgggtcggtagggactaggtaccggaacgtaaccggaagttcggtcggtagtccgaccgaccgttagttaccttggttcctacgg

SEQ ID NO: 243962 - DNA, 654 bp, Homo sapiens
  misc_feature: GYAE6OF02HZ76V.11.11.A11.1.454.CMB.1.raw
  modified_base (453)..(453): a, c, t, g, unknown or other
  misc_feature (453)..(453): n is a, c, g, or t
  modified_base (478)..(478): a, c, t, g, unknown or other
  misc_feature (478)..(478): n is a, c, g, or t
  modified_base (521)..(521): a, c, t, g, unknown or other
  misc_feature (521)..(521): n is a, c, g, or t
  modified_base (577)..(577): a, c, t, g, unknown or other
  misc_feature (577)..(577): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgtgtctcgtgggcgaggacgggccacatcgagtgacaagtccagcgagtacttcttttatactagtcgtacaaacgaagtaacggtacttaattttacgcgtttaggtatacgaagaaccaaaaaccgaggaacacgtacccttaaccgtaaactcgtactacgtactcctacccgttggggacctacgtaccgtaccccggggacctaaccccggggtcgtacccttacggaaccgtacttacggacggtcggacgacggccgggttcggtcgggacagtaccttcacctctacaccntacacgaccactgcagcgtagagtntggtctacttagtttactacgtcgtacagtgtagttatggttnaacgtcctaccgtcgttacgtcgttcggggcgggtacggtaccgggagggtagganacggttacgaacgtaaccggttacgtacggttcggtactacggacctaacccggttctacgtttcccgtacttcccg

SEQ ID NO: 243963 - DNA, 571 bp, Homo sapiens
  misc_feature: GYAE6OF02H0JP7.11.11.A11.1.454.CMB.1.raw
  modified_base (262)..(262): a, c, t, g, unknown or other
  misc_feature (262)..(262): n is a, c, g, or t
  modified_base (427)..(427): a, c, t, g, unknown or other
  misc_feature (427)..(427): n is a, c, g, or t
  modified_base (467)..(467): a, c, t, g, unknown or other
  misc_feature (467)..(467): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggagggccaccagtcgagtgcaagtccagcgagtactcttttatatagtgtacaacgataaggacttattagcttggtatcagacaaaaaccgnggaacagacctactaaactgctacatctccgtgggcacgtccgtacccgggccaccccggtacgtccctaggaccgtattcgaggtcggctaggtccgggtcgtggggacacgtacttcactcctaccgacactcacgacctaaccgtgcgaggtctagaacgtntggtagcttagtttattactgtcagctagttatgtagaanccgtccgtactcgtacggttcgggacgggacggtcggcggtaggagtacgacgaagtaccgtacgtggtcgtcacggtaccaccgtagttcgtcgttacctacg

SEQ ID NO: 243964 - DNA, 632 bp, Homo sapiens
  misc_feature: GYAE6OF02IA8OU.11.11.A11.1.454.CMB.1.raw
  modified_base (368)..(368): a, c, t, g, unknown or other
  misc_feature (368)..(368): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcagagggccacatcgagtgacaagtccagcgagacttcttttatatagtgtacaaacgataaggacttattagctttaggtatacagacaaaaaccaggacacgcctacctaaactgctacattcctccgtgggacctatccgtacccgggccaacccgggacgtccccgtagaccgtattccgaggtcggcgaggtccgggtntacgggatacgtacttacgactctaccactactcgagacccaaacgttgacgtaggactaggaagtcgttaggtcggtacgttaaggttttaacttaaccgttcggtaacctaggtaccgttaaggttacgtttaggtaacggtaaacgtccgtaccgtccgttaccgtaaccggttttcggggaccgggtacggggaccgtacggggtgacgtagtacgaacgtaacgacgtcgtggctagaccacgtactcgttagtctacg

SEQ ID NO: 243965 - DNA, 643 bp, Homo sapiens
  misc_feature: GYAE6OF02IPXND.11.11.A11.1.454.CMB.1.raw
  modified_base (501)..(501): a, c, t, g, unknown or other
  misc_feature (501)..(501): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtcccagatatcctgcctgtgtctcgtgggcgagagggccaccatcgagtgcgaagtccagcgacgtacttcttttatatagttgtacaacgtataacggacttagtttagcttaggtactacgaagaccaaaaaccgaggaacacgtcctacctaaatcgctacatctccgtgggctacgtccgtacccgggaccgaaccccggtcgtacccctcggaaccgtacgttcgaggtcggccgacggtccgggtcgtacgggaccgagtaccttccacttcctaccaacctactccgacgacctaaccgtcgaccgacggtacgtagaagacgttggacgtacttaggtttacttaacgttgtactacgntacgttagttggacgtacgtcctccgtctacgtccggtttacgggcggtacggaccgtgggtacggagtacgtacggaacggtaaccggtacgtggtacggtacctggtaccctaccgtcgttccgttacgttccgttaccg

SEQ ID NO: 243966 - DNA, 686 bp, Homo sapiens
  misc_feature: GYAE6OF02GHW8J.11.11.A11.1.454.CMB.1.raw
  modified_base (630)..(630): a, c, t, g, unknown or other
  misc_feature (630)..(630): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatcgacccagtccccagatatcctgcctgtgtctcgtgggcgaggacgggccaccatcgagtacaagtccagcgagtacttcttttatatagtgtacaacgagtaaggacttattagcttggtactacaaaacaaaaccaggacacgtacccttacctaaactgactcacttctaccgtggctacgtcccgacccgggtaccgacccggtacgtccccgacgaccgtattcgaggtcggacgacggtccggtcggtaggactacgtacctcacctctaccactactacacaccacgtcgacgaagtctaagacgttagtcggtagtccgtttaagtttactacgtggtacgtagtacgttagtttagttcgggaacgtaccggtcccttccggtaccgtttacggtacccggggtttaccggggaccgggtaccgggggtacccgggtagggtaacgggactaacgggttacggaaacggttcgaacggtttggacccggttnaccggtaccaacgtttcggtaccccttggttacccgttaccttccccgttccccgg

SEQ ID NO: 243967 - DNA, 769 bp, Homo sapiens
  misc_feature: GYAE6OF02G1XTA.11.11.A11.1.454.CMB.1.raw
  modified_base (257)..(257): a, c, t, g, unknown or other
  misc_feature (257)..(257): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgtgtctcgtgggcgaggacgggccaccatcgagtgcaagtccagcgagtacttacttttatatagtgtacaacgataaggacttatttagcttaggtatacanaacaaaaaccgaggaacacgacctacctaaactcgactactattcccgtccgtcgggacctacgtacccgtaccccggggaccgtaacccccgggtacgttccccgtacggtaacccgtactttaccgaggttcggaccggtacggtcggggtacggttacggggaactacggttaccttaccgtacctacctaccaacctactaccgtaccgaacctaacccgtcggaccgtacgggtacgtaacgggtaaacttagggtcgggttagggttaccgtttaaaggtttttaaccgtttacggttaaccggttaccgtaacggttacgtaaggtttaacgtttaggacgttaaccggtacccttcccggttaccttaccggttaccggtttaccgggggaccgggtaccgggtaccggtacggggtacggacgtacggtaccggaacggtaaccgtacggtggtaccggtcgtaacgtcccgtactacgttccgttaccgttaccgttacccg

SEQ ID NO: 243968 - DNA, 739 bp, Homo sapiens
  misc_feature: GYAE6OF02H2F9V.11.11.A11.1.454.CMB.1.raw
  modified_base (208)..(208): a, c, t, g, unknown or other
  misc_feature (208)..(208): n is a, c, g, or t
  modified_base (259)..(259): a, c, t, g, unknown or other
  misc_feature (259)..(259): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtcccagatatcctgcctgtgtctcgtgggcgagagggccacatcgagtcgcaagtccagcgagacttcttttanatagtgtacaacgataaggacttatttagcttggtatcagacaaaaaccgnggacagacctactaaatcgactacatctcgtggctacgtccgtacccggaccacccggtaacgttcccgtacggtaccgtaacgttcgaggttcggacgtacgggtccgggtacggttacggggaactacggtaacccttcgaaccttccgtaaccacccgaaattccaaggtacccaaccgttgaccggtaggtccgtaaggaaacgtagttacgggttaggactttaacggttttttacgtaacttcggtaacgtacaaccggttaatttaaccggtggtttaacggaacgtccgtaccggtttaccttccggtttaaccgggttccggggaacggggtaaacgggtcccgggtacggggttaaggacgtaacccggttacggaaccggtaaccggtaacggttcgggtccggtaccgggttaacgtaccccggaacccgttaacgtttccggtttaccggttaccctttaaccccgg

SEQ ID NO: 243969 - DNA, 731 bp, Homo sapiens
  misc_feature: GYAE6OF02IDVWG.11.11.A11.1.454.CMB.1.raw
  modified_base (302)..(302): a, c, t, g, unknown or other
  misc_feature (302)..(302): n is a, c, g, or t
tcagcgagagataccacgaccggtgctcgatttagctacgactgcaggggacggagcgaagactggtgttgcagacccgaggtctttcatttccgtctgttgctctggatctctggtgcctgtgggacagtccttggatcgacccacgttccccgtagtattactcctgtccgtgttgtcctcgtgggcgaggacgggccacagtcggagtcgacaaggtccaggcgagacttcttttagagtacgtgtacaacgtataacggacttagttacgcttcggtatcgaagtaccaaaaaaccgnggactacgtacctaccgtaaactgctacactcccgtccggtgggcctaacgtcccgtacccggggccgaacccgggtcgtccccgtaggaccgtagttcgaaggtcggtacaggtccgggtagtacgggacagtacgttacaacttctacacctagtacacgacccgtaacgtcgacgacggtacctaggaacgtacgtagtcggtacgttaacgtttaactacgttacgtacgtacgtacgtagttacgttagtacgtaacgtaccgttacctacgttaccgttaccggtttcgggaccgggtaaacgggccgggttacgggtacgggaacgtacggttaccgtaacggttaaccggtaacggtcggtttaacgacggttaccgtaccgtaaccgtacgttaccggtttacccggtaccgttacccgg

SEQ ID NO: 243970 - DNA, 612 bp, Homo sapiens
  misc_feature: GYAE6OF02F8JRO.11.11.A11.1.454.CMB.1.raw
  modified_base (208)..(208): a, c, t, g, unknown or other
  misc_feature (208)..(208): n is a, c, g, or t
  modified_base (288)..(288): a, c, t, g, unknown or other
  misc_feature (288)..(288): n is a, c, g, or t
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtcccagatatcctgcctgtgtctctgggcgaggagggccaccatcgagtgcaagtccagcgagacttcttttanatagtgtcaacgtataaggacttatttagcttaggtatcaagacaaaaaaccaggaacacgacctacctaaactgcctanactctcgtggctactccgtacccgggcacccggagtcccngacctatcgagtggcaggcgggtngggacagactcactcncaccatcagcaactgacgagctagaacgtagtcggtaggacttaagtttacttacgttcgtacagtacgtaagtacgttagtagtaacgtcctaccgtccttacccgttacggtttaccggggacgggtaaccggggtaccgggtcgggtagggacgtaccgtacggaaccggtaaccgtaacggttgggtacggtacgtccggtacctaaccgttacgttccgtttacggtaccctttaaccg

SEQ ID NO: 243971 - DNA, 571 bp, Homo sapiens
  misc_feature: GYAE6OF02IQX2S.11.11.A11.1.454.CMB.1.raw
  modified_base (259)..(259): a, c, t, g, unknown or other
  misc_feature (259)..(259): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggacttatttagcttggtatcagacaaaaaaccnggacagcctacctaaactgctcatctcctgggcatccgtacccgggccaccccggagtccccgtgacccgtattccgagtcggcaggcgggtcgtcgggacagtacttcactcctcacctatcagcaaccgtgcaggctagaagagtggtggctagtttattacgtgttacagtctagtattgtagtacgtctccgctcgtacgtttcgggcgggtacgggaccggtcggtagggacgtacgtcggaacggaaccgtaacggtggttacgggtctacggtacccgaccgtacgtacgttcgttacctttccg

SEQ ID NO: 243972 - DNA, 665 bp, Homo sapiens
  misc_feature: GYAE6OF02IHO8I.11.11.A11.1.454.CMB.1.raw
  modified_base (258)..(258): a, c, t, g, unknown or other
  misc_feature (258)..(258): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatcgacccagtcccagatatcctgcctgtgtctcgtgggcgagacgggccaccatcgagtgcaagtccagcgagacttctttatatagtgtcaagataaggacttattagcttaggtatcaagacaaaaaccnggacacgcctacctaactcgcctcacttcctcgtaggctaacgtccgtacccgggccgacccggtacgtccctcgaaccgtacgttcgaggttcggcacggtcgggtacgtagggacctagtaccgttaccaccgtactaccgaacctactacgtacgaccaacccgtgtaccgagggtcctaggtaagtacgtcggaggttaaccttagttttacgtacgttacgtacgtaagtccgtaagttacgttaggtacggtaacgtcccgtaccgttccgttaccgttaccggtttcggggaccggaaccgggtaccggtcggtagggacgagttaccggaacgtaaccggttaacgtcgggtcggtaccgttcgaaccgtaccgttacttcgttaccgttcccttaccg

SEQ ID NO: 243973 - DNA, 594 bp, Homo sapiens
  misc_feature: GYAE6OF02F2A82.11.11.A11.1.454.CMB.1.raw
  modified_base (378)..(378): a, c, t, g, unknown or other
  misc_feature (378)..(378): n is a, c, g, or t
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (433)..(433): a, c, t, g, unknown or other
  misc_feature (433)..(433): n is a, c, g, or t
  modified_base (460)..(460): a, c, t, g, unknown or other
  misc_feature (460)..(460): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatctgcctgtgtctctgggcgagagggccacatcgagtgcaagtccagcgagacttcttttatatagtgacaacgataaggactatttagcttggtatcagacaaaaaaccaggacagcctacctaaactgctcactctccgtgggacatccgtacccgggccaccccggtagtcccctagaccgtattcagtcggcaggcggggtactgggacagaacttcactctcgaaccntcacgcaacctgacnggtcaggaanatgtggacctaaggttttactacgttcgtnacgacgtagttaactttgggaagtaanccgttacgccttacgttaccgtttcgggggaccggtaagggggtaccctaggggttacggagtaacgacgtaaggaaccggtaaagtgggtacggacgttcgacccaaccgttgtacgttcggttactttaccg

SEQ ID NO: 243974 - DNA, 641 bp, Homo sapiens
  misc_feature: GYAE6OF02F5A58.11.11.A11.1.454.CMB.1.raw
  modified_base (208)..(208): a, c, t, g, unknown or other
  misc_feature (208)..(208): n is a, c, g, or t
  modified_base (403)..(403): a, c, t, g, unknown or other
  misc_feature (403)..(403): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtacaacgataaggacttaagtttagcttggtatcagactaaaaacaggacagcctctaaactgctcatctccgtggcatccgtacccgggcaaccccgggacgtccctacggacccgtattccaggtcggcaggccgggtctagggacaggaccttcaactcctacgtacccaatcacgaccaaccgtnacgacggtcgtaagaacgtatcgggtaggtaccttaagttttaacttacgttacgtacctaaggaccgtaagtttaactttggtaggtaaactccgttacccgtacgttaccttaccggtttaccgggaaccggtaacgggaccggtaccgggtggacgtagtaccgaacggtaaaccggacgttaaggtccggttagtaccggaccctaacgacttacgtttccgttacttaacccg

SEQ ID NO: 243975 - DNA, 547 bp, Homo sapiens
  misc_feature: GYAE6OF02GSC38.11.11.A11.1.454.CMB.1.raw
  modified_base (255)..(255): a, c, t, g, unknown or other
  misc_feature (255)..(255): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactattagcttggtatcagacaaaaaccnggacagcctcctaaactgctcatctcctgggcatctacccgggcacccggagtccctgaccgattcagtggcagcgggtctgggacaggacttcactctacaccatcagcaacctgcaggctgaagtatggtggctagtttattacttgtcagcagttattgtgaatccgtccgtcttcgtacgttttccgggcgggtagggacccggtcgggttaggagtacgtacgaggtaaccggtaacgtcggttggccgttacgaccgtacccgtagttccttaggttccctttacg

SEQ ID NO: 243976 - DNA, 725 bp, Homo sapiens
  misc_feature: GYAE6OF02JIX5E.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagacggccaccatcgagtgcagtccagcgagactctttatagtagtgtacgaacgataacggacttattagcttaggtatcagacaaaacaggacacgtacctaccgtaaactcgacctactacttccgtccgtaggacctacgtacccgtacccgggccgaaccccgggcgtccccgtacgaccgtacgttcgaggtcgggactacggtccggggtacgtacgggaacctacgtacccgtttacgaaccgttaccgtacccaacccgtagtaccgaacgtaccctaaaccgtacgaccgtacggtacgtacggtaacggtacgtacggtacggtacgttaacgtttacgttacttacggggggggggggttactacgtacgtacgttaagttacggtacggtaacgtaccgtcccgtaccgttaccgttaccggttaccgggtaccgggtaccgggtaccgggtacgggtacggtacggtacgtacggtaacggaacgtacgtacggtacggtacgtacgtaccgtaccgttacgtaccgttacgttaccgttaccg

SEQ ID NO: 243977 - DNA, 724 bp, Homo sapiens
  misc_feature: GYAE6OF02JI2QZ.11.11.A11.1.454.CMB.1.raw
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatactcctgcctgtgtctcgtgggcgagacgggccaccatcgagtgcaagtccagcgagtacttcttttanatagtgtacaacgataaggacttattagcttggtatcaagacaaaaaccnggaacacgcctactaaactgctactatcctccgtggctactaccgacccggcacccggtatcccagaccgattcgagtcgctacggcgggtctacgggactaacgtaccgtttaccgaacttaccgtacctaacccgtaacttacccgaacggtaaccctaaacccgtggaacccggtaacggtaccgttaacggaaacggtacttcggggtacggttacgtttaacgttttaaacgttaccgttcggttaccgtaacggccgttaaggtttagtttacgggtaacgtaaccgtcccgttacccgtaccgttaccgttaaaccgggttttcccggggaaccggggtaaaccggggtacccgggacgggttacgggtaacgtaacggtacctaacgggtaaccggtaacggttcggtccggtactcggaccctaaccctgttaccgttgtaccctttaccg

SEQ ID NO: 243978 - DNA, 755 bp, Homo sapiens
  misc_feature: GYAE6OF02H5YLK.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatactcctgcctgtgtctcgtgggcgagacgggccaccatcgagtgacaagtccagcgagtacttctttatatagtgtacaacgtagtaaggtacttagtttagcgttaggtatcagtacaaaaacgaggacacgcctactaactgctacactccgtaccgtcgggacctacgtacccgttaccccgggacccgtaaccccggtaccgttccccgtacggacccgtaacgttcggaaggtcggaccgtaacggtcccgggttacgtcgggtaacgtaaccgtaccttaccggaaccttccctaccaaaccctcgtaccaacggaaccctaaccgttcggaccgtacgggtaccgtaacggtaaacgtacgtagggttacggtaccgtttaagtttttaaccgttaaccgttcggttaacgtacggtaccgttaagttacgtttaacgggtacggtaaaccgttcccgttcccgtaccgtttccgtaacccgggttttccggggaccggggtaacgggtaccccgggtgggtacggtacgtacgttaccggaggtaacccgtaagtcggtaccgtacgtccgaactaccgtgttaccgttacgttccttacccg

SEQ ID NO: 243979 - DNA, 712 bp, Homo sapiens
  misc_feature: GYAE6OF02GPCKU.11.11.A11.1.454.CMB.1.raw
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgaggagggcccaccatcgagtgactaagtccagcgagacttcttttaanatagtgtcaacgaataaggcttagtttagcttggtatcagacaaaaacgngacagcctactaaactgctacgactctccgtgggtcacgtaccgtacccgggacctaacccgggtaccgttcccgtacgaacccgtattcgaacggtcggccgacggtccggggttcgagggtacaacggtacttctaccgtcttaccgacctacgttacncgaacctaaccgngaccgtaggtccgtaggaaacgtaagtggtacgggtacctaacgttttaactacgttagtaccgtaagtacgtaacgttatttacggtaacgtaaacgtccctcccggtacgttaaccgttcccggtttacggggtaaccgggtaaccgggggtacccggtacggggtacgggtaacgtaggtaacccggaacgggttaaaccgtaaaccgggttcgggtacggttacgtaccggccgtaacccgttagttccccgtttcgtacccgtttaccg

SEQ ID NO: 243980 - DNA, 685 bp, Homo sapiens
  misc_feature: GYAE6OF02IBOEU.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatgacccacgtcccagatatcctgcctgtgtctcgtagggcgagagggccacatcgagtgacaagtccagcgagtacttcttttaatatagtcgtacaaacgaataaaggtacttatttacgcgttaggtatacgagaaccaaaaaacgaggacacgacccttacctaaactcgaccttacacttaccgtcccgtgggtcctacgtacccggtaccccgggccgaaccccggtacgttacccgtcggaccgttacttcgaggtcgcgacggtccgggtacgtacgggactacgtacttcacgttccaccactactcgacgaccctaacgcgtacgacggtactaggaaacgtgttacggtacgtacttaaggtttacttaccgtgtacgacgtacgttagtagttaggacgttaagcccttccgtaccttacggtaccggtttacggggaccgggtacgggacccgggtacgggtagacggtacgtccggtaacggtaacggttccggtcggtaccggtcttcggaccctacgtacgtttccgttacgttcttacccg

SEQ ID NO: 243981 - DNA, 676 bp, Homo sapiens
  misc_feature: GYAE6OF02JGK80.11.11.A11.1.454.CMB.1.raw
  modified_base (158)..(158): a, c, t, g, unknown or other
  misc_feature (158)..(158): n is a, c, g, or t
  modified_base (599)..(599): a, c, t, g, unknown or other
  misc_feature (599)..(599): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatcgacccacgtccccagatatcctgcctgtntctcgtgggcgaggaggcccaccatcgagtgacaagtccagcgagacttacttttatatagtgtacaacgataagacttattagcttgtatcagacaaaaaccaggacagacctacctaaactcgctactactcgtccgtacggtctaccgtccggtaaccccggcccgaaccccggtacgttcccgtaccggtaccgtacgttacgaggtcggacgtacgggtcgggtcgtaacgggacgacgttaccgttacctacctacctacccgaacctactacgaaccgtaccaacccgttgaaccggacggtaccgtaaggaaacggtagttcggtacggttagttaacgttttacgttaacgtcgtacgacgtactaagttagttacgtgaaccgttcccgaccgtcgtacctacgggtttcgggaccggggacggtacgggnggttacgacgtacgaacgtacggtacctaacggtgggtacgtacgtcgaacccgtgtaccgtcgttaccgtctaccg

SEQ ID NO: 243982 - DNA, 606 bp, Homo sapiens
  misc_feature: GYAE6OF02JWJ65.11.11.A11.1.454.CMB.1.raw
  modified_base (186)..(186): a, c, t, g, unknown or other
  misc_feature (186)..(186): n is a, c, g, or t
  modified_base (304)..(304): a, c, t, g, unknown or other
  misc_feature (304)..(304): n is a, c, g, or t
  modified_base (563)..(563): a, c, t, g, unknown or other
  misc_feature (563)..(563): n is a, c, g, or t
  modified_base (566)..(566): a, c, t, g, unknown or other
  misc_feature (566)..(566): n is a, c, g, or t
tcagcgagagataccacgaccggtgctcgatttagctacgactgcagggcagcaagatggtgttgcagacccaggtcttcatttctctgttgctctggatctctgtgcctgtgggacatcctgatcgacccagtccccagatactcctgcctgtcgtctcgtgggcgagacgggccaccatcgagngcaagtccagcgagacttactttatatagtgtacaacgtataaggtactagtttagctttaggtattcgaagaacccgaaaaaacctagggaaccaagaccccttacccttaaaaacncgaacctctacttccgtccgtggaccacgttccgtacccgggaccaaccccggtcgttccccctaggaccgttacttaccggagtcggacacggtcgggtaccgtagggaccacggtaccttcaacgtcctacgactacgcaacgacccacgtcgcgtaacgctaggaacgtagtagtcggtatacgttttaactacgttcgtacgagtacgtagttatacgttagacgtcgacgtctacgtacgtggtcgaggcgtgngancgtgagtagcgtagcgtgctacgcttctcgtactacggtc

SEQ ID NO: 243983 - DNA, 650 bp, Homo sapiens
  misc_feature: GYAE6OF02GVQZN.11.11.A11.1.454.CMB.1.raw
  modified_base (208)..(208): a, c, t, g, unknown or other
  misc_feature (208)..(208): n is a, c, g, or t
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
  modified_base (293)..(293): a, c, t, g, unknown or other
  misc_feature (293)..(293): n is a, c, g, or t
  modified_base (321)..(321): a, c, t, g, unknown or other
  misc_feature (321)..(321): n is a, c, g, or t
  modified_base (413)..(413): a, c, t, g, unknown or other
  misc_feature (413)..(413): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctctgggcgagagggccaccatcgagtgcaagtccagcgagacttcttttanatagtgtacaacgataaggacttatttagcttggtatcagacaaaaaaccgnggacagcctacctaaactgcctnacttctccgnggctacgtccgtacccgggcaccccggntcccctgaccgtattcgagtcggcaggtcgggtctgggacagtacttcactctcaccatcgacgaccaaccgtgacgacggtctaagaacgngttggtcggtacttacgttttattacgttcgttagacgttacgtagtttagtttaggtacgtaacgttcccttacccggtacctttaccgttaaccgggttttcccgggaccggggtaaacggggtaccgggttacggggtaggtacgtacgttacggaaccggtaaaccggtacgttcgggtaccggtccgtacgtaccgtacccgttaagtttcccgttacggttacccttaccg

SEQ ID NO: 243984 - DNA, 855 bp, Homo sapiens
  misc_feature: GYAE6OF02JDCMM.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtgggacatcctgatcgacccacgtccccagatactcctgcctgtgtctcgtgggcgaggacgggccaccatcgagtgacaagtccaggcgagtactttacttttatagttagtgtacgaaacgtagtaaacggtacttaagttttacgtcgtttaggtattacgaaacgaaaccaaaaaacccgaggaaaccgaacggtacccccttaaccttaaaaccgttgtacctacctaacttcccggttaaccgtcgggacctaaccgttccccggtaacccccgggacccgtaaccccgggtacccgttaccccgtacggaaccccgtagtttaccgaacgggttcggcgtaccgggtcgggttacgtacggggaactacgttaccttccgacctccgtaccaaccgtactaccaacggaccctaaccggcgtaccgaaggtaccgaaaggtaacggtcgttacgggtacggtacgtttaacggttttaactttccgacgtaacgtacgtacgttaaacggtttgttacgggtaaccgtaaccgggtcccttaccggtaacccgtttcccggtttaacccgggtttacccgggggaacgggggtaaaccccggggttacccgggtaaggggtttacccgggaagtacccgttaacgggaaaccgggtaccggttacggtaacgggccgtacggtacccgtacccgtaacgttccgttttacccggttacgtttacccgttacccg

SEQ ID NO: 243985 - DNA, 575 bp, Homo sapiens
  misc_feature: GYAE6OF02IUT7I.11.11.A11.1.454.CMB.1.raw
  modified_base (414)..(414): a, c, t, g, unknown or other
  misc_feature (414)..(414): n is a, c, g, or t
  modified_base (443)..(443): a, c, t, g, unknown or other
  misc_feature (443)..(443): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctcgtgggcgaggacgggccacatcgagtgacaacgtccagcgagtacttcttttatatagtgtacaacgagtaaggtacttattagcttggtatcagacaaaaaccaggaacagcctacctaaactgctcatcctccgtgggctactccgtacccgggccaccccggtagtccccgtacgaccgtacttcgaggtcggcacggtcgggtctagggacagtacttcactcacacatcacgccactgcagctagaagtntggtgactagtttatacgtgtacgacgtntagttattggagaacgtctaccgcttacgtacgtttcgggaacgggcggtaccggngggtagganacgtaccggaaggtaaccgagttcggcgtcgtaccgacctaccgtacttccgttacgttccttaccg

SEQ ID NO: 243986 - DNA, 616 bp, Homo sapiens
  misc_feature: GYAE6OF02GSBL6.11.11.A11.1.454.CMB.1.raw
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagacaaaaaccnggacagcctacctaaactgctcatctcctggcatcgtacccgggcaccggngtccctgaccgattcagtggcaggcggtcgtgggacagtacttcactcctacaccatccagaccaaccgtcgacgtaggcctaggaacgtagtggtacggtcttaagtttacttacggttctacgagtactagttattggtagtaaccgtccgtacccgtctaccgttacggtttccggggacgggtacgggtaccggtcggggtaggacgtacgtaccggtaacggtaaccgttaacggtacgggttcgggaccgttacggacccgtaacccgttacgtttacccggtttcgttacccgtttacccg

SEQ ID NO: 243987 - DNA, 686 bp, Homo sapiens
  misc_feature: GYAE6OF02FJ8M6.11.11.A11.1.454.CMB.1.raw
  modified_base (211)..(211): a, c, t, g, unknown or other
  misc_feature (211)..(211): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagacgggccaccatcgagtgcaagtccagcgagacttcttttanatagtgtcaacgataaggactatttagcttggtatcagacaaaaaccaggacacgcctacctaaactgacctcagtcctccgtgggcctatccgtacccgggccaccccggtacgtccccgtaggaccgtacttcgagtcggccgaggtccgggtcgtagggacctaacgtacttcgaccttcctacctacctactccaacgtaccctaaccgtgccgaaggtcctaggaaacgtacgttaggtcgggttaccttaagttttaacgttagttacggtacgtacggacctaaggtttattagggtaaccgtaacggtccttacccggtcctttacggttacccggtttacggggaccggggaacgggtcccgggttagggtacggtacggtactacccgggaagtaccggttaaacggttcgggacggttccgacggtacccgtacctacgtttccgttaccgttcctttaacccg

SEQ ID NO: 243988 - DNA, 665 bp, Homo sapiens
  misc_feature: GYAE6OF02I0IBR.11.11.A11.1.454.CMB.1.raw
  modified_base (109)..(109): a, c, t, g, unknown or other
  misc_feature (109)..(109): n is a, c, g, or t
  modified_base (221)..(221): a, c, t, g, unknown or other
  misc_feature (221)..(221): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (464)..(464): a, c, t, g, unknown or other
  misc_feature (464)..(464): n is a, c, g, or t
  modified_base (491)..(491): a, c, t, g, unknown or other
  misc_feature (491)..(491): n is a, c, g, or t
  modified_base (507)..(507): a, c, t, g, unknown or other
  misc_feature (507)..(507): n is a, c, g, or t
tcagcgagagataccacgaccggtgctcgatttagctacgactgcaggggcagcaagatggtgttgcagacccaggtcttcatttctctgttgctctggatctctggtncctgtgggacatctgatgacccagtccccagatatcctgcctgtagtcctcgtgggcgaggacggccaccgatcgacgtgaccgtaacgtccgagcgagtacttacttttanatagtcgtacaacgtaagtagtacttagttagcgttgtatcagaaccaaaacgaggacctagtccccttaaccaaattcgcctactactccgtcgacggctaaccgtccgtacccgggaccctacccggtactcccgtaccgaacgttattccgagtcggactcggtccgggtagtacggactacgtctaccncgtacncctacactcgactacccatacgccggtagaccgtagaacggtanggtcggtaacttacggtttataccgtnaccgtgtcttaaggtntacgtagacgttcccgacccttcgtaccgtttaccggggttcgggacgaccgggtacccggagttacggggacgttaactccgggaaacgtaccggttaaggtcccgtagggccttacgggaccccctaagttagttccccgtttcgtacgtttcccg

SEQ ID NO: 243989 - DNA, 595 bp, Homo sapiens
  misc_feature: GYAE6OF02F075C.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactattagcttggtatcagacaaaaaccaggacagcctactaactgctcatctccgtgggctactccgtacccgggccaccccggtacgtcccctaggacccgtattcgagtcggcaggcgggtctgggacaggtacttcgacctctaccacctactaccgacgacctaaccgtgacgtaacggcctaggaacgtagtgggtacggtacgttaagttttacttaacgttcgtactacgactagttattggtacgaacgtcctccgtacgttcgtacggttcgggacggtacgggtccgtcggaggagacgtcggtaacggacgtaacgtcggtgtaccgtcggaccaccgtatccgttacttcctccg

SEQ ID NO: 243990 - DNA, 699 bp, Homo sapiens
  misc_feature: GYAE6OF02FI26V.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtcaacgataaggactatttagcttggtatcagcaaaaaccaggacacgccctacctaaactgctactactctaccgtggcacttccgtaaccccgggcgtaaccccgggacgttccccgtagaacccggtactttcgaggtcggacacggtcggggtcgtggggacctagggtaccttaccgactcctacctaacccacgtccaacggcctaaacccgtgaccgaagggtaccttacggaaaggtagttcgggtacgggtacttaacgttttacgtttaacgttcgtacgtaggtaccttaagggttactttaggtaacgtaacggtccccgttccgttaccttaccgtttaacccggttttcggggaccgggtaacggggtacccggtacggggtcggaacgagtaccggaacggtaaccgtaacgttcggtacggtacgttaccggcccgtaaccgtacgttccgttgtttaccgttacccg

SEQ ID NO: 243991 - DNA, 663 bp, Homo sapiens
  misc_feature: GYAE6OF02GQTWJ.11.11.A11.1.454.CMB.1.raw
  modified_base (209)..(209): a, c, t, g, unknown or other
  misc_feature (209)..(209): n is a, c, g, or t
  modified_base (257)..(257): a, c, t, g, unknown or other
  misc_feature (257)..(257): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtcctcgtggcgagagggccaccatcgagtgcaagtccagcgagactcttttanatagtgtcaacgataaggactatttagcttggtatcagacaaaaaccnggacagcctacctaaactgctctactctcgtggcactccgtacccggcacccggtgtccctcgaccgtattcgagtggcaggtcgggtctagggacagtcttacgactctaccacctagtaccacgtacctaaccgtgaccgacggtctaaggaaacggtagtacgggtcggtactttaaggttttaactacgttaggtacctaggtaccgttaagttacgtttggacgtaaacgtcccgtttacccgacctttaccggttacccgggttttcggggaaccggggtaccgggtaacccgggtcggggttaacgacgtacgtaccggaacggttaaccggtacggttcggtacggttaccgtccggtacccgtaaaccttcgtttaccgttcgttaccttaacccgg

SEQ ID NO: 243992 - DNA, 743 bp, Homo sapiens
  misc_feature: GYAE6OF02JL9KC.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtgggacatcctgatcgacccacgtccccagatactcctgcctgtgtctcgtgggcgagacggccaccagtcggagtcgacgaacgtccgagacgagtaccttactttatagtacgtcgtaacaacgtagtaagtacttagttagcttagacacaagaccaaaaccgaggacctaccgaccttacccgtaaaacgtcgactaccgaattccgtacccgtagggactaacgtccgtaaccccggggctaaccccgggacgtcccgtaggacctacgttcgaggtcggaccacggcgggttaccgaggggacctaaggtcccgttacgaacttacctaccgaaccgataccgacgacctaaccgtgaccgaggtactaaggaaagtacgttggtacggacttaaacgtttacttaacgtagtacccgtaggtacctaaaggtttactacggacgtaacgtcttacccgtacgttaccggtaaccggtttccgggaaccggggtaccggtaccggttacggggtacgaacgtacgtacccggtaaacggtacggttaaaccgttacgggacgttaacccggtacgtaacccgtaaaccggttacggttacccgttacggttaccccttaaccgg

SEQ ID NO: 243993 - DNA, 721 bp, Homo sapiens
  misc_feature: GYAE6OF02IXKCA.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatcgacccagtccccagatatcctgcctgttgtctcgtgggcgagacgggccaccatcgagtgcaacgtccagcgagtacttcttttatatagtgtaccaacgtaataaggacttaatttagcttaggtatcgaagacaaaaaccgaggaacagacccctacctaaacgtcgacttcaacttccgtccgtcgggactacgtcccgtaaccccggggacccaaccccgggtacctccccgtcggtaacccgtacgttacgaggttcggcgtacggtcggggtccgtgggaacctaggtaccttcctactccgtaccaaccgtataccgacgaccgtaaacctcgaccgtaaggtaccgtaagtaaggtagttcggtcgggtaaccttttaagttttaacgttacgttaggtaccagttacgtaaggtttagttaggttacgaacggtccctccgtaccgtaccgttacggtttacggggaccgggtaccgggtccgggacgggtagtacgacgtaccggtaaacggtaaccgtaaggtccggtacgggcgttaccggaccctaacgtacggtttacgttacggtttccttaacccg

SEQ ID NO: 243994 - DNA, 616 bp, Homo sapiens
  misc_feature: GYAE6OF02HNAET.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagagggccaccatcgagtgcaagtccagcgagaccttacttttatattagtcgtacaaacgtataaggacttatttagcttggtatcagaaccaaaaaccgaggaacacgtaccctaccttaaaactgtacctcactcctccgtacgggtcacgtcccgtacccgggccacccggacgtccgtcgaccgtatcgagtcggcgaggtcgggtgtacgggacacgtactcactcacaccatcacgcaaccgtcgacagcgtagaagtatggtcggtacgttaagttttacgttacttcggtacagtacgtaagttagttaggtacgtaacgccgttacccgcgttacgtacggtttcgggacgggtacgggaccgtcgggtagacgtagtacgaacggacgtaacggtgtacggtactacggacctaccgtatccggtcgttacctacccg

SEQ ID NO: 243995 - DNA, 527 bp, Homo sapiens
  misc_feature: GYAE6OF02FSRKO.11.11.A11.1.454.CMB.1.raw
  modified_base (340)..(340): a, c, t, g, unknown or other
  misc_feature (340)..(340): n is a, c, g, or t
  modified_base (392)..(392): a, c, t, g, unknown or other
  misc_feature (392)..(392): n is a, c, g, or t
  modified_base (483)..(483): a, c, t, g, unknown or other
  misc_feature (483)..(483): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagacttcttttatatagtgtacaacgataaggacttatttagcttggtatcagacaaaaaccaggacagcctacctaaactgctcatctcctgggcagtcctacccgggcaccccggagtccctgaccgattcaggtggcaggngggtctgggacagacttcactctcaccatcacgcaactgacaggctagaagntgtcggctagtttacttacttgtacagtcagttattggtagaagtcctcggcttccgacgttttcggaggacgggtaccgtcgggtgacgngtaccgaagtaccgagtgtcggatcgccaccgtatctgtctacg

SEQ ID NO: 243996 - DNA, 792 bp, Homo sapiens
  misc_feature: GYAE6OF02HFS41.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtgggacatcctgatcgacccagtccccagatatcctgcctgtgtctcgtgggcgaggacggcccaccagtcggagtgcaagtccagacgacgtacttcttttatatagttgtacaaacgtagtaaacggtacttaatttaggtcgttggttactactaacggaacctaaaaaaccgacggaaccaacggtaccccttaacccgtaaaactcgtaccttacctacttccctacccggttgggacctaaccgtacccggtaccccgggaccgaccccgggtaccgtccccgtacgaccgtattcgaggtcggcgacggtcggtcggtaggactacgtacttacactcctaccgaactacgtaccgtaccgtacctaaccgtaggaccgtacggtacgtaagtacggtacgtgggttaccggtattaacgttttacgtaaccgttgtaaccgttacgtagttaacgtttagtacggttacgtaaccgttaccgtacccgttaacgttccggttaaccggtttccgggggacggggtaacgggttacccgggtacgggtacgggtaccgtaacgggtaccgttaacgggttaaacccgtaaggggttcccgtttacggggacccgttaccggttaccctaaccggttccgggtttacccgttttcggttacccttttacccgg

SEQ ID NO: 243997 - DNA, 741 bp, Homo sapiens
  misc_feature: GYAE6OF02HJHRC.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtgggacatcctgatgacccagtcccagatatcctgcctgtgtctcgtgggcgagacgggccaccatcgagtgcaagtccagcgagtactttacttttatatagttgtacaaacgtaagtaaggaccttaagtttacgtcgtttaggttaatcgtaacgaacctaaaaaaccgacgggaaccacggtaccccttaacctaaaaaccgtcgtaccttacaacttccgttacccgtaggggtacctaacgttaccccgtaaccccggggaccccgtaaccccgggtaccgttacccccgtacggaacccgtacgtttaccgaacgggtcggtacgacgggtccggggttaccgtacggggtaacctaacggtaccgttaccaccttcccgtaccaaccctaacgtaccgaacgacccgtaacctcggaccgtacgggtacttagaaacggtgtacggtacggtattaacgttttactacgttgtaccgtagtaccgttaagttgtaggtacgtaacgtcccgtaccgtccttacgttacggttcgggaccggacgggtaccggtggtagcgtagtacgtaacggactacggtggaccgttggccacgtactacgtacgttcgtaccgtccg

SEQ ID NO: 243998 - DNA, 721 bp, Homo sapiens
  misc_feature: GYAE6OF02JCVJK.11.11.A11.1.454.CMB.1.raw
  modified_base (121)..(121): a, c, t, g, unknown or other
  misc_feature (121)..(121): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (691)..(691): a, c, t, g, unknown or other
  misc_feature (691)..(691): n is a, c, g, or t
tcagcgagagataccacgaccggtgctcgatttagctacgactgcaggggcagcaagatggtgttgcagacccaggtcttcatttctctgttgctctggatctctggtgcctggtgggacntcctgatcgacccacgtcccagatactccgtgcctgtcgtctcgtgggcgaggacggccaccagtcgagtgacgaagtccagcggaactactttacttttatatagtgtaccgaaacgtaagtaacggtattactttagtcgttaggtatcgaacgaaccaaaaaccgnggacacgtacctactaaacntactcgtactcctcgtacggactaccgtacccggtacccgggaccgtacccggtaccgttacccgtacggaacccgttagttaccggaccggttcggaccgtaccgggttaccggggtcgtacggggtaacctaacggttacccgttccgtaaccttcccggaactacccggtactacccgaacgtaccccgtaaaccgtcggaaccgtacggtacgttaaggtaaccgtagttaggtccggtaacttacggttttatcgttacgtactacgtgttagtacgtgtaacgccgtacgtcgtaccgtagtaccggttccgggacgtacggcgggtacgtggtacacggtacgtaacggacgttacgtgggtacaccggttacncctaccgttatccgttaccgtacttcccgg

SEQ ID NO: 243999 - DNA, 814 bp, Homo sapiens
  misc_feature: GYAE6OF02HN40C.11.11.A11.1.454.CMB.1.raw
  modified_base (321)..(321): a, c, t, g, unknown or other
  misc_feature (321)..(321): n is a, c, g, or t
  modified_base (735)..(735): a, c, t, g, unknown or other
  misc_feature (735)..(735): n is a, c, g, or t
tcagcgagagataccacgaccggtgctcgatttagctacgactgcaggggcagcaagatggtgttgcagacccaggtcttcatttctctgttgctctggatctctggtgcctggtgggacatcctgatcgacccacgtcccagatatcctgccgtgtgtctcgtgggcgaggacggcccacagtcgagtcgacaagtccagcgaacgtacctttacttttaagtaagttaggttacgtaaccgtaaaccgaagttaaaacgggtactttaagttttaacggtcgttttagggtacttacgaagtaaaccgtaaaaaaccgnggaacacgtaccccttaacctaaaacgtcgacctactacttcccgtccggttacgggacctaccggtacccggtaaccccgggaccgtaacccgggtaccgttaccccgtacggtaacccgttacgttacggacgggttcgggaaccgtacggggttacggggtacccgtaggggaaccctacggttaaacccgttccaccgttacccaaaccgtacccgtaagtaccgtaacgaacccgttaaccgcggaccgtaaggtaacggtaacggtaagttacggttagggtaacggttacgtttaagttttacgttacgtacggtataacgttacgtaaggttctaacggtacgtaaacgtcccgtttccgacgtttaccggttacggtaccggggaacgggtacggtaacccgggngttaagacgttacgaacggtacggaccgtagtcgggtacgtccgtacgaccgtacgttacgttacttcgtactaaccgg

SEQ ID NO: 244000 - DNA, 673 bp, Homo sapiens
  misc_feature: GYAE6OF02GQ3BF.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtgggacatcctgatcgacccagtccccagatatcctgcctgtgtctcgtgggcgaggacgggccaccatcgagtgacaagtccagcgagtacttcttttatatagtgtacaaacgataacggacttatttagcttagtatcagacaaaaaccgaggacagacctacctaaactgctcacttctccgtgggctactccgtacccgggcacccggacgtcccgtcgaccgtacttcgagtcggaccgacggccgggacgtacgggacacgtaccttcaccttctaccacctagtaccaagacccgtaaacctcgacgacggtctaaggaacggtgtaggtacgtacgttacgttttacgtttaccgttggtaccgtagtacgtagttacgtttcggaacgttacgtccgttacccgtacttccggttaaccggtttccggggacgggtaccggggtacggtaccgggttaggacgacgttaccggaacggtaaccggtaaccgtgggtacggtccgttacgacccgtaaccgttaccgtcgtttaccgtccgtttaaccccg

SEQ ID NO: 244001 - DNA, 774 bp, Homo sapiens
  misc_feature: GYAE6OF02IA5SH.11.11.A11.1.454.CMB.1.raw
  modified_base (210)..(210): a, c, t, g, unknown or other
  misc_feature (210)..(210): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtggcgaggagggccaccatcgagtgacaagtccagcgagacttctttanatagtgtacaacgataaggtactaattagcttaggtatcagacaaaaacaggacagcctactaaactgactacatcctacgtggacactccgttacccgggccacccggtacgtccccgtgaaccgactttacgaggttcggcgaacggtccgggttacgtaggggactaagtaccgtttcaaccgttccgtacctaaccctacgtacaacgtacccgtaacctaggacctacgggaccgtaggaaaaggtacgttacgggtacggtaaccttaaggttttttaacgttaccgttacgttaccgtaaggtaccgttaaggtttaagttacggttacggtaaaacgttcccggttaccctaccgtttacccgtacccgggtttttaccgggggacccggggtaaacggggtaaccccggggttacgggttaacgggggtaaccgtaacgggtttaccgaaacgggttaaccggtaaaccggttccggggttaggaacccgtttaccggaaccgtaaccccggttaacctttccgggttttacccgttaccgtttttaacccccgg

SEQ ID NO: 244002 - DNA, 570 bp, Homo sapiens
  misc_feature: GYAE6OF02IT6ED.11.11.A11.1.454.CMB.1.raw
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (297)..(297): a, c, t, g, unknown or other
  misc_feature (297)..(297): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtggacggaggcggccaccgaagtcgacgtgacaagtcagcganctnttttagatagcgtacaacggataaggacttattgcttggatcagacaaaaacgtggactagccttacaatgctcagtctcgtggctacncgtacccggacaccggtanccccgttaanacctatcgagcgacacggacggtcaggactacgactcactcacgtaccagtcgaaccgcctaacgtcgacgacggtacgtagaagtcgtacgtacgtacttaagttactacgtcgtacgctagtagtagtagacgtcgacttccgtactcggtacgttcgggacgacggtcggtagtacgacgtacgtagaccgtacgtagtcggtacgtaccgtacgaccgtactacgttcgtacgttcctcg

SEQ ID NO: 244003 - DNA, 655 bp, Homo sapiens
  misc_feature: GYAE6OF02FSTVK.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagaccttcttttatatagtgtacaacgataaggacttattagcttggtatcagcaaaaaccaggacagcctacctaaaactgctcatcctcctgggcactcctacccgggcaccccggagtcccctagaccgacttcgtacgtcggacacgggtcgggtcggtacgggaacgacgttaccttactacgtcctaccaacctataccaccgtaacctaacccgtcgaccgtacggcgtaaggaaacggtgtggtcggtacgttaacgttttacgttaacgttggtacgacgtcgtaaggttacttgtacgaacgtccgttcccgactttacgtccgtttacggggacggtaccgggtaccggtcgggtaagacgacgtaccggaagtaacccgggtaacgtggggtaccggtaccgttacgacccgtaaccgttccgtaccgttcgttaccgttaaccccg

SEQ ID NO: 244004 - DNA, 735 bp, Homo sapiens
  misc_feature: GYAE6OF02HWEK0.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgagacgggccaccatcgagtaacaacgtccaggcgagactttcttttatatagtgtacaaacgtaataacggtacttatttagcgttggtatcaacgacaaaaaccaggacacgcctacctaactgctcactctccgtgggctacgtccgaccccgggccaccccggacgttccccgtacgaaccgtacttcgacggtcggacgtacggtcgggtcgtggggaacacggttaccttcaccttcctaccaaccctactaccacgtaccaacccttcggaccgtacggtacgtaagtaaccggtaggtttccggtacgggttaacttaaggttttttaacgttaacgtcggttaaccgtaacgacgttaaggtttacgttacggtacgtaacgtcccgttaccgtccctttacgttacccgggtttcgggggacccggggtaaccggggtacccggtagggtaccgggagtaccggtaccggaacggttaaccgggaccgtttggggtaccgtccggtacggtaccctaacgtaccgttccggtttacgttcccgttacgttaaccccgg

SEQ ID NO: 244005 - DNA, 687 bp, Homo sapiens
  misc_feature: GYAE6OF02JJ1RC.11.11.A11.1.454.CMB.1.raw
  modified_base (223)..(223): a, c, t, g, unknown or other
  misc_feature (223)..(223): n is a, c, g, or t
  modified_base (284)..(284): a, c, t, g, unknown or other
  misc_feature (284)..(284): n is a, c, g, or t
  modified_base (403)..(403): a, c, t, g, unknown or other
  misc_feature (403)..(403): n is a, c, g, or t
  modified_base (471)..(471): a, c, t, g, unknown or other
  misc_feature (471)..(471): n is a, c, g, or t
tcagcgagagataccacgaccggtgctcgatttagctacgactgcaggggcagcaagatggtgttgcagacccaggtcttcatttctctgttgctctggatctctggtgcctggtgggacatcctgatcgacccacgtcccagatactcctgcctgtgtctcgtgggcgaggagggcccaccagtcgagtcgacgaacgtccacggacgagtacttcttttanagtagtcgtacaacgagtaaggtacttagttagcttaggtactcgaacgaccaaaaaccgnggaacacgccgtacctaaaacgtgacctcaacttccgtaccgtaggaccactcccggtaacccggccgacccggaccgtcccgtacgaccgttatacgtagtcggacaggtcggtacgnggacactctacacgttccacgtaccagacccacgaccgtacgtcgacgacgtcgtaacgaacgtcggngttacgtactttagtttaccgttacgtacgtctaacggtcgtaacgttagtaggacgtaacggttccctaccgaccgttaacggttaccggttccggggaaccgggaccggtaccgggtacgacggtacgtaaccgtcggtaaaccgggtaactacggtacgggaccgttcctacgggtaccctacgttaccgttcggttaccttaccgtaacccg

SEQ ID NO: 244006 - DNA, 456 bp, Homo sapiens
  misc_feature: GYAE6OF02I3FUK.11.11.A11.1.454.CMB.1.raw
  modified_base (283)..(283): a, c, t, g, unknown or other
  misc_feature (283)..(283): n is a, c, g, or t
  modified_base (440)..(456): a, c, t, g, unknown or other
  misc_feature (440)..(456): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatcgacccagtccccagatactcctgctgtgtctcgtgggcgaggacgggccacatcgagtgacaagtccagcgagtacttcttttatatagtgtacaacgataaggacttattagcgttgtatcagaacaaaaaaccaggacagacctacctaaacncgctcaactcctccgtggcctacgtacccgtaccccgggccgaccccgggacgtccccgtacgaaccgtacttacgaggtcggacagggtccgggtccgtacggggacaacggtacttccgaacctcctaccacctaactcacgaccctaaccgtannnnnnnnnnnnnnnnn

SEQ ID NO: 244007 - DNA, 717 bp, Homo sapiens
  misc_feature: GYAE6OF02GZUUH.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatgacccagtcccagatatcctgcctgtgtctcgtgggcgagacgggccaccatccgagtcgacaagtccagcgagacttcttttatatagtgtacgaacgaagtaaggacttaatttagcttggtatcagacaaaaaccaggacacgacctacctaaactgctacatctccgtggctactccgtacccggcacccggacgtcccacgaccgtacgttcgagttcggacgacggtccgggtacgacgggtacacggtacttcaaccgttccgtacctaaccctacgttaccgaacggtaccctaaccggtcggaaccgtacggggtaccttaagggaaaacggtcgtttacggtacgggtaccctttaaaggttttaaccgttaacggttcgttaaacccggtagtaccgtaaaggtttcgttaacgggtaccgtaaccggtttccccgttaccgttaccgtttaccgttacccgggttttacggggaaccgggtaccgggtaccggacgggttacggagtactaccgggacgtaaaccgttcggtaggtaccggcttaacgcctaccgtagttccgttgttaccttaccg

SEQ ID NO: 244008 - DNA, 657 bp, Homo sapiens
  misc_feature: GYAE6OF02GHSNS.11.11.A11.1.454.CMB.1.raw
  modified_base (391)..(391): a, c, t, g, unknown or other
  misc_feature (391)..(391): n is a, c, g, or t
  modified_base (513)..(513): a, c, t, g, unknown or other
  misc_feature (513)..(513): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtccccagatatcctgcctgtgtctcgtgggcgagacgggtccaccatcgcgtcgacgaagtccgagcgactacttcttttaatatagtcgtacgaacgtataaaggtacttagtttagcgttaggtactcgaagaaccaaaaaccgaggtaaccacgacccttacccgtaaactcgtcctacacttcctccgtggactacgtccgtaccccggccgacccggtacgtcccgtacgacccgtattccgagtcggccgnggcgggtcgtggaacgacgtactacacctctaccactactcgacgaccaaccgtggaccgaaggtctaggaaacgtagtcggtagtaaccttagtttacgttactagtaccagtctaagttnttacggaggtacctacgtcccgtactaccgttcggttaccggcgggaaccggcggtacgggtaggactacggtaccgaaagggtaccgaaggttccggtaggtccctacgacgtaccccttaggtccttcgtaccgtttacccg

SEQ ID NO: 244009 - DNA, 732 bp, Homo sapiens
  misc_feature: GYAE6OF02IDQKW.11.11.A11.1.454.CMB.1.raw
  modified_base (434)..(434): a, c, t, g, unknown or other
  misc_feature (434)..(434): n is a, c, g, or t
tcagcgagagataccacgaccggtgctcgatttagctacgactgcaggggcagcaagatggtgttgcagacccaggtcttcatttctctgttgctctggatctctggtgcctgtcgggacatcctgatcgacccacgtcccagtatactcctcgcctgtcgtctcgtgggacgaggacgggccaccactcgagtcgacaacgtccaggacgacgtacctttacttttaataacgttagtcgtacaaacggtaataaacggtacttagtttagtacgtttaggtactcgaacgtaaaccaaaaaccgaggtaccacgtaccttacctaaacgtcgtacctactactccgtccggtagggcctacgtcccggtacccgggaccgaacccggtcgtcccgtacgaccgtacttcgaggtcgacgtacggccgggtcnggactacgtacttacgactccgtaccacctactacacgtaccctaccgtacgcggacgtcgtaagtaaggtcgttagggtacgtacgtttacgttttaagtacgttcgtacgaacgttacgtagtttacgtaggtacgtacgttcccgtcgttaccgtacgttaccgggttaccggggaaccgggtaccgggaccggtacgggtaggtaccgtaaccggtacggaaccggttaaccggtaggttccgggtacgtacgttccaccgttacctggtttaccgttccgttactttccccgg

SEQ ID NO: 244010 - DNA, 672 bp, Homo sapiens
  misc_feature: GYAE6OF02J12UH.11.11.A11.1.454.CMB.1.raw
  modified_base (217)..(217): a, c, t, g, unknown or other
  misc_feature (217)..(217): n is a, c, g, or t
  modified_base (634)..(634): a, c, t, g, unknown or other
  misc_feature (634)..(634): n is a, c, g, or t
tcagcgagagataccacgaccggtgctcgatttagctacgactgcaggggcagcaagatggtgttagcagacccaggtcttcatttctctgttgctctggatctctggtgcctgtggggacatcctgatgacccagtccccagatactcctgcctgtgtctcgtgggcgagagggtcccacatcgagtgacaagtccgagcgagtacttcgttttanataggtgtacaacgataaggtacttagtttagcttggtatcagaacaaaaccgtaggacacgtcctactaaactgctactactcctccgtggacctacgtcccgtacccgggaccacccggtcgtcccacgtaccgtacttcggagttcgggccgacggtaccgggtcgtacgggaactacggtaccttaccgaccttctaccacccgtacgtaccgacgtaccgtaccgtcggacgtaccggtacgtaacgaacgtgttacgggtacggttacgtttaaggtttaccttcggttacgtacgacgttacgtacgttagtaggttacgaacgtccgtccgtacgtaccttaccgggttacgggacgggacggtaccgggtcggtaggacgtcgtacgaacggtacgtagtcggtacgngtacccgtacgtaccgtgttacgtccgttacgttaccg

SEQ ID NO: 244011 - DNA, 759 bp, Homo sapiens
  misc_feature: GYAE6OF02HZLQF.11.11.A11.1.454.CMB.1.raw
tcagcgagagataccacgaccggtgctcgatttagctacgactgcaggggcagcaagatggtgttgcagacccaggtcttcatttctctgttgctctggatctctgtgcctgtgggacatcctgatcgacccacgtccccagatactcctgcctgtgtctcgtgggcgacggacgggcccaccagtcgagtcgacaacgtccgagcgaacgtacttacttttaatattagtagtacaaacgaagttaacggtaacttatttagcgttaggtatacagaacaaaaaccgagacacgtaccctacctaaactcgtctacactcctccgtacggcacgtccgtaccccgggacctaccccggaccgtcccgtacgaccgtacttcgaggtcggacgacggtcgggtacgtacgggaactacgtaaccttcgaacctcctaccgtaaccctactaccgaacgtacccgtaaccgtagaccgtacggtaccgtaagggaaactacggttacgggtacgtaacgtttacgttttaaaccgttaattccggtacgtagtaccgtaaacgttaggtttacggtacggtaaaccgtcctacccggtacctaccgttaccgggtttccggggaaccggggttacgggacccgggttagggacggtacgtaccggtacggtaaacggtaaccggtaacggttaccggttaccggtccgttaaccgacccgttacccgttaacgttcccgttacgtttacccctttaaccg

SEQ ID NO: 244012 - DNA, 688 bp, Homo sapiens
  misc_feature: GYAE6OF02HKFKN.11.11.A11.1.454.CMB.1.raw
  modified_base (295)..(295): a, c, t, g, unknown or other
  misc_feature (295)..(295): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgaggagggcccaccatcgagtgacaagtccgacgcgagacttcttttatatagtgtacaaacgataaggtaactatttagctttaggtatacagacaaaaaccaggacacgcctactaaactgcctanactcctccgtggctacgtcccgtaccgggacccacccgggtaccgtaccctcggaacccgtacgtttcgaagggttcggacgacggtaccgggggtaccgtaagggggtaaccacggtacccttacggaccttacccgtactaaccctagaccgacgacccgtaccgtacgacggacggcttaagaggtaagtcgggtaggtaccagttacttagttaacgtttgtacgatacaaatttacgttacttaaccgtttcctcgtttacccaagtttccgttaacggtttcccgggacgggtaccgggtaaccctagggtacccagggtcgtaacctacggaacggtacccgtaacggtttgacggtcctcggaaccctaccgtcttaccgttccg

SEQ ID NO: 244013 - DNA, 622 bp, Homo sapiens
  misc_feature: GYAE6OF02JJOST.11.11.A11.1.454.CMB.1.raw
  modified_base (219)..(219): a, c, t, g, unknown or other
  misc_feature (219)..(219): n is a, c, g, or t
  modified_base (282)..(282): a, c, t, g, unknown or other
  misc_feature (282)..(282): n is a, c, g, or t
  modified_base (570)..(570): a, c, t, g, unknown or other
  misc_feature (570)..(570): n is a, c, g, or t
  modified_base (584)..(584): a, c, t, g, unknown or other
  misc_feature (584)..(584): n is a, c, g, or t
  modified_base (605)..(605): a, c, t, g, unknown or other
  misc_feature (605)..(605): n is a, c, g, or t
  modified_base (612)..(612): a, c, t, g, unknown or other
  misc_feature (612)..(612): n is a, c, g, or t
  modified_base (617)..(617): a, c, t, g, unknown or other
  misc_feature (617)..(617): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatcgacccagtccccagatatccgtgcctgtgtctcgtgggcgaggacgggccaccatcgagtcgcaacgtccacgcgagaccttcttttanagtagtgtacgaacgtagtaaggtacttatttacgcgttaggtatcgtaagaacaaaaaccgnggaactacgccttacctaaaactcgcctactaactcttccgtggactactaccggtaacccggtccgaccccggtacgtcccgacgacctacgtcaggtacggcgtacggccgggttcgtcgggacacggtacttaccactctaccactactacaactcgctacgcgtagtcgtacgaagtagtagggtcgacgtaacgtatttacgttagtaccgttagacgtacttaaagtactttacttccttaccgttctaccgtaacttcttacggttcgacggtacggtacngtacgagatcgtanacggtactaacgtgtcgtacncgtaccncttcncgttc

SEQ ID NO: 244014 - DNA, 763 bp, Homo sapiens
  misc_feature: GYAE6OF02GJR2C.11.11.A11.1.454.CMB.1.raw
  modified_base (216)..(216): a, c, t, g, unknown or other
  misc_feature (216)..(216): n is a, c, g, or t
  modified_base (292)..(292): a, c, t, g, unknown or other
  misc_feature (292)..(292): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtcgtctctgggcgaggacgggaccaccatccgagtgcaacgtccagcgagtacttcttttanatagtcgtcaacgataaggacttattagcttggtatcaagacaaaaaaccgaggacagccctacctaaactcgctnacttcctccgtcgggcactcccgtaccccgggcctaccccgggacgtcccctaggacccgtattccgaggtcggaccgaggtccgggttcgtacgggacctaggtaccttccacttccaccaccactaccaccgactaacccgtgaccgtaggaccgtaggtaacgtagttggtacggtacgttacggttttaacttaccgttaggtaccgtaacggtctaaggttacgtttacggtaacgtaacggtcccttaccggtacctttaccgggttaacccggttttccgggggaaccgggggtaaacgggtaccccggggtttacggggaacggggtaacgttacgggtaacccggtaaacggggtttaaaccggttaaacccgggttcgggttaacggggttccccgtaaccggtacccgttaaaaccccgtttacggttaccccggtttaccggttttacccttaccccgg

SEQ ID NO: 244015 - DNA, 687 bp, Homo sapiens
  misc_feature: GYAE6OF02GOFG5.11.11.A11.1.454.CMB.1.raw
  modified_base (184)..(184): a, c, t, g, unknown or other
  misc_feature (184)..(184): n is a, c, g, or t
  modified_base (207)..(207): a, c, t, g, unknown or other
  misc_feature (207)..(207): n is a, c, g, or t
  modified_base (286)..(286): a, c, t, g, unknown or other
  misc_feature (286)..(286): n is a, c, g, or t
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
  modified_base (398)..(398): a, c, t, g, unknown or other
  misc_feature (398)..(398): n is a, c, g, or t
tcagcgagagataccacgaccggtgctcgatttagctacgactgcaggggcagcaagatggtgttgcagacccaggtcttcattctctgttgctctggatctctggtgcctgtgggacatcctgatcgacccagtccccagatatcctgcctgtcgtctcgtggcgagacggccacatcgagtncaagtccagcgagacttctttanatagtgtacaacgtataaggacttattagcttggtatcagtacgaaaaacctggacacgtacctacctaaatcgactanactctccgtggactactccgtaccgggcacccggngtaccccngacccgtattaccgaggtcgcgtacggcgggtctagggacagtacctcgacctctaccacgctaccganaccgtaaccctgaccgaggtacttacggaagttatacgggtacgacgttaacggtttacttacgtacgttacgaacgtacgtacgttaagtttcggaacgtaaaccgtcgttaacccgcgttaacccttaaccgggttttccggggaaccggtaaaccggggaccggttacgggggtaacggttaccggattaacccgggaaaggttaacccggtacgtttcggggtacggtccggttaaccggtccgttaaacccttcggttacccgtttacggtttaccctaacccg

SEQ ID NO: 244016 - DNA, 815 bp, Homo sapiens
  misc_feature: GYAE6OF02I5GUE.11.11.A11.1.454.CMB.1.raw
  modified_base (287)..(287): a, c, t, g, unknown or other
  misc_feature (287)..(287): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatgacccagtcccagatatcctgcctgtgtctcgtgggcgaggacgggccacagtcgagtgacctaagtccgagcgacgtacttaccttttataagttagtgtaccaaacgagtaaacgggacttagtttacgctttaggtatacgagtaaccaaaaaccgnggaacacgtacccttaacctaaacgtcgacctactacttcctccgtcgggactacgtccgtaaccggccgacccgggtctacccgtacgtaccgtacgttacgtaaggttcgaccgaggtcccgggttacgtacgggtacctacggttacccttaccgaccgttaccgttaccctaccctaacgttaccggaacgtaccccgtaacccgtcggaaccttaacgggaccgttaagaaacgggttacgttgggttaaacgttaccgtttaagggttttacttaaccgttcggaacccgttaaggttccttaaagggttttacgttaggtaacggtaccgtaacccggttccgtaactttacccggtacgtttacccgggggacgggttaaacccggggccggttaggggaccgggttaaacgccgttaaacggaaacccgggtttaacggaacggtttcgggggtaaccgtccgtaccggttaaccctaacggttttaaccgttccggttaccgttacctttaaccccgg

SEQ ID NO: 244017 - DNA, 745 bp, Homo sapiens
  misc_feature: GYAE6OF02HPLMZ.11.11.A11.1.454.CMB.1.raw
  modified_base (273)..(273): a, c, t, g, unknown or other
  misc_feature (273)..(273): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagaggccaccatcgagtgcaagtccagcgagacttcttttaatattagtgtacaacgaataaggtacttagtttagacgttaggtatacaacgtaacaaaaaaccnggaacacgtacctaccctaaactcgacctactacttcctccgtgggtccaagttcccggtaaccccgggacccgtaccccgggacgttccccgtacgaacccgtacttacgaggttacggacgtacgggccgggtccgtagggacctacgtaccttacgtaaccgttcctaaccgaacctacgtaccgacgacctaacccggtgaacccgtaggtaaccgtacggtaaaggtagttcggggtaacggttacttaacggtttttaacgtttacgttacggttacaacggttacgttaggttaacgtttaggaccggtaacgttacccgtcccgtacgtttaccgtaccggttttaccgggggaccggggtaaccgggtcccgggtacggggtacgtacgtacgtacgggtaaccgaacggttaacggtgggtacgccgttaccgctacccgtatttccggttctacttacccg

SEQ ID NO: 244018 - DNA, 791 bp, Homo sapiens
  misc_feature: GYAE6OF02G8G1H.11.11.A11.1.454.CMB.1.raw
  modified_base (175)..(175): a, c, t, g, unknown or other
  misc_feature (175)..(175): n is a, c, g, or t
  modified_base (743)..(743): a, c, t, g, unknown or other
  misc_feature (743)..(743): n is a, c, g, or t
  modified_base (767)..(767): a, c, t, g, unknown or other
  misc_feature (767)..(767): n is a, c, g, or t
tcagcgagagataccacgaccggtgctcgatttagctacgactgcaggggcagcaagatggtgttgcagacccaggtcttcatttctctgttgctctggatctctggtgccgtggtgggaccatcctgatcgacccagtccccagagttatcctgcctgttgtctcgtggcgagnggccacatcgagtgacaagtccgagcgagtacttcgttttatactaggtcgtactaaaccgagtaaacggtacttacgttttagcgttggttatacgtaacgtaaccaaaaaaccgtacggtaaccaacggttaccccttaaccgttaaaacgttacggtccttaaccgaccgttacccgttccggtacggggtacctaaccggttacccggttaaccccggggaccggtaaccccggggtacgtacccgttacggtaacccgtacgtttaccgaacggttcggacgtaccgggtaccggggttacgtaacggggtaaacgtaacggtttaaccgtttaccgtaaccgttccttaacccgtaacccgttaacgtaccggtaaaccgtaccctaaacccggttcgaccggtaacgtaccggttaaggaaaccgttcggtaacggttacggttacgtttaaacgttttacgttaacgtcgggttactaccgtaacgtttagttaacgtacggtaacgtacgttccgtacgtccttacggtcggtacggcggacgtcggtacgtagacgtntacgaggtaccaaggtcgcgtacncgactacgtcgtcgttctcgttcg

SEQ ID NO: 244019 - DNA, 714 bp, Homo sapiens
  misc_feature: GYAE6OF02IV5H6.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtccccagatactcctgcctgtgtctcgtgggcgaggacggccacagtcgagtcgcgaacgtccagcgacgtacttctttatatagtacgtaccaacgagtaaggtacttaagtttacggtctttaggtacacgaacgaaccaaaaaccgacgaaccacgcccctaaccgtaactcgacctactacttaccgtccggtcgggactacgtacccggtacccgggacccgtacccggtaccgtaccccgtacggaaccgtacgtcgacggtcggacggcgggtcgggtacgtagggacctacggtacttacctaacttcctaccacctaactaccgacgtaccaccgcgtaacgcggtacgtaacggtaactaggtcggtagtaccgtttaagtttaacttcgtactacgagtacgtagttactaggttacgacgttcctccgttacgacgttaccgggtcgggtaaccggggacgtcccgggggtagtaacgggtctacgggtaacctaacgggtaaccggtacggttcgtcggtatacccggaacttaaccgtagttcccgttagtcccgtttaccg

SEQ ID NO: 244020 - DNA, 692 bp, Homo sapiens
  misc_feature: GYAE6OF02IBHHT.11.11.A11.1.454.CMB.1.raw
  modified_base (233)..(233): a, c, t, g, unknown or other
  misc_feature (233)..(233): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (495)..(495): a, c, t, g, unknown or other
  misc_feature (495)..(495): n is a, c, g, or t
  modified_base (630)..(630): a, c, t, g, unknown or other
  misc_feature (630)..(630): n is a, c, g, or t
tcagcgagagataccacgaccggtgctcgatttagctacgactgcaggggcagcaagatggtgttgcagacccaggtcttcatttctctgttgctctggatctctggtgcctgtgggacatcctgatcgacccagtcccagatactcctgcctgtgtcctgtgggcgaggacgggtccaaccatcgagtcgaccgtaaagtcccgaaggcgtaacgtaaccttctttttaaanattaaggtcgtaacgaaaacgtaagttaaacggtactttaagttttagtaccgtttaggtactacgaaggaaaccaaaaaaccgaggaaccacggtacccttaaccgtaaatcggctacctacttcccttccggtagacaccgtaccgtaccccgggctaccccggtacgtcccgtagaccgtagttacgcggtcggtacncggtccgggtanacggganacgttacccgtacacgtcctacgtaaccctgaccggtaaacncccgtaacgtgaccgtaggtacgtaacgagtacggtagtaccggtagtttctttaacgtcgtacgactgtactaagtcgtagtcgacttccgtccgacgttcgtaacggtccgggtaacgggacggtcgtaacgngtacgcgttaccggaagttaccgacggttgacggtcacgtcaacgtcgttcttagtacctcg

SEQ ID NO: 244021 - DNA, 548 bp, Homo sapiens
  misc_feature: GYAE6OF02FT1S9.11.11.A11.1.454.CMB.1.raw
tcagcgagagataccacgaccggtgctcgatttagctacgactgcagggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctctaaactgctcatctcctggcatcctacccgggcacccggatccctgaccgattcgagtgcaggcggtctgggacagacttcactctcacatcagcaacgtgacgaggctagaagtatggtgtctagttattactgtcagtcagttatgtagaacgccgtccgtctacgtaccgtttcgggcgggtacgggaccgtcgggtagggacgtagtaccgaaggtaaccggtaacgttgggtacggtccgtacgccgtaaccgtacgttcgttacgttcttacccg

SEQ ID NO: 244022 - DNA, 746 bp, Homo sapiens
  misc_feature: GYAE6OF02FH822.11.11.A11.1.454.CMB.1.raw
  modified_base (208)..(208): a, c, t, g, unknown or other
  misc_feature (208)..(208): n is a, c, g, or t
  modified_base (266)..(266): a, c, t, g, unknown or other
  misc_feature (266)..(266): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtggcgagacgggccacatcgagtgcaagtccagcgagtcttctttanatagtcgtacaacgataacggacttagtttacgcttggtatcaacgtacaaaaaccgnggaactacgtacctaccgtaaactgacctcacttctccgtggctactccgacccggactacccggtacgtcccgtagacccgtacgttacgaggttacggcgtacggtaccgggtcgtacggggaaccgttacggtacccttaccgtactaccgtacctaacccgtactaccgtacgaccctaacgttcgacgtacggtctaacggtaagtaacgtcgggtaacgtacgttaagtttacgtttacgtcgtaccgtagtccttaagttgttaccggtaagtaccgtaccggttcccgtacgtttacccgtaccggttttccggggaaccgggttacggggtaacccggttacgggttaccggggtacgtacgttaacgggtaaccgggttaaccgttaacgggttacccgggttacggttaaccgtacgggtaaccctaccgggtttaccttacccgggtttacttacccggtttaacccg

SEQ ID NO: 244023 - DNA, 764 bp, Homo sapiens
  misc_feature: GYAE6OF02HLLJE.11.11.A11.1.454.CMB.1.raw
  modified_base (304)..(304): a, c, t, g, unknown or other
  misc_feature (304)..(304): n is a, c, g, or t
tcagcgagagataccacgaccggtgctcgatttagctacgactgcaggggcagcaagatggtgttgcagacccaggtcttcatttctctgttgctctggatctctggtgcctggtgggacagtcctggactcgacccagtccccagatatcctcgcctgtcgtctcgtgggcgacggacgggcccaccagtcggagtcgacaacgtccgagacgagtaaccttcttttaatagttacgttagaacaaacgtaagtaacggtacttagtttacgtcgtttagtactacgagaaaccaaaaaccgnggaacacgccgtaactaaactcgtactactactcgtccgtcggtactaccgtacccggtacccgggcccgtaacccggacgttccccgagtaacccgttcgttaacggtaggtcggacgtacggttaccgggtacggtacgggaccgtagtaccctttcgaccttactccgaaccctactacgaccgtaccaacgtcgtaacgacggtacgtacgaacggtgtcggtacgttcgtttaacgtttacgttagacgttacgacgttacttaaggtgttacgtacgtaaccgttccggtacccgtacgttacccggttaacgggtttcggaaccgggggtaacccgtacgggtacgggtagggaaccgtacggtaaccgaacgggtacggtaacggttaaccgggtcgtaaccgacggttaacccgtacttacccggtttaccgtcggtttactttaacccgg

SEQ ID NO: 244024 - DNA, 630 bp, Homo sapiens
  misc_feature: GYAE6OF02G9FRJ.11.11.A11.1.454.CMB.1.raw
  modified_base (280)..(280): a, c, t, g, unknown or other
  misc_feature (280)..(280): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggacgggccaccatcgagtgcaagtccagcgagacttcttttatatagtgtacaacgataaggtacttatttagcttggtatcagacaaaacaggacagtcctacctaactnactacactctccgtggctacgtccgtacccgggccaccccgggtctacccgtcgaccgtagtcgaggtcggcgacggtcggtacggcggacagtaccgtctactcaccactactaccgacgacctacgcgcgacggtctaagaagtcgtacgggtcgtaactttacgtttagttaccgtgtacgtacgcttaagttagttacgtaggccttcctaccgtccgtacgtttaccgggttaccggggaacgggtaccgggaccggttcgggacgtagtcggaaccggaacgttaaccggacgttggccgggtactacggtaccaacgttccgtacgtttaccgtacttacccg

SEQ ID NO: 244025 - DNA, 749 bp, Homo sapiens
  misc_feature: GYAE6OF02G31S9.11.11.A11.1.454.CMB.1.raw
  modified_base (287)..(287): a, c, t, g, unknown or other
  misc_feature (287)..(287): n is a, c, g, or t
  modified_base (536)..(536): a, c, t, g, unknown or other
  misc_feature (536)..(536): n is a, c, g, or t
  modified_base (625)..(625): a, c, t, g, unknown or other
  misc_feature (625)..(625): n is a, c, g, or t
tcagcgagagataccacgaccggtgctcgatttagctacgactgcaggggcagcaagatggtgttgcagacccaggtcttcatttctctgttgctctggatctctggtgcctggtgggacatcctgatgacccagtcccagatactcctgcctgtctctcgtgggcgaggacgggacccaacctagtcgaggttgacgtaacgtccaggaccgagtactttacttttaagtaagtagttcgtaacgaaacgtaagtaaggtaacttagtttaagtcgttaggttacncgaacgtaaaccaaaaaccgtaggaaccacgtaccccttaaccgttaaactcgtacctactaccttccgtaccggtacgggtacctcgtacccggtacccgggtaccgtaccccgggtaaccgtccccgtaacggtaaccgtacgttaccggacgggttcggaccgtacgggtcggggtaccggtcggggaaccgtacgtaacgttccctacgtacctaccgtacctacgtacgtaccgaaccgttacncggtaacgacggtctaaggaagtcggtagacgggtaacttacgttactcggttacgtcaagtcgtaagttcgtaggactacgtccgtcncttcgggttaccggtgggccgggaacggttcggagggtactacgggataccgggtacggtaaccgttaggtggtaccgtacgtacggttaccccatttaaccggtcttaccggttcttacccgg

SEQ ID NO: 244026 - DNA, 691 bp, Homo sapiens
  misc_feature: GYAE6OF02GVFW4.11.11.A11.1.454.CMB.1.raw
  modified_base (159)..(159): a, c, t, g, unknown or other
  misc_feature (159)..(159): n is a, c, g, or t
  modified_base (178)..(178): a, c, t, g, unknown or other
  misc_feature (178)..(178): n is a, c, g, or t
  modified_base (211)..(211): a, c, t, g, unknown or other
  misc_feature (211)..(211): n is a, c, g, or t
  modified_base (552)..(552): a, c, t, g, unknown or other
  misc_feature (552)..(552): n is a, c, g, or t
tcagcgagagataccacgaccggtgctcgatttagctacgactgcagggggcagcaagatggtgttgcagacccaggtcttcatttctctgttgctctggatctctggtgcctgtggggacagtcctgatgacccgtagtcccagatactcctgctgtntctcgtggcgagcggcacngtcgagtgacacgtcagcgacgacttcgtttanagttacgtgtacaacgataacggtactatttagctttaggtattacgagtaaccaaaaaccgaggtaaccgagtccccgtaacctaaacgtcgtactacctacgttaccgtccgtagggcctacgtacccggtaacccgggaccaacccgggtacttcccgtaccgtaccgtacgtttacgacgggttacgccgtaacggtccggggtacgtcgggtacctaacggtccttaccggacctactaccgtacctacgtcgacgtaaccacgtgaacgtacggatacgaagtagtgacgttacgtacgttacgtcgttagtacgtacgtaccgtagttaacgtntaacggtcacccgttacgtaccgttgtaccggtttcgggaccggggtacggtccggacgtacggtacgaccgttaaggacgtaaccgtacggttcggaacgtccgacgaccgtaccgttccgtacttcgtaccgttccg

SEQ ID NO: 244027 - DNA, 922 bp, Homo sapiens
  misc_feature: GYAE6OF02HY1TF.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtggggacatcctgatcgacccacgtccccagactactcctcgccgtgttcgtcctcgtgggacgaggacggccaccagtcgagtgacgaacgtccgagcgagtacttcttttaatatagtcacgaacgaataaggtacttagttagtcgttaggtactcaacgtaacaaaaaccgacgaacgacgtacctacctaaacgtcgtacgtactatccttccgtacgggtacaacgtccgttaacccgggaccgacccgggtacgtcccgtacgaaccgttacgttacggtacggttcggacgtacggtccggggttacgtcgggtaaccgtaacggttaccttaccggtaaccttacccgtaacccgtaacccgtaaactaccgtaaaccggtaacccgtaaacccgttacggacccgtaacgggtaccgttaaaccgggtaaaggttaacgttacggggttacggttaaccgtttaaaggtttttaaaccttttaaccggttagttaccggtaaacggtacccgttaaaacgggtttaacggttaacgggttacggttaaaccgtaccccgggttttaccccgtaccgtttaacccgggtttaacccggtttttcgggggaaacccggggggttaaacccgggggtaaccccgggttaaggggggtttaccgggtaaccgggtaaacgttacccgggaaagggttaaacccggtttaaccgggttacgggttaaccggttaccgggtacccgttaacccggttacccttaaccggttttaccctttaccgggtttacctttaaacccccgg

SEQ ID NO: 244028 - DNA, 914 bp, Homo sapiens
  misc_feature: GYAE6OF02H9A7Y.11.11.A11.1.454.CMB.1.raw
  modified_base (869)..(869): a, c, t, g, unknown or other
  misc_feature (869)..(869): n is a, c, g, or t
  modified_base (879)..(879): a, c, t, g, unknown or other
  misc_feature (879)..(879): n is a, c, g, or t
tcagcgagagataccacgaccggtgctcgatttagctacgactgcaggggcagcaagatggtgttgcagacccaggtcttcatttctctgttgctctggatctctggtgcctggtgggacactccgtgatcgacccacgtcccagatactcctcgcctgtgtctcgtgggcgaggacggacccaccagtcggacgtcgacaacgtcccgaggacggaacgtaccttacttttaatagtagttcgtaacaaacggtaagttaacggtactttaatttagtcgtttaggttactacgaacgaaaaccgtaaaaaaccggacggtaaccaaccggtacccctttaaacccgttaaaaccgttcggtacccttaacctaacgtttcccccgtttaccgggtcggggtaacccgtaccggtaaccccggggtaaccccccggggtaccccgaaacccccggggtcccggtttaccccccggtacgggtaaccccggtttaacgttccccggtaaggggtccgggtaccggtaaccgggtcccgggggttacggtacggggtaaccgtacggttacccttactaacccgttccctactacctacgaccgtaacgaccctaaccggtcgaccgtacggtaacgttaacggaacggttacgttagggttacccggttaacgtttaaggttttaccgttaccggttaccgtacgtaacggttacgtttaacgggttacgtttaaacgggtaccgtaaccggttcccgttaccgtacccgtttaccgggttacccggggttaacggggcccggggtaacgggcccgggttaggacggtacggtacgtaaccgacggtaccggttacggtcgggtttacncccggttacncccgtaaccgtcgttccgttaccgttcttacccgg

SEQ ID NO: 244029 - DNA, 752 bp, Homo sapiens
  misc_feature: GYAE6OF02HN15M.11.11.A11.1.454.CMB.1.raw
  modified_base (213)..(213): a, c, t, g, unknown or other
  misc_feature (213)..(213): n is a, c, g, or t
  modified_base (538)..(538): a, c, t, g, unknown or other
  misc_feature (538)..(538): n is a, c, g, or t
  modified_base (608)..(608): a, c, t, g, unknown or other
  misc_feature (608)..(608): n is a, c, g, or t
tcagcgagagataccacgaccggtgctcgatttagctacgactgcaggggcgagcaagatggtgttgcagacccaggtcttcatttctctgttgctctggatctctgtgcctgtgggacatcctgatcgaccacgtcccagatatcctgcctgtgtctcgtgggcgaggaggccacagtcggagtcgacgaagtccagcgagacttcttttanagtacgtgtcaaacgtataaggtacttattagcgttggtactacagtaaccaaaaaccgtaggaacctagtacccttaccgttaaactcggacctactaacttcccgtccggtacggggacctaacgtcccggtaaccccggggcctaaccgggtaccgttcccgtcgggaaccttaagtttccggagggtacgggtaccgtacggtcgggttaccgtaggggacacgggtttaacttccgaacctttcaacccgaccctattacccggaacgtaccctaaacccgttcggaccggacgggtacgttaacgggaaacgtttacgnggggtttaacggagtttaacggttttacttacgttaccgtacgacgtaccgttaagttcgttacgggtanaaccggttaccttaccggtccgttaacgttaccggtttcgggaacgggggtacgaccggggtaggtacgggacgtactacgggtaacgccgttaaggtcggtcgtacgtacgtacctacgtaacgttccgtagttccttaaccg

SEQ ID NO: 244030 - DNA, 817 bp, Homo sapiens
  misc_feature: GYAE6OF02FURK2.11.11.A11.1.454.CMB.1.raw
  modified_base (170)..(170): a, c, t, g, unknown or other
  misc_feature (170)..(170): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgagngggccacatcgagtcgcaagtccagcgagacttcttttatagtagtgtacaacgtataaggacttaatttagcttgtatcgaacgaacaaaaaccaggaacacgtccctacctaaactcgctacgacttcctccgtcgggctacgtacccgtacccggggaccgtaccccgggtacgttccccgtacgtacccgtatttccgaacggtcggaccgtacggtccgggggtaccgttacggggacgtaaccggtaaccctttaccgaacccgtttccctaacccgtaaccccgtaacgttacccgaaccgtaccccgtaaacccgttcggacccggaacggttaacccgttaaggaaaacggttacggttacgggttacgggttaaccgttaacggtttttaacgtttaaccgttaggttaccgtaacggtaccgttaaggttttaaggtttcgggtaaacggtaaccggtacccgttccccggtacgttttacccgtttaacccgggtttccgggggaaccgggtaccggggttaacccgggtcggggttacggaacgtacgtaccggtaacggtacccggtaagttcggtcgggtaccgtaccgaccgttaacccgtacgtccggtttaccggttactttaccccgg

SEQ ID NO: 244031 - DNA, 738 bp, Homo sapiens
  misc_feature: GYAE6OF02JGRAX.11.11.A11.1.454.CMB.1.raw
  modified_base (172)..(172): a, c, t, g, unknown or other
  misc_feature (172)..(172): n is a, c, g, or t
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatactcctgcctgtgtctcgtgggcgagngggccaccgatcgagtgacaacgtccaggcgagacttctttanatagtgtacaacgataaggacttattacncttggtatcgagaccaaaaacgagacgacgtaccttaccgtaaactgcctactaactccgtaccgnggtcaccgtccggtaacccgggccgaaccccgggtcgtacccctggaaccgtcttacgnggtcggtaccgacggtccgggtacgtacgggtacacggtactttaccgactacctaccgaaccgtacgaccgtaacgtacccgtaaacccgtgaaccgtaccgggtacgttaacggaaacgtacgttacgggtaggtaaccctttaagggttttaccttaaccggttacggtacccgtaaacggttccgtaacgtttaagttaccggtacggtaacccgtaacgttccggtacttacccggttaccgtttacgggggaacggacggggttacccgggtacgtaacgggtactaacgtccggtaaacggtaaccgttaggcggttacgcgtacgtaccaccggttaactttcccgttagtacccgttccg

SEQ ID NO: 244032 - DNA, 817 bp, Homo sapiens
  misc_feature: GYAE6OF02IGU65.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatcgacccacgtcccagatatcctgcctgtgtctcgtgggcgaggacgggccaccatcgagtgacaagtcagcgacgtacttcttttataatagtgtacaaacgtaagtaacggtaacttaagtttacgtcgttagggttaataccgaaaggtaaaccaaaaaaacccgaaggtaaccgacggtaccccttaaccgttaaaaaccttcgtaccttacctaacttacccgttacccggttacgggggtacccttaaaccgttcccggttaccccggggtaaccccgtaccccgggtaacccgttccccgtaaccgggtaacccgttaacgtttaccggtacgggttagggaccggtacgggtacccgggggttacggtaccggggtaaccgaaccggtttaacttaacccggaacctttaccctaactaacccgtaaactcccgaaacggtacccgtaaaccgtcgggacgtaacgggtccgttaaagaaggttagtacggttaggacctttaggttttaacttacgttacgtacgacgtaccgtaagttatggtacgtaacgtcgtccgtacttactaacccgggttcggaaccggggtacgggacccggtaggggtagacgtacggtacaaacgggtaccgtaagtcggtcggacgtcgtactaccgtacttacgtccgtttactaccg

SEQ ID NO: 244033 - DNA, 667 bp, Homo sapiens
  misc_feature: GYAE6OF02GGUMP.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtgggacatcctgatcgacccagtccccagatatcctgcctgcgtctcgtggcgaggacggccacatcgagtgacaagtccaggcgagtacctttactttatatagtcgtaccaaacgtagtaacggtacttaagttttagcgtttaggtactacgaacgaaccaaaaaccgaggaacctacgtaccccttaaccgtaaactcgtacctacactccgtaccggtcggctacgtcccgtaccccgggccgacccggtacgtcccgtacgaccgttactcgacggtcggcgacggtcggtcgtggtacagtactctactccgacaccacgtcgacgctaccgtgacgtaggtacacggagtagtcgtaggtaccttagtttactacgtagtctaggtacttaagttacgttaggtaacgtaccgtccgttacttcccgtaccgttacggttccgggacgggtaaccggtcgggacggtaggtactacggtaacggaacgtaaccggtacgttcggtcgacgttccgaccgtacgttacgtccgttctccgttaccg

SEQ ID NO: 244034 - DNA, 861 bp, Homo sapiens
  misc_feature: GYAE6OF02GWYTV.11.11.A11.1.454.CMB.1.raw
tcagcgagagataccacgaccggtgctcgatttagctacgactgcaggggcagcaagatggtcgttgcagacccaggtcttcatttctctgttgctctggatctctggtgcctgtgggacatcctgatgacccagtcccagatactcctgcctgtgtctcgtggggcgaggacggcccaccgatcggagtgactaacgtccaagcgacgtacctttacttttaatacgtagttcgtaccgaaacgtaagtaaacggtacttaagtttaacggtaccgtttagggtaactaccgaaaggtaaaccaaaaaaacccggaagggaacctacggtaccccttaacccgtaaaaacgttcggtaccttacctaacgttcccggtacccgttacgggggaccctaaccggttacccgggtaacccccgggggtacccgtaaacccccggggtaccggttcccccgttaaacgggtaaccccgttaagtttacccggaagggttcgggacccggtaacgggtcccggggttaacgtaccgggggaacctaaccggttaaacccttccggtaaccttaccgtaccctaaaccgtaccgtaaccgtaaccggtaaccctaaacccgtggtaacccggtaacggtaccgttaaagggtaaacggtacgttagggtacgtacgtttaaacggtttacttaaccggtcgtaacgtaacggacgttaacggttagtacggttaacggacgttcccgttacgtaccttcggttaccggttcgggacgggacggtacggtcgggaagtcgtacgtacgacggtaaacgtcgtggtcgtaccgcgtaccgtaaccttacggttcttacgtcttaccg

SEQ ID NO: 244035 - DNA, 712 bp, Homo sapiens
  misc_feature: GYAE6OF02FJIBK.11.11.A11.1.454.CMB.1.raw
  modified_base (183)..(183): a, c, t, g, unknown or other
  misc_feature (183)..(183): n is a, c, g, or t
  modified_base (209)..(209): a, c, t, g, unknown or other
  misc_feature (209)..(209): n is a, c, g, or t
  modified_base (265)..(265): a, c, t, g, unknown or other
  misc_feature (265)..(265): n is a, c, g, or t
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggcgagacggccacatcgngtgcaagtccagcgagacttctttanagtagtcgtacaacgataacggtacttatttagcttaggtatcaagacaaaaaccnggacacgcctacctaaactcgctaccatcctccgtgggcctactcccgtacccgggccaaccccggtacgttcccctaggaccgtacgttcgaggtcggaccncggtcggttcgagggtacacgtactccnctctaccacctacgtcctacgacctaacgtcgactacgggtacgtacgtaacggtagttcggtaggggtaaacctttaaggtttaacctttacgttacgtaccgttacggtaagttaacgtttacggtagttacgggtaaaccgtcccgttaccggttcccgttaccgttaacgggttttacccgggggacgggtaaccggggtaaccggttccgggtaaggtaccgtaaccgtacggaaccgggttaacggtacgttccgggttacgacggtccggtactaacccggttctacggttttacttcccgtttaaccg

SEQ ID NO: 244036 - DNA, 813 bp, Homo sapiens
  misc_feature: GYAE6OF02I5MXF.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctgtgggacatcctgatgacccagtcccagatatcctgcctgtgtctcgtggcgagaggccaccatcgagtgctaacgtccagcgactcgttctttatatagtactacaaacgaagtaacggtacttatttgtacgtttaggtatcaagtaaccaaaaaaccaggtaaccaacgtcccgttaacccgtaaaacgttcgaccttactaccgttaccgttacccgtagggtacccgtaacggtacccggttaaccccggaccgtaaacccccggggtagtttacccccgagggtaacccgttaacgtttaccggaacgggttacgaaaccggtccgggtaaccgggttcccgttagggggaaccttaacggtaacccgtttacgtaaccgttaccgttacccgtaaacctaacgtaccgtaaacgaccctaaacccgggtttacaaccggtaacggttaccgaaggtaaacggtcgttaaggtaccggttagttaacgtttaacgttaccggtagtacccgtaagtacccgtaggttttaagcgttacgaaacgtccgttacgtccgttacgttccggtaacgggtcgggaccggtaccgggtacggttagaccgtagtaccgaacggggttaacccaagttccgggaaacgttccggacgtaacccggacgttaccgtaccgttaccggttcctttaaaccggg

SEQ ID NO: 244037 - DNA, 783 bp, Homo sapiens
  misc_feature: GYAE6OF02FIJZT.11.11.A11.1.454.CMB.1.raw
  modified_base (259)..(259): a, c, t, g, unknown or other
  misc_feature (259)..(259): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctcgtgggcgaggagggcccaaccatcgagtgcaagtccagcgagtaccttcttttaatagttagtcgtacaaacgataaacggtactatttagcttgtatnagacaaaaaccgaggactagcctaccttaaacgtgctcactccgtaccctgggactacgtccgtaacccggggcctaacccccgggtacgttccccgtacggtaaccccgtacgtttacgtacgggtacggtaccggtaacggtccgggggttaccggttcgggggaaaccaccggttaacttttcccaaccgttccttaaccccaacccgttaaactccgtaacgaacccgtaaacccttaggaaccgtaacgggccgttaaggtaaaacggtacttacgggttaccggggttaaaccgtttaaggttttaaacgtttaccgttagttaccgaacggtaccgttaaggttacgtttacgggtaagtaaacggcccgttaccgtccgttaacgttaccggttcgggaccgggttaaccgggaccgggttcggtagggtactaacggtacgtaacggtaaccgtaacggttacggtacggtccgtacggtaccgaaccgttcgtacgttaccgtttcttaaccgg

SEQ ID NO: 244038 - DNA, 644 bp, Homo sapiens
  misc_feature: GYAE6OF02GRPXG.11.11.A11.1.454.CMB.1.raw
  modified_base (208)..(208): a, c, t, g, unknown or other
  misc_feature (208)..(208): n is a, c, g, or t
  modified_base (257)..(257): a, c, t, g, unknown or other
  misc_feature (257)..(257): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttanatagtgtacaacgataaggactatttagcttgtatcagtcaaaaaccgngacacgcctacctaaactgctcatactccgtggctactcgtacccggcacccggagtcccctgacccgattcgagtcggcaggtcgggtctgggacagtacttcgactctcaccatcacgcaacctgacacggtctggaaagtacgtggtacggtactaagttttacgtaacgttgacctagacctaaagttacgttggaagtaaccgtcttacccgtacttaccgttacggttttccggggaacgggttacgggggtaaccccgtggggttacgggacgttacggtaccggtaacggtaaacccggtaccggtttaaggtccggggtaaccctaggggttcccctaaaccggttaccttaccggttttacgtcctttttaacccgg

SEQ ID NO: 244039 - DNA, 795 bp, Homo sapiens
  misc_feature: GYAE6OF02FTP6O.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtggggacatcctgatgacccagtccccagatatcctgcctgtgtctcgtgggacgaggacggccacagtcgagtcgacaacggtccgagacgacgtactttacttttatagtagtacgtacgaacgtaataaggtaactttagtttagtacgttaggttactaccgtaacgaacctaaaaaaccgacgggaacctacgtaccccgttaaccttaaaaccgtcgtaccttactacgttacccgtcccggttggggacctacggtaccccggttaacccccggggaccgtaacccccgggttacggtacccccgtacggtacccgtacgtttaccgacggtacgggacctaggggtccgggtacggtacgggtaacgtaaccgtacgtcctaccgttacctaccgacctactaccgaaccgaccgtaacgtacggacgacggtcgttaaggaacgttacggtagtaccgggttaacttttacggtttaattccgttaagtacgtattaccgagtttaggtttacgacggttaaccgtccgtccgttccgttacggtttacccggtacgggtaccgggaaccgggtccgggtacggggtacgtacgtacgtaaccggtaggaaccggttgtacggtacgtacgtacgtacccgtaaccgttcgtccgtacgttacccgttaccg

SEQ ID NO: 244040 - DNA, 783 bp, Homo sapiens
  misc_feature: GYAE6OF02G07SB.11.11.A11.1.454.CMB.1.raw
tcagcgagagataccacgaccggtgctcgatttagctacgactgcaggggcagcaagatggtgttgcagacccaggtcttcatttctctgttgctctggatctctggtcgtcctggtgggacatcctgatacgacccacgtaccccagtatactcctcgcctgtctctcggtgggcgaggacggccacagtacgagtacgacacgccgagacgacgtacctttacttttataagtagttacgtaccgaaagtaagtaaacgtactttaagtttacgtacttggtactacgaaacaaaaccaaaaccggaacgacacgtacccttaaccgtaactcgaccttaccaacttccgtaccgtacggtacctaccgtcccgggtacccccggacccggaaccccggtacccgttaccccgtaccggttaaccgttacgtttaccggaacggttccgggaccggttaacggggttccggggtaccgggtacgggaacccgttaaggttacccctttaaccgtccttacctaaccccgtacttaacgacgtaccacccgtaccgtacgaccgacggtacgtagtaagttcggtggtacgttacgtttaacgtttacttcgttcgttaatcgtagttaacgttagtttacggtcgtacctccgttacccgtcgtaccggttacggttccgggaacgggtacggccgggttaggacgacggtacgaccggttaacgacggttcgtacgggttcgaccgcgtacgtccgtttagtcccgttattacccttccg

SEQ ID NO: 244041 - DNA, 764 bp, Homo sapiens
  misc_feature: GYAE6OF02FP4BZ.11.11.A11.1.454.CMB.1.raw
  modified_base (218)..(218): a, c, t, g, unknown or other
  misc_feature (218)..(218): n is a, c, g, or t
tcagcgagagataccacgaccggtgctcgatttagctacgactgcaggggcgagcaagatggtgttgcagacccaggtcttccagtttctctcgttgctctggatctctggtgcctggtgggacatcctgatcgacccagtccccagatatcctgcctgtgtctcgtgggcgagacgggccaccatcgagtgacaagtccagcgagtacttcttttanatagtgtacaacgataaggacttattaagcttaggtatacgaacgaacgaaaaaccgacggaacctaccgtacccttaacccgtaaactcgtacctactacttcccgtaccggtcgggactaaccgtcccggtaccccgggaccgtaacccgggtaccgttaccccgtacggtaacccgttacgttaccgacgggtacggacggtacgggtccggggttcgtacgggtacctaacggttacccttacctaacctacctacccgtacctacgtaccgaccgaccgtaaccgtacgaacggtacggtacgtaaggtaacgttagtacgggtacggttacgttaagtttacgttacgttacgtacgtacggtacgtaggttagttacggtacgtacgtaccgtacccgtacgttaccggttaccgggtttccggggaccgggtaccggggtaccggtacgggtacggtacgtacgtacggtaacggtaccggtacggtacggtacgttaccgtacgtaccgtaacgttacgttcgttaccgttacctcg

SEQ ID NO: 244042 - DNA, 644 bp, Homo sapiens
  misc_feature: GYAE6OF02GH4E5.11.11.A11.1.454.CMB.1.raw
  modified_base (285)..(285): a, c, t, g, unknown or other
  misc_feature (285)..(285): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggcccaccatcgagtgcaagtccagcgagacttcttttatatagtgtacaacgataaggactattagcttggtatcagcaaaaaccaggacagcctactaaactgactacactcnccgtggacatccgtacccgggcaccccggacgtcccctgaccgtattcgacgtggaccaggcgggtctgggacagtacttcgactctcaccactcacgacaaccctgaccgaggtaccgtaggaaacgtacgttgggttacggacgttaagtttttaacttacgttcgtacgaagtaccgtaagttagtttaggtacgaacgtccgtacccgtcttaccgtacgtttccggggacgggtaaccgggccgggttcggaacgggacgtacgtaaccgaacggggtaacctaacggttagggtcccggtaactaccgggtacccgtaaccgttaccggtactttaccggtacctttacccgg

SEQ ID NO: 244043 - DNA, 763 bp, Homo sapiens
  misc_feature: GYAE6OF02FV7N7.11.11.A11.1.454.CMB.1.raw
  modified_base (753)..(753): a, c, t, g, unknown or other
  misc_feature (753)..(753): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatcgacccacgtcccagatatcctgcctgtgtctcgtgggcgaggacgggtcccaaccagtcgagtcgacgaacgtaccgaggcgtaagtacctttacttttaatacgttagttacgtaccaaaccggtaattaaacgggtaacttaagttttaagccgtttaggtattacaacgaaacaaaaaaccgaaggacctaacgtaccccgtaaactaaacgtacgaccttaccgtaacgtttaccgtcccgggtacggtacctaaccgtacccggtaaccccgggtaccccgaacccgggtacccgtccccgtaacgtacccggtacttaacggtaacggtcggtaccgtaacgggttccggggtacgtacggggtaactacgttaaccgtaccgtactacccgtaccgaacctacgtacgacgtaaccctacgtcgtacgaacggtcgaacggtaagtcggtgtacggtattaacggtttacttacggttccgtagtaccgtagtacgttagttagcgtaacgtccgtacgtcctacggttcggttccgggacgggtacggaggcgggtagacgtacgacggtaaccgaacggtcgtgtacggtcgtacgacttaccgtatccgttacncgtttacccg

SEQ ID NO: 244044 - DNA, 681 bp, Homo sapiens
  misc_feature: GYAE6OF02G3PH5.11.11.A11.1.454.CMB.1.raw
  modified_base (423)..(423): a, c, t, g, unknown or other
  misc_feature (423)..(423): n is a, c, g, or t
  modified_base (496)..(496): a, c, t, g, unknown or other
  misc_feature (496)..(496): n is a, c, g, or t
tcagcgagagataccacgaccggtgctcgatttagctacgactgcaggggcagcaagatggtgttgcagacccaggtcttcatttctctgttgctctggatctctggtgcctgtggggacatcctgatgacccagtccccagatatcctgtcctgtgtctcgtgggcgagacgggcccaccatcggagtgacaagtccagcgagtacttcttttatacgttagtgtacgaaacgaagttaaggacttatttagtacttggtatcaagacaaaaaccgaggacacgacctaccctaaactcgactcattccgtccgtcggctacctccgtacccgggccacccggtactcccgtcgaaccgtattcgacggtcggcgaggccgggtgtagggactacgtaccgttcgacttcctaccacctacnccacgaccgtaccgtcgccggtagcgttaaggaacgtagttcggttcggactttaacgttttacttacggttntaccgagtaccgttaagtttagtacggtacgtaacgtcccgttaccggaccttaccggttaccggtttaccggggaacggggtacccgggtaaccggtgggttaacggtaccgtaacgcggtaacggtaaccgtaggtgtaccggtcgtacgacctacccgttacgtacgttgttacccttaccg

SEQ ID NO: 244045 - DNA, 791 bp, Homo sapiens
  misc_feature: GYAE6OF02H3Y5X.11.11.A11.1.454.CMB.1.raw
  modified_base (136)..(136): a, c, t, g, unknown or other
  misc_feature (136)..(136): n is a, c, g, or t
tcagcgagagataccacgaccggtgctcgatttagctacgactgcaggggcagcaagatggtgttgcagacccaggtcttcatttctctgttgctctggatctctggtgcctggtggggacatcctgatcgacccncgtccccagtatactcctcgtcctggttcgtcttcgtcggggcgaggacgggacccaccatcggagtcgacaacgtccaggcgaagtactttacttttaatagttagtgttacaaacgtaagtaaggtacttaattttagtcgtttaggtaatcgaagaaaccaaaaaaccgacggaacacgacccttaccctaaaactcgtacttccgtactccttccgtcgggtacctaacgtccccggtaccccgggaccgaaccccgggtaccggttccccgtacgacccgtactacgtacgggtggaccgtacgggtccgggtcgtacgggaactacgttaccttaccgtacttccgtaccacccgtactaccgtacgaccctaccgtacgaccgtacgtacgtaaggtaacgtagtcgggtacgtagtttaccggtttaattaccgttgtacgtacgtacttagtagtggtacgtacgtcctaccgtcgttaacgtaccggtttcggggacgggtaaccgggtaccgggtacgggtaccgggtacggtaccgtaccgtaacggtaacccgggttaacgggtccgggttacggttcccggttaaggtaccccgttaacccgttccgtttaacccggtttacggtttcccctttaacccgg

SEQ ID NO: 244046 - DNA, 838 bp, Homo sapiens
  misc_feature: GYAE6OF02ISZ0M.11.11.A11.1.454.CMB.1.raw
tcagcgagagataccacgaccggtgctcgatttagctacgactgcaggggcagcaagatggtgttgcagacccaggtcttcagttctctgttgctctggatctctggtgcctgtgggacatcctgatgacccacgtcccagattactcctcgcctgtgtctcgtgggcgaggacggccacagtcgagtcgacgaacgtccagcgagtacttacttttatatagtcgtacgaacgtaactaaggtacttagtttacgtcgttaggttaactacgaacgtaaccaaaaaccgtacggaacctacgtaccccttaaccttaaaccgtcgtaccttacgaccttcccgttcccggttacggggtacctaccgttaccccggttaaccccggggacccgtacccccgggtacgttacccccgtaaccggtaaccggttacttaccgacgggttcggaccggtacgggtaccggggttccggtacgggaaccgtacgtttaccgttaccgtaaccgttcccgtacccgtaacccgttactaccggtaacccgtaacctaacccgtacggacggtaacggtacgtaaggaaacggtacgtttcgggtaacgtacgtttaacgtttttacttaacccggttacgttaccgtaacgtaaggttacgtttacggtaggttaacgaccggttaccctacccggtttccgttaccggtttacccgggttacggggtaacccgggggtccggtaaccggggtcgggtaggaccgtagtaaccgggacgtaaccgtacggtcgggtacgttcggacctaccgaccttgttaccgttacgttacccgttaccg

SEQ ID NO: 244047 - DNA, 772 bp, Homo sapiens
  misc_feature: GYAE6OF02GYVLH.11.11.A11.1.454.CMB.1.raw
tcagcgagagataccacgaccggtgctcgatttagctacgactgcaggggcagcaagatggtgttgcagacccaggtcttcatttctctgttgctctggatctctggtgcctggtgggacatcctgatacgacccacgtccccagatactcctgtcctgtgtctcgtgggcgaggacggccaccagtcgagtcgacgaacgtccgagacgacgtactttacttttaagtagtagtacgtaccaaacggtaagtaacggtactttaagtttacgtcgtttaggtaactacgtaacgaaacctaaaaaaccgaggaacaccgtaccctaaccgtaaacgtcgtacctactacttccctccggtacggactaccgtacccgtaccccgggccgtaaccccggtaccgtccctacgacccgtagttaccgaggtcgacgtacggtccgggtacgtacgggacacgtacctacgtacccttacgtccaactactaccgaaccgacctaaccgtacggaccgtacggacgtaaggaacggtagttcggtacggttacgttaacgttttacgtcgttacgtacgaacgttacgttacgttagtttcggtaccgacgttcccgtaccgttaccttacggttccgggttacgggtaaccgggacgggttacccgtacggggtacgtacgttaaccggtacggtaaccgtaaccgggttaaacgtcggtaccggacgttaccgtaccgtaaccgttacgttccgttaccgttacgttacccg

SEQ ID NO: 244048 - DNA, 753 bp, Homo sapiens
  misc_feature: GYAE6OF02GPX3P.11.11.A11.1.454.CMB.1.raw
tcagcgagagataccacgaccggtgctcgatttagctacgactgcaggggcagcaagatggtgttgcagacccaggtcttcatttctctgttcgctctggatctcgtggtcgtcctggtggggacactcctgatcgaccccacgtccccagactactcctcggtccttgtcgtctcgtcgggcgaggtacgggcccacagtcgtaagtacaacgtccagaccgacgtacctttcttttaagtacttaggtgtacaaaccgtaagtaacggtacttaagtttacgtcgtttaggtaactacgaacgtaaaccaaaaaaccgaggaaccaccgtacccttaaccttaaacgtcgtcctacctacgtcccgttaccgtcgggactaccgtacccggtaccccgggtaccgacccggtccgtacccgtacgaccgtataccgtggcgcgtacggtcggtcgacgggacagtaccgttcacctactccaccatacgacgaccgtacgtgacgtagtcgtaagagtacgtcggtagtacgttaacgtttaacgtacgttgtacgtacgtacggttagttagttacggtaacggtcctccgttcccgttagtaccgttaccgggttcggggaaccgggtcccgggttacgggcggttaaccgggtatacccgggtacgtacgggtaaccgttacggtacgggtccggtaccgtacgacccgtaccttaaccggttcgttaccgttccgtactttacccgg

SEQ ID NO: 244049 - DNA, 835 bp, Homo sapiens
  misc_feature: GYAE6OF02FZZS6.11.11.A11.1.454.CMB.1.raw
  modified_base (310)..(310): a, c, t, g, unknown or other
  misc_feature (310)..(310): n is a, c, g, or t
  modified_base (512)..(512): a, c, t, g, unknown or other
  misc_feature (512)..(512): n is a, c, g, or t
tcagcgagagataccacgaccggtgctcgatttagctacgactgcaggggcagcaagatggtgttgcagacccaggtcttcatttctctgttgctctggatctctggtgcctggtgggacagtcctgactcgacccgtagtcccagtactactcctcgtcctgttgtctcgtgggcgaggacggcctacagtcgagtcgcaagtccagcgtaaggtcctttagtttatagtacgttcgtaacaaacgtacgtaaacggttactttaagtttacgtcgttaggtactacgtaacgaaaccgtaaaaaccgnggtaacctaccgtacccgtaaccctaaacgtcggtaccttaagacgttcccgttccggtacggggtacctaccggttaccccgtacccgggacccgtaacccggtcgtacccgtacgtaccgtacttcggagtcggacgcggtaccggtcggtacggtacgtaacttccgtacgttaccacgtaccctacgactcgtaaccncgtaaccgtcgacggtacggtacgtaggtacgtaggttacgacggttacttagttaccgttaacgtacggtctaaggtaaacctttgtaggtttaccggtaacggttccggtaccgttcccgttaccgttaaacggggttcccggttacggggggaaccggttaccccgggggtacgggttaacgggggtacggtacgtaaaccgggtaacggtaaacggggttaaccgttaggggttacccgggttacggtaaccggttacccggtacccggtaccggttttaacggttcccggttttaccgggttaaccttttcccccggg

SEQ ID NO: 244050 - DNA, 303 bp, Homo sapiens
  misc_feature: GYAE6OF01DAI74.3.82.H05.1.454.CMB.1.raw
  modified_base (121)..(121): a, c, t, g, unknown or other
  misc_feature (121)..(121): n is a, c, g, or t
  modified_base (160)..(160): a, c, t, g, unknown or other
  misc_feature (160)..(160): n is a, c, g, or t
  modified_base (166)..(166): a, c, t, g, unknown or other
  misc_feature (166)..(166): n is a, c, g, or t
  modified_base (169)..(169): a, c, t, g, unknown or other
  misc_feature (169)..(169): n is a, c, g, or t
  modified_base (174)..(174): a, c, t, g, unknown or other
  misc_feature (174)..(174): n is a, c, g, or t
  modified_base (176)..(176): a, c, t, g, unknown or other
  misc_feature (176)..(176): n is a, c, g, or t
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (214)..(214): a, c, t, g, unknown or other
  misc_feature (214)..(214): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
tcagagacgcactccacgaccggtgctcgatttagtcgagctctctcgcgggctggcaaggcgcatagcgggctggcaaggcgcatagcggctggcaaggcgcatagcggctggcaaggcncatagcggctggcaaggcgcaatagcggctggcaaggcnatgcgntgnagcgnanagngcngngagngnagagngngngngagcgnagngngngngcgagngnanagngcgngngagngnagngcgngngngagngnagngagngngngagcganagagngngngcgagcgcgngagngngn

SEQ ID NO: 244051 - DNA, 207 bp, Homo sapiens
  misc_feature: GYAE6OF01EU01E.3.82.H05.1.454.CMB.1.raw
  modified_base (204)..(207): a, c, t, g, unknown or other
  misc_feature (204)..(207): n is a, c, g, or t
tcagagacgcactccacgaccggtgctcgatttagtcgagctctctcgcgggcacgaccggtgctcgatttagtatcactcacgcgggatgcataccgacacgggattccttgccaacaccggaggaccgttgatgatgactcgtgtttcaaagagacggctcgtcccgctggcgctgctgagcgggctggcaaggcgcatagnnnn

SEQ ID NO: 244052 - DNA, 109 bp, Homo sapiens
  misc_feature: GYAE6OF01ACF2Z.3.82.H05.1.454.CMB.1.raw
  modified_base (107)..(109): a, c, t, g, unknown or other
  misc_feature (107)..(109): n is a, c, g, or t
tcagagacgcactccacgaccggtgctcgatttagtcgagctctctcgcgggcacgaccggtgctcgatttagtcgagctctctcgcgggctggcaaggcgcatagnnn

SEQ ID NO: 244053 - DNA, 106 bp, Homo sapiens
  misc_feature: GYAE6OF02I69YG.3.82.H05.1.454.CMB.1.raw
  modified_base (106)..(106): a, c, t, g, unknown or other
  misc_feature (106)..(106): n is a, c, g, or t
tcagagacgcactccacgaccggtgctcgatttagtcgagctctctcgcgggcacgaccggtgctcgatttagtcgagctctctgcgggctggcaaggcgcatagn

SEQ ID NO: 244054 - DNA, 171 bp, Homo sapiens
  misc_feature: GYAE6OF02G83ER.3.82.H05.1.454.CMB.1.raw
  modified_base (171)..(171): a, c, t, g, unknown or other
  misc_feature (171)..(171): n is a, c, g, or t
tcagagacgcactccacgaccggtgctcgatttagtcgagctctctcgcggggaccggtgctcgatttagtcgagctctcccgcgagagagctcgacccgcgagagagctcgctgcctggtcaaggactacttccgagtgcgtctctgagcgggctggcaaggcgcatagn

SEQ ID NO: 244055 - DNA, 108 bp, Homo sapiens
  misc_feature: GYAE6OF02HWXSC.3.82.H05.1.454.CMB.1.raw
  modified_base (107)..(108): a, c, t, g, unknown or other
  misc_feature (107)..(108): n is a, c, g, or t
tcagagacgcactccacgaccggtgctcgatttagtcgagctctctcgcgggcacgaccggtgctcgatttagtcgagctctctagcgggctggcaaggcgcatagnn

SEQ ID NO: 244056 - DNA, 197 bp, Homo sapiens
  misc_feature: GYAE6OF02GEBSG.3.82.H05.1.454.CMB.1.raw
tcagagacgcactccacgaccggtgctcgatttagtcgagctctctcgcgggcacgaccggtgctcgatttagcactcgcacgttgggtttgggctgaccaaggtcaccgtcctaggtcagcccaaggccaaccccactgtcactctgttcccaccctcctcgagtgcgtctctgagcgggctggcaaggcgcatag

SEQ ID NO: 244057 - DNA, 213 bp, Homo sapiens
  misc_feature: GYAE6OF02GPH17.3.82.H05.1.454.CMB.1.raw
  modified_base (204)..(213): a, c, t, g, unknown or other
  misc_feature (204)..(213): n is a, c, g, or t
tcagagacgcactccacgaccggtgctcgatttagtcgagctctctcgcgggcacgaccggtgctcgatttagtatcactcacgcgggatgcataccgacacgggattccttgccaacaccggaggaccgttgatgatgactcgtgtttcaaagagacggctcgtcccgctggcgctgctgagcgggctggcaaggcgcatagnnnnnnnnnn

SEQ ID NO: 244058 - DNA, 502 bp, Homo sapiens
  misc_feature: GYAE6OF01DLH1Q.11.71.G05.1.454.CMB.1.raw
  modified_base (203)..(203): a, c, t, g, unknown or other
  misc_feature (203)..(203): n is a, c, g, or t
  modified_base (386)..(386): a, c, t, g, unknown or other
  misc_feature (386)..(386): n is a, c, g, or t
  modified_base (489)..(489): a, c, t, g, unknown or other
  misc_feature (489)..(489): n is a, c, g, or t
  modified_base (498)..(499): a, c, t, g, unknown or other
  misc_feature (498)..(499): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactcccaggctcctcatctatgatgcatccaacagggccactggccaccccagccaggttcagtggcagtgggtctgggacagcttcactctcaccatcagcagcctagngcctgaggtattttgctagtttattactgtcagcagcgtatcgactggatcaccttcggaccgaagggacacgactaggaaattaacgactgtggctgcactntctgtcttnntcc

SEQ ID NO: 244059 - DNA, 508 bp, Homo sapiens
  misc_feature: GYAE6OF01CMI5Q.11.71.G05.1.454.CMB.1.raw
  modified_base (199)..(199): a, c, t, g, unknown or other
  misc_feature (199)..(199): n is a, c, g, or t
  modified_base (501)..(501): a, c, t, g, unknown or other
  misc_feature (501)..(501): n is a, c, g, or t
tcagcgagagataccacgaccggtgctcgatttagtgtcgtcgcaagagagagggggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactcccaggctcctcatctatgatgcatccaacagggccactggcacccccagccaggttcagtggcagtgggtctgggacagacttcactctcacatcagcagcctagacgcctgaggtattttgctagttttattactgtcagcagctatcgactggatcaccttcggaccaagggaccacgactaggaaacttaaacgaactgtaggctgacaccatctgtcttcntctcccg

SEQ ID NO: 244060 - DNA, 521 bp, Homo sapiens
  misc_feature: GYAE6OF01AIU4I.11.71.G05.1.454.CMB.1.raw
  modified_base (259)..(259): a, c, t, g, unknown or other
  misc_feature (259)..(259): n is a, c, g, or t
  modified_base (399)..(399): a, c, t, g, unknown or other
  misc_feature (399)..(399): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggaggcgtggtccagccgtggggaggtccctgagactctcctgtacngcctctggcttcaccttcattacctatggcatgcactgggtccgccagactccaggcagggggctgggagtgggtggcagttattcatatgatggaaatgtgacttctattcagtactccgtgagggccgattcacgtcncagagacaattccaggcacacgctgtatctgcaatgaacagcctgagagctgagacacggcgtgtagtattactggtgacgtaaagtactttacgtataggtaggtgtacggttacgggggg

SEQ ID NO: 244061 - DNA, 640 bp, Homo sapiens
  misc_feature: GYAE6OF01DGXS8.11.71.G05.1.454.CMB.1.raw
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
tcagcgagagataccacgaccggtgctcgatttagtgtcgtcgcaagagagagggggggagaggagcccagcactagaagtcggcggttgtttccattcggtgatcagcactgaacacagaggactcaccatggagtttgggctgagcgtgttcgcgtaggctcttaagagtgtcagtntnagtgcaatggagngtcgtggggagcgtgtccagcctgggcgtcctganctctcctgtacncgcctcgtcgtccttcctaccttctacttaccgtagtcgactagtcggtcgtaccggtccgggtacccgaccgacggtaccgtccggagggtcgggacggggtcgtaggtagggtgggtagtcgttagtttattacgattagtacgtaagtaaggtaactgtacgtacttctattacgacgtcgtacggtacggaccggtacctacgttcgtacccgtacacgaagtactaactacgtacgacgacctacgtactacgtagtactacgtacgaacaagtaacgaactacgtcgaagcgtacgacgaggaccggacgtcggttgttagttagtacgttacggtaggtagtaaacgttagttacgttaagtacggtaggtacggtcgggtacgggttacgg

SEQ ID NO: 244062 - DNA, 499 bp, Homo sapiens
  misc_feature: GYAE6OF01C8G5B.11.71.G05.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (492)..(492): a, c, t, g, unknown or other
  misc_feature (492)..(492): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgctccaggggaaanagccaccctctcctgcagggccagtcagagtgttaacagctacttagcctggtaccaanagaaacctggccagactcccaggctcctcatctatgatgcatccaacagggccactggcaccccagccaggttcagtggcagtgggtctgggacagacttcactctcaccatcagcagcctagagcctgaggtattttgactagtttattactgtcagcagcgtatcgactggactcaccttcggccaaggcacgactaggaaattaacgactgtagctgcacatctgtcttcntctcccg

SEQ ID NO: 244063 - DNA, 533 bp, Homo sapiens
  misc_feature: GYAE6OF01ELLXY.11.71.G05.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaangccaccctctcctgcagggccagtcagagtgttaacngctacttagcctggtaccaacagaaacctggccagactcccaggctcctcatctatgatgcatccaacgagggccactggccaccccgagccaggttcaggtcggcaggtgggtctgggacaggcttcactctcaccatcagcagcctagcgctgagtatttgctagtttatactgtcagcagtcgtatcgactggacttccgtaccttcgggaccaacgggaccaacgacgttaggaaaacttaaacggaacgtagtcggctacgccacgtatcctagttcttcgcttccccg

SEQ ID NO: 244064 - DNA, 543 bp, Homo sapiens
  misc_feature: GYAE6OF01EQAZJ.11.71.G05.1.454.CMB.1.raw
  modified_base (302)..(302): a, c, t, g, unknown or other
  misc_feature (302)..(302): n is a, c, g, or t
  modified_base (503)..(503): a, c, t, g, unknown or other
  misc_feature (503)..(503): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggcttcaccttcattacctatggcatgcactggggtccnccaggactccgaggcgagggggctggagtgggtggcagttatttcatatgatggaaatgtgacttctattcagtactccgtgaacgggcctattcgaccgttctccaagacgacaattcccaggcacgacgctgtactctgacaaatgaacagtcctagacgagctggaacggacgaccgggtcttggttagtatttacgnggttacgacgtaaagtatttaccagttaggaggttacggg

SEQ ID NO: 244065 - DNA, 620 bp, Homo sapiens
  misc_feature: GYAE6OF01D1FG7.11.71.G05.1.454.CMB.1.raw
  modified_base (201)..(201): a, c, t, g, unknown or other
  misc_feature (201)..(201): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaaanagcccaccctctcctgcagggccagtcagagtgttaacagctacttagcctggtaaccaacagaaacctggccagacctcccaggcctcctcatctatgatcgcatccaacgacgggccacgtcggaccaccccagccctaggttcaggtcggctaggtgggtctggggacagtacttcactctacaccatcagcacgaccgtagacgcgtggtacgttagtttcgtacttagtttattacttgtcgacgtacgtacgtcgtacgtacgtacgtacggtacgtccgtaccgttccggaccgtaacgggacgacggtttttaacgaacggtaaaacgttaaacggtaacgttacggtaggacgtcggacctaaccgtacgttaccgttacgttacctttacctacgttcccgttaccccg

SEQ ID NO: 244066 - DNA, 509 bp, Homo sapiens
  misc_feature: GYAE6OF01AWDU0.11.71.G05.1.454.CMB.1.raw
  modified_base (478)..(478): a, c, t, g, unknown or other
  misc_feature (478)..(478): n is a, c, g, or t
  modified_base (491)..(491): a, c, t, g, unknown or other
  misc_feature (491)..(491): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctgggagtgggtggcagttatttcatatgatggaaatagtgacttctattcagactccgtgagggccgattcaccgtctccagagacaattccaggcacacgctgtatctgcaaatcgaacagcctgagagctgaggacaggctgtagtattacgngtgacgtaaagtntttactatagtggtacgg

SEQ ID NO: 244067 - DNA, 519 bp, Homo sapiens
  misc_feature: GYAE6OF01AC48T.11.71.G05.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (306)..(306): a, c, t, g, unknown or other
  misc_feature (306)..(306): n is a, c, g, or t
  modified_base (372)..(372): a, c, t, g, unknown or other
  misc_feature (372)..(372): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaangccaccctctcctgcagggccagtcagagtgttaacngctacttagcctggtaccaanagaaacctggccagactcccaggctcctcatctatgatgcatccaacgngggccactcggccaccccagccaggttcagtggcaggtgggtctgggacagacttcactctcaccntcagcagcctagagcctgagtatttgcttagtttattactgtcagcagcgtatcgactggactcgtaccgttcggaccgaagggacacgacgtaggaaacttaacgacgtgtaggctgaccacacttctctacttcattccgtcccg

SEQ ID NO: 244068 - DNA, 537 bp, Homo sapiens
  misc_feature: GYAE6OF01AETES.11.71.G05.1.454.CMB.1.raw
  modified_base (257)..(257): a, c, t, g, unknown or other
  misc_feature (257)..(257): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggagcgtggtccagcctggggaggtccctgagactctcctgtacngcctctggcttcaccttcattacctatggcatgcactgggtccgccagactccaggcagggggctgggagtgggtggcagttattcatatgatggaaatagtgactttctattcagtactccgtggaagggccgattcaccgtctccagagacaattccaggcacgcgctgtatctgacaatgaacagcctagagagctaggacggacgacggctgtgtacttacgtggtgacggtaaagtcgtttactagttaaggtagggttgacggttaccgggggg

SEQ ID NO: 244069 - DNA, 569 bp, Homo sapiens
  misc_feature: GYAE6OF01ED45Y.11.71.G05.1.454.CMB.1.raw
  modified_base (204)..(204): a, c, t, g, unknown or other
  misc_feature (204)..(204): n is a, c, g, or t
  modified_base (543)..(543): a, c, t, g, unknown or other
  misc_feature (543)..(543): n is a, c, g, or t
  modified_base (556)..(556): a, c, t, g, unknown or other
  misc_feature (556)..(556): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaanacgccaccctctcctgcagggccagtcagagtgttaacagctacttagcctaggtaccaacagaaacctggaccagacctcccaggcctcctcatctatgatgcactccaacgacgggccacgtcggacccaccccgagcccgtaggttccaggtcggcgtagggttcgggtcgtaggggacacggtacttacactcctcaacctatcagcacgcctagacgtccgtgtaggtatttcgacttagtttattactgtcagcgagtcgtatcgagtcgactcgtaccgttcggaccgaacgggcaacgtacgtagtaaacgttaacgtacgtagtacgtcngaccacgtctctntcttcgcttcccg

SEQ ID NO: 244070 - DNA, 505 bp, Homo sapiens
  misc_feature: GYAE6OF01ARV6K.11.71.G05.1.454.CMB.1.raw
  modified_base (301)..(301): a, c, t, g, unknown or other
  misc_feature (301)..(301): n is a, c, g, or t
  modified_base (396)..(396): a, c, t, g, unknown or other
  misc_feature (396)..(396): n is a, c, g, or t
tcagcgagagataccacgaccggtgctcgatttagtgtcgtcgcaagagagagggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggaggtccctgagactctcctgtacagcctctggcttcaccttcattacctatggcatgcactgggtccnccagactccaggcagggggctggagtgggtgcagttattcatatgatggaaatgtgacttctattcagactccgtgaagggccgattcaccgtcnccagagacaattccaggcacacgctgtatctgcaaatgaacagcctgaagagctgaggacacggctgtgtattactgtagacgtaaagtatttacataggtaggtacgg

SEQ ID NO: 244071 - DNA, 736 bp, Homo sapiens
  misc_feature: GYAE6OF01DR6M5.11.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccacctgtctttgtctccgaggggaaancgccaccctctcctgcagggccagtcagagtgttaacngctacttagcctggtaaccaacagaaacctggaccagacctcccaggcctcctcatctatgatgactactacccaacgacgggcccaacgtcggacccaacccccgagccgtagggttcaggtcggacgtagggtcggggtctaggggaaccaggtacttccgactcctacacctatcgacgcgacgtaccgtaggacgtccgtaggtaacgttacgttttcgaccgtttaagttttacttaacgttcggttacacggtacgtaaggttaccgttaacgttccggtaacggttacgggtaacctttaccccgttaacccggtttacccgggaaacccggtaaaccgggggtaaccctaaccgggtaaaccggttaaaacgggttaaaaaccgtttaaaaaccgggtacgttacggggttacggtacccttacggtaacccctaaccgttacgttacccggttagttacccttttaccgtaccggtttaccccccg

SEQ ID NO: 244072 - DNA, 621 bp, Homo sapiens
  misc_feature: GYAE6OF01DP584.11.71.G05.1.454.CMB.1.raw
  modified_base (261)..(261): a, c, t, g, unknown or other
  misc_feature (261)..(261): n is a, c, g, or t
  modified_base (345)..(345): a, c, t, g, unknown or other
  misc_feature (345)..(345): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggagtccctgagactctcctgtacngcctctggccttcacctttcattacctatcggcatcgcacgtgggtcccgccagacctccgaggcgagggggctgggagtgggngctagtttattcatagtgataggaaatgtgtactttctatcagtactcggtagaacgggtcctattccgaccgttctacccgaagacgaactaattcccgaaggtccaaccgacgtccttagtaactccgtagactaaacgtacgaaaccgtagtacccgtaggaacgtacgacgtagggaacggtaccgacgggtcgttggttagttaacgtttacgtggttacgaacggtaaaacggttactttaacggtaagttagggtagggttaaccgggg

SEQ ID NO: 244073 - DNA, 526 bp, Homo sapiens
  misc_feature: GYAE6OF01C9SGL.11.71.G05.1.454.CMB.1.raw
  modified_base (264)..(264): a, c, t, g, unknown or other
  misc_feature (264)..(264): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactgggaggagtcgtggggggagcgtggtccagcctggggaggtccctgagactctcctgtacagcctntggcttcaccttcattacctatggcatgcactgggtccgccagactccaggcaggggctggagtgggtgcagttattcatatgataggaaatgtgacttctattcagtactcgtgaacggtccattccaccgtctaccagagacaattccaggcacacgctgtatctagacaatgaacacgacctagagagctagacgacacggctgtgtattactgtcgacgtaaagtactttacgtaacgtagaggtgtacgtacggggg

SEQ ID NO: 244074 - DNA, 610 bp, Homo sapiens
  misc_feature: GYAE6OF01BMBIS.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggagcgtggtccagccgtgggagtccctgagactctcctgtacagcctctggcttcaccttcacttacctatcggctagtcgctacgtggggtcccacagacctccgaggcgagggggctgggagtgggtcgctagttattcatagtgagtaggaaatgtagtactttctattcgagtaccgtcggtaggaacgggtccgtattaccgtaccgtctaccgagtaacgaactaacttaccgaggaccaacgacgtactacgtactcgtacgaactaaagtcgaaacctacgtaccgtagacgacgcgtaggaacggtaccgacggtcgtggttagttaacgttcgtaggtaggaacgtaaacgttactttacgtaagtagggtaggttaaccggg

SEQ ID NO: 244075 - DNA, 601 bp, Homo sapiens
  misc_feature: GYAE6OF01CEK5E.11.71.G05.1.454.CMB.1.raw
tcagcgagagataccacgaccggtgctcgatttagtgtcgtcgcaagagagaggggagaggctgaggaggaggctccaggaggctattccaaggcaggggttccggggccctggggctgaagggcgccgaccctatgcagtgtctggcccctctgctgcacagaagaaaaggccttggagggcagagggcaggctatgaccagggccctgggcaagtcaggcccactcactaggggaggccatgctggagcggcagggtcagggcttcgagggggctcgggggacccaccgagaacgccatctgagaacagtgtccactgtacaagccaaggcacccaataaaacggctaggagtcggggaccaaagtgggacagtgacgccgtccgtggaggtcggacaccggagtcgggaccaggacgcgtaggacgggacccaaaggctaaggaacgacgacgtaggacttggtacgcgttaggacctcccggacgacggccacgtacgagccgacgttcgacccgtggacctcgaccccgacgccccccgtccgtcccgtacggcctcggcgacgggggtcacccgttggactagggaacgggaccc

SEQ ID NO: 244076 - DNA, 523 bp, Homo sapiens
  misc_feature: GYAE6OF01D4BQJ.11.71.G05.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (427)..(427): a, c, t, g, unknown or other
  misc_feature (427)..(427): n is a, c, g, or t
  modified_base (512)..(512): a, c, t, g, unknown or other
  misc_feature (512)..(512): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaaanagcccaccctctcctgcagggccagtcagagtgttaacagctacttagcctggtaccaanagaaacctggccagactcccaggctcctcatctatgatgcatccaacagggccactggccaccccagccaggttcagtggcagtgggtctgggacagacttcactctcaccatcagcagcctagacgcctggagtatttgctagtttatactgtcagcagtcgtancgtactggactcgtaccgttcggaccaagggaccaacgactaggtaaaacttaaacgacgtgtggctgccacatctgttcttacntccgttccccg

SEQ ID NO: 244077 - DNA, 516 bp, Homo sapiens
  misc_feature: GYAE6OF01CBD9F.11.71.G05.1.454.CMB.1.raw
  modified_base (303)..(303): a, c, t, g, unknown or other
  misc_feature (303)..(303): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccnccagactccaggcagggggctgggagtgggtgcagttattcatatgatggaaatgtgacttctattcagactcggtgaaggccgattcaccgtctcagacgacatccagcacacgctgtatctgacaatgaacacgcctagacgagcgtggaggaccgacggtcgtggtagtattcgtgtagacgtaaagtactttagtagtagagggtacgg

SEQ ID NO: 244078 - DNA, 556 bp, Homo sapiens
  misc_feature: GYAE6OF01EGVZJ.11.71.G05.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagcgagagataccacgaccggtgctcgatttagtgtcgtcgcaagagagagggggtaggaactgctcagttaggacccagagggaaccatggaagccccagctcagcttctcttcctcctgctactctggctcccagatagcaccggagaaattgtgttgacacagtctccagcccaccctgtctttgtctccaggggaaangccaccctctcctgcagggccagtcagagtgttaacngctacttagcctggtaccaacagaaacctggccagacctcccaggctcctcatctatgatgcatccaacgacgggcccactcggccaccccagccaggttcaggtggcgaggtgggtctgggacagtacttcactctcacatcagcagcctagcgcctggagtatttgctagttttattactgtcagcagtcgtagtcgactaggacttcctaccgttcggaccgaagggacctaacggacgttaaggtaaaacttaaacggaacgttggtacggcgttacgacgaccctattccttagttcttccacgttcccg

SEQ ID NO: 244079 - DNA, 626 bp, Homo sapiens
  misc_feature: GYAE6OF01DXA1J.11.71.G05.1.454.CMB.1.raw
  modified_base (203)..(203): a, c, t, g, unknown or other
  misc_feature (203)..(203): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaatttgtgttgacacagtctccagccaccctgtctttgtctccgaggggaaagngcccaccctctcctgcagggccagtcagagtgttaacagctacttagcctggtaaccaacagaaacctggaccagactcccaggctcctcatctatgatgcactaccaacgacgggccactcggaccaccccgagcccgtaagggttccaggtcggctagggttcgggtcgtggggactagtactttcacttcctaccacctatcgtacgctacgtccctaggacgtccgtaggtaggttattttgacttagttttacttactgtcgagtcagtcgtagtcgataggactccgtaccgttcggaccgaacgggacaaccggtacgtaacggtaaaacttaaacggtaacgtcgggttaggacgttacgacctaacccgtacgttccgttacggttacctttactaccgttcccttacccccgg

SEQ ID NO: 244080 - DNA, 542 bp, Homo sapiens
  misc_feature: GYAE6OF01BKCAZ.11.71.G05.1.454.CMB.1.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaanagaaacctggccagactccaggctcctcatctatgatgcatccaacgagggccacgtcggccaccccagcctaggttcagtggcagtgggtctgggacagacttcactctcaccatcagcagcctagacgcctgagtatttgctagtttatactgtcagcagtcgtagtcgacgtggactccgtaccgttacggaccgaagggaccaacggtactaacggtaaaacttaaacgaacgtggtaggacgtcgaccacgactctcgtccttactcttccgtccccg

SEQ ID NO: 244081 - DNA, 682 bp, Homo sapiens
  misc_feature: GYAE6OF01CP0V7.11.71.G05.1.454.CMB.1.raw
  modified_base (308)..(308): a, c, t, g, unknown or other
  misc_feature (308)..(308): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtccagccgtgggacggtccctgagactctcctgtacagcctctggcttcaccttcattacctatggcatgcacgtgggtccnccagacctccgaggcgagggggctgggagtggggtggctagtttatttcaatagtgaattaggaaataggtgtaactttctattcgagtaccttccggtaggaacgggtcccgtatttcccgaacccggttctacccgaaggtaacgaaaccgtaattacccgaaggtccaaccgaccgtccgttaggtacttaccgttaggaacctaaaacgttcggaaaaccgtacggacccgttaggaacggtacgtacggtaacgggtaacgggacccgacgggtacgttacggttagtttaactttaacggttcggtaacggtaaccggttaaaaagttacgttttaccgtaaagttaagggtaggggttaaaccgggg

SEQ ID NO: 244082 - DNA, 528 bp, Homo sapiens
  misc_feature: GYAE6OF01CVEJC.11.71.G05.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaanagccaccctctcctgcagggccagtcagagtgtaacngctacttagcctggaaccaacagaaacctggccagactcccagctcctcatctatgatgcatccaaacgngggccactgccaccccagccaggttcagtgcaggtgggtctgggacagacttcactcncacatcagcagcctagacgctgagtatttgcttagtttattactgtcagcagtcgtatcgatggactcaccgttcggaccgaagggaccacgacgtaggtaaattaaacggaacttggtcggactcgaccaacctatcgttagttccttgtacttcccg

SEQ ID NO: 244083 - DNA, 702 bp, Homo sapiens
  misc_feature: GYAE6OF01BSWNC.11.71.G05.1.454.CMB.1.raw
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccacctgtctttgtctcgaggggaaangccacctctcctgcagggccagtcagagtgtaacngctacttagcctggtaaccaacacgaaacctggaccaagacctcccgaggctcctcatctatgatcgcactaccaaacgacgggccacgtcgggacccaacccccgagccccgtaagggttcaacgggttggaccgtagggttcgggggtctagggggaaccaaggtaaccttcaaccttctaccaacctatccgaagtaccacgacccgttaagacgacccgttaggaacggttagttttacggacgtagttacttaacgtttacgtcgtacgaggtacgtacggtacgttaacgtcggtaacgttgggtaaccttacccgtaacccggtttaccgggaacccgtaaacggggtaaccgaaccggttaaaccggttaaacgggtaaaacgtttaaaaccggaacgttacgggtacggacctacgaaccgtacctacgttccgtttacggttacctttcgtaccg

SEQ ID NO: 244084 - DNA, 544 bp, Homo sapiens
  misc_feature: GYAE6OF01A2IUD.11.71.G05.1.454.CMB.1.raw
  modified_base (307)..(307): a, c, t, g, unknown or other
  misc_feature (307)..(307): n is a, c, g, or t
  modified_base (490)..(490): a, c, t, g, unknown or other
  misc_feature (490)..(490): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggagtccctgagactctcctgtacagcctctggcttcaccttcattacctatggcatgccacgtgggtcccnccgagactccgaggcgagggggctgggagtgggtggctagttatttcatatgataggaaatgtgtacttctattcagactcgtagaaggccgtattccaccgtctaccagacacaacttccgagacacacgctgtatctagacaaatagaacctagccgtagagacgcgtaggacgacgacgngtggttatagttacgtgtagaacgtaagtatttacgtagtaaggtggttacggg

SEQ ID NO: 244085 - DNA, 856 bp, Homo sapiens
  misc_feature: GYAE6OF01A1NND.11.71.G05.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
tcagcgagagataccacgaccggtgctcgatttagtgtcgtcgcaagagagagggggaactgctcagttaggacccagagggaaccatggaagccccagctcagcttctcttcctcctgctactctggctcccagatagcaccggagaaattgtgttgacacagtctccagccaccctgtctttgtctccgaggggaaangccaccctctcctgcagggccagtcagagtgttaacngctacttagcctggtaccaanagaaacctggccagactcccaggctcctcatctatgatgcatccaaacgacggggcccaacgtcgggacccaacccccgaggtcccctaagggtttccaagggttcggggacctaaggggtttcgggggttacccgttaggggggaacctaacgggttaacccttttccgaaaccgtttcccgttacccgtaaaccccgtaacgtttacccgaaacggtacccgaaccggtaccccgttaaacgggaaccggtaccccgtttagggtaaacgggtttaactttttttacgggaaccgtttaaacggtttttttaactttaaccgtttacggttacctaacgggtacctaacgggtaccggtttaacgttaccggtaaccgtttacggggtaaccttacccggttaaccccggttttaccggggtaaccccgtaaaacgggggtaaccctaaccgggtaaccggttaaaggggtaaaaaaccgtttaaaaaccgggaaaccgtttacgggttaggggtacccgttacggaccctaaacccgttacgtttccgttacggtttacccttttaccgtaacgtttccccgtttaaccccccgg

SEQ ID NO: 244086 - DNA, 584 bp, Homo sapiens
  misc_feature: GYAE6OF01EZY0S.11.71.G05.1.454.CMB.1.raw
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacagctacttagcctggtaccaanagaaacctggccagacctcccaggctcctcatctatgatgcatccaacacggggccacgtacggccaccccagccaggttcaggtggcagtgggtctgggacngacttcactcncaccatcagcagcctagacgccgtaggaggtattttcgctaagtttattacgtgtacagctagcgtatcgaactgggacttcgaccgtttcggaccgtaagggacctacggtaaccgtaaggtaaaacgttaaaaccgaaccgttagtagggtacgtacggacctaaccgtacgtaccttcggttacctttcctacgttcccgttacccccg

SEQ ID NO: 244087 - DNA, 636 bp, Homo sapiens
  misc_feature: GYAE6OF01A6PQ7.11.71.G05.1.454.CMB.1.raw
  modified_base (307)..(307): a, c, t, g, unknown or other
  misc_feature (307)..(307): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcaactggaggagtcgtgggggagcgtggtccagccgtgggacgtccctgagactctcctgtacagcctctggtccttcaccttcattacctatggcatgcacgtgggccnccagacctccaggcgagggggctgggagtgggtgctagttattcatatgatggaaatgtgacttactattcgaagtacctcgggtagaacgggtccgtaacttccgaccgttcctacccaaggacgtaacctaacgttccgaagggtaccaaccgtacgtcttacggtaactccgttacgaaccgtaaatacgtaaaccgacgtacccgtaggaacgacggtccgtaagggaacgggtaccgaacgggtacgttggttagttaacgtttacggtaggttacggaacgtaaacgttactttaacgtaagttaaggtacgggttaaacggg

SEQ ID NO: 244088 - DNA, 521 bp, Homo sapiens
  misc_feature: GYAE6OF01EYGLC.11.71.G05.1.454.CMB.1.raw
  modified_base (304)..(304): a, c, t, g, unknown or other
  misc_feature (304)..(304): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctggggaggtccctgagactctcctgtacagcctctggcttcaccttcattacctatggcatgcactgggtccnccagactccaggcagggggctgggagtgggtggcagttattcatatgatggaaatagtgacttctattcagtactccgtagaagggccgtattcacgtctccagagacaatccaggcacacgctgtatctgcaaatcgaacagcctgaagagctggacggacacgggtctggtgtattactggtagacgtaaacgtatttactataggtaggtacgg

SEQ ID NO: 244089 - DNA, 558 bp, Homo sapiens
  misc_feature: GYAE6OF01ENNXT.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggcttcaccttcattacctatggcatgcactggggtccgccagactccgaggcgagggggctgggagtgggtggctagttattcatatgatggaaatagtgtacttctattcagtactccgtagaacgggccgtattcaccgtctccagacgacaacttccaggcaccacgctgtatctgcaaatgaacagcctggaagagcgtaggaggaccgacggtctggttagttaacgttccgttggttaggaaccggtaaaagttacttttacgtaaggttaggtaaggggttaacggg

SEQ ID NO: 244090 - DNA, 519 bp, Homo sapiens
  misc_feature: GYAE6OF01A5BPJ.11.71.G05.1.454.CMB.1.raw
  modified_base (201)..(201): a, c, t, g, unknown or other
  misc_feature (201)..(201): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaaangcccaccctctcctgcagggccagtcagagtgttaacagctacttagcctggtaccaacagaaacctggccagactcccaggctcctcatctatgatgcatccaacgagggccacgtcggaccaccccgagccaggttcaggtcggcaggtcgggtctgggacagacttcactctcacatcagcagcctagcgctgagtatttgactagtttattacgtgtacagtcagtcgtatcgactggactccgtaccgttcggaccgaagggacacggataaggaaattaacgagtgtggctgacacntctntcttcntcttc

SEQ ID NO: 244091 - DNA, 683 bp, Homo sapiens
  misc_feature: GYAE6OF01DB1C7.11.71.G05.1.454.CMB.1.raw
  modified_base (209)..(209): a, c, t, g, unknown or other
  misc_feature (209)..(209): n is a, c, g, or t
  modified_base (248)..(248): a, c, t, g, unknown or other
  misc_feature (248)..(248): n is a, c, g, or t
  modified_base (655)..(655): a, c, t, g, unknown or other
  misc_feature (655)..(655): n is a, c, g, or t
  modified_base (673)..(673): a, c, t, g, unknown or other
  misc_feature (673)..(673): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagtaaattgtgttgacacagtctccagcccaccctgttctttgtcctacgaggggaaacncgcccacctctcctgccgaggccagtcagagtagtaacngactattacgcctaggtaaccaacgaacgaaaccgtggacccaagacctacccgaggtcctcctcactctatgatgacactaccaacggacggcccacgtcggacccaaccccgagacccgtaggttaccaggtcggacgtagggtcgggtacgtaggggaacctacggtaccttacgacctttccgtaccaaacctactaccgaagcccgaaggtacccaagggtccgtaccgttaggtaagtttacttttcggaactttagttttactacgtcggttcaaggtccgtaggtaccgtacgttcggaaccgtggtaacctcccgtaaccggtccggaaccgtaacgggaccaaggtaccgtaaaggtaaaacttacggacttagggcgtctacggacctaaccggtnttccggtacttccgttancccgttcccg

SEQ ID NO: 244092 - DNA, 538 bp, Homo sapiens
  misc_feature: GYAE6OF01EO79Y.11.71.G05.1.454.CMB.1.raw
  modified_base (304)..(304): a, c, t, g, unknown or other
  misc_feature (304)..(304): n is a, c, g, or t
  modified_base (530)..(530): a, c, t, g, unknown or other
  misc_feature (530)..(530): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccnccagacctccgaggcgagggggctgggagtgggtgctagttattcatatgatggaaatgtgacttcattcagtactccggtagaacgggccgtattccgaccgtctccaagacgacaacttccgaggcacgacgctgtactcgtgacaaatcgaacagcctagagacgctgaacggacacggctcggtattattacgtgtagacgtaaagtactttatagttaggnggtacggg

SEQ ID NO: 244093 - DNA, 631 bp, Homo sapiens
  misc_feature: GYAE6OF01ACV83.11.71.G05.1.454.CMB.1.raw
  modified_base (310)..(310): a, c, t, g, unknown or other
  misc_feature (310)..(310): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtggggggaggcgtggtccagcctgggaggtccctgagactctcctgtacagcctctggtcttcaccttcattacctatggcatgccacgtgggtcccnccagacctccgaggccgagggggctgggaggtgggtggctagttattcattatgataggaaatgtgtacttctattcagtacgtccgtaggaacggccgtattccgaccgttcctaccgaagacgaactaacttccgaggaccacgacgtctagtactcgtacgaactaaagtcgaaaccacgtacccgtaggaacggacggtacgtacggaacgggtacccgtacgggtcgttacggttagttaactttacggtaggttaccgggtaaacgttaaacggttaactttaccggtaaagttaagggtaaggggttaaccggg

SEQ ID NO: 244094 - DNA, 593 bp, Homo sapiens
  misc_feature: GYAE6OF01A7SP1.11.71.G05.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaanagccacctctcctgcagggccagtcagagtgttaacngctacttagcctaggtaccaacagaaacctggaccagacctcccaggctcctcatctatgatgcatccaacgacgggccacgtcggaccacccccgagcccgtaggttaccaggtcggcgaggtcgggtcgtgggactagtacttcacctctcaacctatccagcacgtcctagacgccgttagaggttactttggacttagtttaacttacgtgtacagtcaggtccgttaagtcgacgtggtacttccgtaaccgttcggaccgtaaggacacgtacgtaacggtaaaattaaccggaacgttggaggtctacggacccacgtattccgttagttccttccgtcttccccg

SEQ ID NO: 244095 - DNA, 582 bp, Homo sapiens
  misc_feature: GYAE6OF01ED8K0.11.71.G05.1.454.CMB.1.raw
  modified_base (266)..(266): a, c, t, g, unknown or other
  misc_feature (266)..(266): n is a, c, g, or t
  modified_base (311)..(311): a, c, t, g, unknown or other
  misc_feature (311)..(311): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtggggggaggcgtggtccagccgtggggagtccctgagactctcctgtacagcctntggccttcacctttcacttacctatggcatcgcacgtcgggtccnccagacctccgaggcgagggggctggaggtgggtgctagtttattcatatgataggaaatgtgtacttctattcagtactccgtaggaacgggccgtattccgaccgtctccaagagacaattccgaggcactacgctgtactctagacctaaagtacgaaccagcccgtagacgtagcgtaggacggaacgcggtctggttacgtacttacgtggtagaacgtaaagttactttacgttaagtaggaaggttcgacgggttaaccggggg

SEQ ID NO: 244096 - DNA, 555 bp, Homo sapiens
  misc_feature: GYAE6OF01AUF83.11.71.G05.1.454.CMB.1.raw
  modified_base (435)..(435): a, c, t, g, unknown or other
  misc_feature (435)..(435): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtgggggaggcgtggtccagcctgggagtccctgagactctctgtacagcctctggcttcaccttcacttacctatggcatgcactgggtcccgccagcctccgaggcgagggggctgggagtgggtgctagttattcatatgataggaaatgtgtacttctattcagtacgtccgtaggaacgggccgtattccgaccgtctaccagagactaacttccgagcacncgctagtactctgacaatcgaacacgaccgtagagacgctaggagaccgaggtctgttagttacttagtaggtcgacgtaaagtactttactagtagtagggtgtacgggttaccggggg

SEQ ID NO: 244097 - DNA, 791 bp, Homo sapiens
  misc_feature: GYAE6OF01BRIXL.11.71.G05.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
  modified_base (296)..(296): a, c, t, g, unknown or other
  misc_feature (296)..(296): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagcccaccctgtctttgtctccgaggggaaangccaccctctcctgcgagggccagtcagagtgttaacngctacttagcctaggtaccaacagaaacctggaccagacctccaggcctcctnatctatgatcgacactccaacgacgggaccctaacgtcggacccaacccccgagtacccgtagggttccaaggtcggctaagggttcggggtccgtaggggaaccaacggtacctttcgacccttcctaccaaccctatccgaacgaccgtacgtacccggttaaggaccgtcccttaggtaacgtttaggttaacgtttttcggaacttttaaggtttttaacttaccgtttacggtacctaaggtacctaaggttaccggttaactttacccgggtaaccgttaggggtaaccctttaccccggttaaacccccggtttcccggggaaacccggtaaaaccgggggtaaccctaaacccgggttaacgttaaaaacggggttaaaaaccgtttaaaaacccgggtaacgtttcgggtaaccgggtacccttaacgggacccccttaaaccgttacgtttacccgttcggtttaccctttccgttaacccccgg

SEQ ID NO: 244098 - DNA, 538 bp, Homo sapiens
  misc_feature: GYAE6OF01BWNC6.11.71.G05.1.454.CMB.1.raw
  modified_base (204)..(204): a, c, t, g, unknown or other
  misc_feature (204)..(204): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagcccaccctgtctttgtctccaggggaaangccaccctctcctgcagggccagtcagagtgttaacagctacttagcctggtaccaacagaaacctggccagactcccaggctcctcatctatgatgcatccaacgagggccactcggccaccccagccaggttcaggtggcaggtgggtctgggacagtactcactctcaccatcagcagcctagagcctgaggtatttgctagtttattactgtcagcagcgtatcgacgtggtactccaccgttcggaccgaacgggaccacgtacgtaggtaaaacttaaacgaacgttaggtcggctacgacctacctacttctagtcttctcttcccg

SEQ ID NO: 244099 - DNA, 507 bp, Homo sapiens
  misc_feature: GYAE6OF01C5OLI.11.71.G05.1.454.CMB.1.raw
  modified_base (362)..(362): a, c, t, g, unknown or other
  misc_feature (362)..(362): n is a, c, g, or t
  modified_base (441)..(441): a, c, t, g, unknown or other
  misc_feature (441)..(441): n is a, c, g, or t
  modified_base (474)..(474): a, c, t, g, unknown or other
  misc_feature (474)..(474): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggaggcgtggtccagcctgggaggtccctgagactctcctgtacagcctctggcttcaccttcattacctatggcatgcactgggtccgccagacctccaggcagggggctgggagtgggtggcagttattcatatgatggaaatgngacttctattcagactcgtgaaggccattcacgtctcagagacattccaggccacacgctgtactctgacaaatgaacngcctgagagctggagacacggctgtgtattcgnggtagacgtaaatatttcaagtggtaggtacgg

SEQ ID NO: 244100 - DNA, 559 bp, Homo sapiens
  misc_feature: GYAE6OF01B0UU5.11.71.G05.1.454.CMB.1.raw
  modified_base (433)..(433): a, c, t, g, unknown or other
  misc_feature (433)..(433): n is a, c, g, or t
  modified_base (477)..(477): a, c, t, g, unknown or other
  misc_feature (477)..(477): n is a, c, g, or t
tcagcgagagataccacgaccggtgctcgatttagtgtcgtcgcaagagagagggggtctgggagaggagcccagcactagaagtcggcggtgtttccattcagtgatcagcactgaacacagaggactcaccatggagtttgggctgagctgggttttcctcgttgctcttttaagaggtgtccagtgtcaggtgcaactggaggagtcgtgggggagcgtggtccagtcgtgggaggtccctgagactctcctgtacagcctctggcttcaccttcattacctatggcatgcacgtgggtccgccagacctccgaggcgagggggctgggagtgggtggctagtttatttcgatagtgataggaaatagtgtactttctattcagtaccttccggtaggaacgggtccgtattccacccgttctaccaganaaccaattccgaggccacaccgctgtactctagactaatgaacngccctgacgacgcgtaggacggacgacgggtcttggtagttattaccgtgtacgacgtaaagtatttacgtagtaggtaggg

SEQ ID NO: 244101 - DNA, 615 bp, Homo sapiens
  misc_feature: GYAE6OF01AOC4E.11.71.G05.1.454.CMB.1.raw
  modified_base (273)..(273): a, c, t, g, unknown or other
  misc_feature (273)..(273): n is a, c, g, or t
  modified_base (320)..(320): a, c, t, g, unknown or other
  misc_feature (320)..(320): n is a, c, g, or t
  modified_base (419)..(419): a, c, t, g, unknown or other
  misc_feature (419)..(419): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggtttttcctcgttgcttcttttaaggaggttgtccagtgtcagggtgacaacgtgggaggagtcggtggggggagcgtggtccaggccgtggggacgtccctggacgacctctcctgtacngcctgtggccttcaccttcattacctatggcatgcacgtggggtccnccagcctccgaggcgacgggggctgggagtggggtgctagtttattcatagtgataggtaaatgtgtacttctattcagtaccgtcgaggacgggcctnttaccaccgtctacgagacgaactacttccgagcaccacgctagtactcgtanaactaagtcgaacncgtaccgtagagacgtcgtacggacggtaaccgcggtacgttggttacgtttaacgttacgtaggtacggaaccgttaaagttactttacgtaagttaaggacgggtaggtaaccggggttaccggggg

SEQ ID NO: 244102 - DNA, 776 bp, Homo sapiens
  misc_feature: GYAE6OF01CNWYR.11.71.G05.1.454.CMB.1.raw
  modified_base (242)..(242): a, c, t, g, unknown or other
  misc_feature (242)..(242): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaacagccaccctctcctgcagggccagtcagagtgttaacngctacttagcctggtaaccaacagaaacctggaccagactcccaggcctcctcatctatgactgctactcccaaacgacgggccaacgtcggcccaacccccgagaccccgtaagggtttccaagggttcggaccagggttcggggtctaggggaactacggtaacctttcaaccgtttcctaccaacccaattaccgaggaccaacggtacccgttaaggacggtacccgttaggtaacgggtttaactttttacggacctttaaggttttttaagttttaaccgttcgttaccgtaacggtacctaacgggttaccgtttaacggtaccgtaacggttacgggtaaccgtttacccgttacccggtttacccggggaacccgtaaacgggggtaacccaaacgggttaacccgttaaacgggtaaaaaaccgtttaaaaccgggtaaacgttagggttaccggtaccttacgggtaccctaaacccggttactaccgtttacggtttacctttaccgtaccgtttacccccg

SEQ ID NO: 244103 - DNA, 617 bp, Homo sapiens
  misc_feature: GYAE6OF01BV5WG.11.71.G05.1.454.CMB.1.raw
  modified_base (176)..(176): a, c, t, g, unknown or other
  misc_feature (176)..(176): n is a, c, g, or t
  modified_base (262)..(262): a, c, t, g, unknown or other
  misc_feature (262)..(262): n is a, c, g, or t
  modified_base (313)..(313): a, c, t, g, unknown or other
  misc_feature (313)..(313): n is a, c, g, or t
  modified_base (388)..(388): a, c, t, g, unknown or other
  misc_feature (388)..(388): n is a, c, g, or t
  modified_base (490)..(490): a, c, t, g, unknown or other
  misc_feature (490)..(490): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgcttcttttaagnggtgtccagtgtcaggtgcaactggaggagtcgtgggggagcgtggtccagccgtgggacggtccctgacgacctcctcctgtacngtcctcgtggcttccaccttcattacctatggcatgcctacgtcgggtccnccagacctccgaggcgaggggctgggaggtgggtgctagtttattcattagtgtagtaggaaatagtctactttntattacgaagtaacgtccggtaggaacgggtcctatccaccgtctaccagacaactactccgaggacctacgacgctagtactcgtagaactaagtcgaacncgccgtagacgacgacgtacggaacgaccgacggtcttacggttagttacgttagtcggtacggtaacgttaaagttcttttaaccgaaggttaagggtacgggttaggtaacccgggttacggggg

SEQ ID NO: 244104 - DNA, 527 bp, Homo sapiens
  misc_feature: GYAE6OF01E5L89.11.71.G05.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
  modified_base (518)..(518): a, c, t, g, unknown or other
  misc_feature (518)..(518): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgctccaggggaaangccaccctctcctgcagggccagtcagagtgttaaacngctacttagcctggtaaccaacagaaacctggccagactcccaggctcctcatctatgatgcatccaaacagggccactggccaccccagccaggttcagtggcagtgggtctgggacagacttcactctcaccatcagcacgcctagacgcctaggaggtattttggcttagtttacttactgtacagtcagtcgtatcgtacgtgactctaccgttcggaccgaaggacacgtacgagtaaactaaacgagtgtgctgactacagttctcgttactctntcttccccg

SEQ ID NO: 244105 - DNA, 547 bp, Homo sapiens
  misc_feature: GYAE6OF01CZKP4.11.71.G05.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (286)..(286): a, c, t, g, unknown or other
  misc_feature (286)..(286): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctccagatagcaccggagaaattgtgttgacacagtctccagccaccctgtctttgtctccaggggaaangccaccctctcctgcagggccagtcagagtgttaacngctacttagcctggtaaccaacagaaacctggccagactccaggctcctnatctatgatgcactccaacgagggccactcggaccaccccagccaggttcagtggcaggtcgggtctgggacagactcactctcactatcagcagctagacgctgagtntttgctagtttntactgtacagtcagtcgtatcgactggactcgtaccgttcggacaagggacaacggactaaggaaaacttaaacgacgttcggtaggctcgacctaaccgacttccgttcgttacctttcctaacgttcccttaccccgg

SEQ ID NO: 244106 - DNA, 561 bp, Homo sapiens
  misc_feature: GYAE6OF01EY1GO.11.71.G05.1.454.CMB.1.raw
  modified_base (307)..(307): a, c, t, g, unknown or other
  misc_feature (307)..(307): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggaggtccctgacgactctcctgtacagcctctggcttcaccttcattacctatggcatgcacgtcgggtccnccgagacctccgaggcgagggggctgggagtgggtgctagttattcatatgataggaaatggtagtactttactattacagtactcgtaggaacgggtccgtattccgaccgtctaccagacgactaacgttccgaggtccacgacgctagttactcgtgaactaaatcgaactagacctagacgagcaggacggacacggcgttgtagtacttcgtgtaggacgtaaagttacttagtagtaggtggtaacgg

SEQ ID NO: 244107 - DNA, 510 bp, Homo sapiens
  misc_feature: GYAE6OF01DTZMK.11.71.G05.1.454.CMB.1.raw
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (478)..(478): a, c, t, g, unknown or other
  misc_feature (478)..(478): n is a, c, g, or t
  modified_base (500)..(500): a, c, t, g, unknown or other
  misc_feature (500)..(500): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgctccaggggaaangccaccctctcctgcagggccagtcagagtgttaacngctacttagcctggtaccaanagaaacctggccagactcccagctcctcatctatgatgcatccaacagggcccatggccacccagccaggttcagtggcaggtgggtctgggacagacttcactctcaccatcagcagcctagagtcctgaggtattttgctagtttacttactgtcagcagctatcgtactggactcaccgttcggaccaagggacacgacgtagaaattaacgacgtgnggctgacacagtctgttctctntcgttccccg

SEQ ID NO: 244108 - DNA, 620 bp, Homo sapiens
  misc_feature: GYAE6OF01B5RWL.11.71.G05.1.454.CMB.1.raw
  modified_base (204)..(204): a, c, t, g, unknown or other
  misc_feature (204)..(204): n is a, c, g, or t
  modified_base (430)..(430): a, c, t, g, unknown or other
  misc_feature (430)..(430): n is a, c, g, or t
tcagcgagagataccacgaccggtgctcgatttagtgtcgtcgcaagagagaggggggaggaactgctcagttaggacccagagggaaccatggaagcccagctcagcttctcttcctcctgctactctggctcccagatagcaccggagaaattgtgttgacacagtctccagcccaccctgtctttgtctccgaggggaaanagcccaccctctcctgcagggccagtcagagtgttaacagctacttagcctggtaccaacagaaacctggccagacctcccgaggcctcctcatctatgatgacatcccaaacgacgggcccacgtcggacccaccccgagccaggttcaggtcggctaggtcgggtctaggggacagtacttcgactctcaccatcagcacgccgtagacgcctaggaacggttnttttgacgttagttttacttacgttgtacagtcgagtcgtatcgacgtcggacttccgtaccgttaccggaccgtaacgggacctaacggtaacgtaacggtaaaacgttaaaccggtaaacgttgggtacggtaccgtacgtaccctaaccgtacgttccgttagttcccgttacgttaccgttccccg

SEQ ID NO: 244109 - DNA, 584 bp, Homo sapiens
  misc_feature: GYAE6OF01BVUY9.11.71.G05.1.454.CMB.1.raw
  modified_base (200)..(200): a, c, t, g, unknown or other
  misc_feature (200)..(200): n is a, c, g, or t
  modified_base (385)..(385): a, c, t, g, unknown or other
  misc_feature (385)..(385): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaangccgccctctcctgcagggccagtcagagtgttaacagctacttagcctaggtaaccaacagaaacctggaccagacctcccaggctcctcatctatgatgcatccaacgacgggccacgtcggccaccccagccaggttcaggtggacaggtgggtctgggacaggtacttcactcctcaaccntacagcacgccgtagacgtccgtaggtacggttattttcgacttagttttacttacgttgtcgtagtccaggtcgttatcgacgttaggacttccgtaccgttcggaccgtaagggaccaacgtaacgtaaggtaaaacgttaacgacgttgtaggctcgaccactacttctcgttaccttctaccgttcccgtacccg

SEQ ID NO: 244110 - DNA, 581 bp, Homo sapiens
  misc_feature: GYAE6OF01C0ZJY.11.71.G05.1.454.CMB.1.raw
  modified_base (311)..(311): a, c, t, g, unknown or other
  misc_feature (311)..(311): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (437)..(437): a, c, t, g, unknown or other
  misc_feature (437)..(437): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagccttgggttttcctcgttgctcttttaagaggtgtccagtgtcaggtgcaacgtggaggagtcgtgggggagcgtggtccagccgtgggagtccctgagactctcctgtacagtcctctcggtcttcaccttcattacctatggcatcgcacgtcggtccnccagcctccgaggcgaggggctgggagtgggtgctagttattcatatgataggaaatgtntacttntattcagtactcgtagacggccattccacgtcacagacgactaattccgagcacgacgtntcgtactcgtagtaacaaagtacgaaccgtacgtaccgttaggacggacgaccgtaggaacggaccgtacggtcgttggttagttattaccgtcggtaagtacggtaaagttactttacgaagttagggtagggttaaccgggg

SEQ ID NO: 244111 - DNA, 516 bp, Homo sapiens
  misc_feature: GYAE6OF01D8HD3.11.71.G05.1.454.CMB.1.raw
  modified_base (158)..(158): a, c, t, g, unknown or other
  misc_feature (158)..(158): n is a, c, g, or t
  modified_base (258)..(258): a, c, t, g, unknown or other
  misc_feature (258)..(258): n is a, c, g, or t
  modified_base (338)..(338): a, c, t, g, unknown or other
  misc_feature (338)..(338): n is a, c, g, or t
  modified_base (362)..(362): a, c, t, g, unknown or other
  misc_feature (362)..(362): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttccncgttgctcttttaagaggtgtccagtgtcaggtgcaactggaggagtctgggggagcgtggtccagcctgggagtccctgagactctcctgtacagcctntggcttcaccttcattacctatggcatgcactgggtccgccagactccgaggcgagggggctgggagtgggtgctagttnttcatatgatggaatagtgacttntatcagactccgtgaaggccgattcacccgtctcagagacaacttccaggcacacgctgtatctgacaatgaacagcctagagagctgacggacacggctagtgttattatgtgacgtaaagtatttctaagtagacggtgacggtaccggggg

SEQ ID NO: 244112 - DNA, 589 bp, Homo sapiens
  misc_feature: GYAE6OF01DZN8F.11.71.G05.1.454.CMB.1.raw
  modified_base (266)..(266): a, c, t, g, unknown or other
  misc_feature (266)..(266): n is a, c, g, or t
  modified_base (311)..(311): a, c, t, g, unknown or other
  misc_feature (311)..(311): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatgggagtttgggctgagcttgggtttttcctcgttgcttcttttaagaggtgtccagtgtcaggtgcaactggaggagtcgtgggggaggcgtggtccagccgtgggacggtccctgagactctcctgtacngcctctggcttcaccttcattacctatggcatgcacgtgggtccncagactccgaggcgagggggctgggagtgggtgctagttattcattatgaatggaaattgtgtactttctatttcagtaccttcggtagaacgggcctattccaccgttctaccgagacgactaacttccgaggacacacgtctagtactctagactaaagtacgaactagacctaggaacgagcgtaggacgggaaccgtacggtcgttaggttacgttactttacgtggtagacggtaaaagttacttttacgtaagttagggtaagggttacggg

SEQ ID NO: 244113 - DNA, 558 bp, Homo sapiens
  misc_feature: GYAE6OF01EAYIH.11.71.G05.1.454.CMB.1.raw
  modified_base (305)..(305): a, c, t, g, unknown or other
  misc_feature (305)..(305): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggcttcaccttcattacctatggcatgcacgtcgggtccnccagacctccgaggcgagggggctgggagtgggtgctagttatttcatatgatggaaatgtgtactttctattcgagtacctccggtagaacgggtccgtattccgaccgttctacccgaagaacgactaacgttccgaggccacgacgtctagtatctgacaaagtcgaactagcctagacgagacgtgacggacgacggtcgtgtagttactcgtgtagacggtaaagttactttactagtagtggtacgg

SEQ ID NO: 244114 - DNA, 544 bp, Homo sapiens
  misc_feature: GYAE6OF01B4FRH.11.71.G05.1.454.CMB.1.raw
  modified_base (203)..(203): a, c, t, g, unknown or other
  misc_feature (203)..(203): n is a, c, g, or t
  modified_base (240)..(240): a, c, t, g, unknown or other
  misc_feature (240)..(240): n is a, c, g, or t
  modified_base (310)..(310): a, c, t, g, unknown or other
  misc_feature (310)..(310): n is a, c, g, or t
  modified_base (400)..(400): a, c, t, g, unknown or other
  misc_feature (400)..(400): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacngctacttagcctggtaccaacagaaacctggccagacctcccaggctcctcatctatgatgcatccaacncgggccactggccaccccagccaggttcagtggcaggtgggtctgggacagacttcactctcaccatcagcacgcctagacgcctgagtntttgactagtttattactgtcagcagcgtatcgactgactcgtaccttcgggacctaagggccaacggtacgtaaggtaaaacgttaaacgaacgttaggtacggtctcgaccaccgtacttactagttccttcacgtttcccg

SEQ ID NO: 244115 - DNA, 551 bp, Homo sapiens
  misc_feature: GYAE6OF01CXKQ8.11.71.G05.1.454.CMB.1.raw
  modified_base (184)..(184): a, c, t, g, unknown or other
  misc_feature (184)..(184): n is a, c, g, or t
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
  modified_base (372)..(372): a, c, t, g, unknown or other
  misc_feature (372)..(372): n is a, c, g, or t
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
  modified_base (533)..(533): a, c, t, g, unknown or other
  misc_feature (533)..(533): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcttgggttttcctcgttgcttcttttaagaggtntccagtgtcaggtgcaactggaggagtcgtgggggaggcgtggtccagccgtgggacgtccctgacgactctccgtgtacagcctctggcttcaccttcattacctatggcatgcacgtcgggtccnccagacctccgaggcgagggggctgggagtgggnggctagttattcatatgatggaaatgngtacttctatcagtacctcggtgaagggtccattcgaccgtctacagacgaactatccgacgctaacgcgtactntaactctacgaactaaatgaaacncgctagacgncgtagacgacgcggtcgtgttatattcaggtacgacggtaaaattactttanaagtagggtggtaacggg

SEQ ID NO: 244116 - DNA, 523 bp, Homo sapiens
  misc_feature: GYAE6OF01BRI5O.11.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (507)..(507): a, c, t, g, unknown or other
  misc_feature (507)..(507): n is a, c, g, or t
  modified_base (517)..(517): a, c, t, g, unknown or other
  misc_feature (517)..(517): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaangcccaccctctcctgcagggccagtcagagtgttaacngctacttagcctggtaccaacagaaacctggccagacctcccaggctcctcatctatgatgcatccaacgacgggcccacgtcggacccaccccgagccctaggttccaggtcggcaggtcgggtctggggacacggtacttcgactcctacaccatcagcacgcctagcgctgagtatttgctagtttattcgtgtcagctagtcgtatcgatgactccgtacgttcggacaggcacgataggaaataacgagtgtgcagcactntctatcttgnttcccg

SEQ ID NO: 244117 - DNA, 560 bp, Homo sapiens
  misc_feature: GYAE6OF01A6DV0.11.71.G05.1.454.CMB.1.raw
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (402)..(402): a, c, t, g, unknown or other
  misc_feature (402)..(402): n is a, c, g, or t
  modified_base (482)..(482): a, c, t, g, unknown or other
  misc_feature (482)..(482): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggaggtccctgagactctcctgtacngcctntggcttcaccttcattacctatggcatgcacgtgggtccgccagacctccgaggcgagggggctgggagtgggtgctagttatttcatatgataggaaatagtgtacttctattcagtctccggtagacgggcgattcnccgtctcagtagacatccagcacacgctgtactctgacaagtcgaactagcctagagtacgctaggaaggaccacgggtntacgttgttacgttacgtaggtcggaacgtaaagttactttacgtagttaaggagggttacgtacggttaaccggggg

SEQ ID NO: 244118 - DNA, 520 bp, Homo sapiens
  misc_feature: GYAE6OF01COCIH.11.71.G05.1.454.CMB.1.raw
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggagaggcgtggtccagcctggggaggtccctgagactctcctgtacagcctctggcttcaccttcattaccatgcatgcacgtcgggtccncagctccaggcgaggggctgggagtgggtgcagttattcatatgatgaatagtgactctattcagactccgngacggcatcacgtctcagagacatcagcacncgctgtatctnacaaatcgaacacgctagagagtcaggaggacgacggcgtagtacgtagttactgtacgacggaaagttactttacgtagttaaggtagggtgtaaccgggg

SEQ ID NO: 244119 - DNA, 619 bp, Homo sapiens
  misc_feature: GYAE6OF01A0A8X.11.71.G05.1.454.CMB.1.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctcgagggaangccacctctcctgcagggccagtcagagtgtaacngcttacttagccttaggtaccaacagaaaccctggacccagacctcccaggcctcctcatctatgatcgcatcccaagacgggcccagtcggacccaccccgagccctaggttccaggtcggctagggtgggtccaggggacacggtaccttcaccgttctaccaacctatcacgcacgcctagacgtcctaggacgtagttttgacgttagtttattactgtacgagtcgtagtcgtatccgtacgtcggtactccgtaccgttcggaccggaacgggacctaaccggtacgtaacggtaaaacgttaaaccggacgttagggtacgtacgtccgaaccgtacccgtacttcgttacggttcccttacctaccgttaccccg

SEQ ID NO: 244120 - DNA, 785 bp, Homo sapiens
  misc_feature: GYAE6OF01ETPV4.11.71.G05.1.454.CMB.1.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaanacgccaccctctcctgcagggccagtcagagtgttaacngctacttagcctaggtaccaacagaaacctggccagacctcccgaggcctcctcatctatgatcgcactaccaacgacgggccacgtcggaccaccccgagcccgtaggttcaggtcggactagggttcggggtcgtacggggacacggtactttccaacgttcctaccaccctataccgaacggtaccgacgtacccgtaacggacggtcccgttagggtaacgggtttaacgtttttacggaaccgttttaaggttttttaacttttacggtttacgttaccgtaagggtacctaacgggttaccgttacgttacccggtaacggtttacgggtaaccgttaccccggttaacccggttttaccggggaaccccgtaaacggggaacccgtaaccggtaaaccggttaacggggttaaaaaacctttaaaacccggggtaaaccgttcggggttaacggtaccgttacggacccgttaaccccgttaagttcccggtttacggtttacccgtttacctaacccgttcccccgtttaacccccgg

SEQ ID NO: 244121 - DNA, 773 bp, Homo sapiens
  misc_feature: GYAE6OF01B90LG.11.71.G05.1.454.CMB.1.raw
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
tcagcgagagataccacgaccggtgctcgatttagtgtcgtcgcaagagagagggggaactgctcagttaggacccagagggaaccatggaagccccagctcagcttctcttcctcctgctactctggctccagatagcaccggagaaattgtgttgacacagtctccagccaccctgtctttgtctccgaggggaaagacgccaccctctcctgcagggccagtcagagtgttaacngctacttagcctggtaccaanagaaacctggccagactcccaggctcctnatctatgatgcatccaacgngggcccactcgggccaacccccgagtacccgagggtttccaaggttcgggacctaagggttcgggggtccgtaggggaacctaaggtaaccctttcaaccttccttaccaacctaatccgaagccaacggacccttaaggaacgtcccgttaggaaggttatttttacggaccgttaaggtttttacttaaccgttggttaccgaaggtaccgtaacgggtacggttaacgttccgggtaacccgttaggggtaacctttacccgtaaccccggttttaccggggaacccgtaaaacgggggtaccctaaacccgggtaaacgttaaacgggggtaaaaaaaccttttaaaaccgggaaaccggtttcgggtaacgggtaccgttaaccgggaaccctaaacccgttacgtttacccgttacggtttaccccttttaccgaaccggtttcccctttaccccccgg

SEQ ID NO: 244122 - DNA, 570 bp, Homo sapiens
  misc_feature: GYAE6OF01CFWQL.11.71.G05.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaangccacctntcctgcagggccagtcagagtgttaacngctacttagcctggtaccaanagaaacctggccaggctccaggctcctnatctatggtncatccacaggccatggttccagccagttcagtgcagtggtctgagacagtagttcacgtctacacctatcgaaacggtctgcagtctagaagtatttgacttagtttacttactgtacagtctaagttaataataactcggccttacgggtaaccgtttcgggaccgtaaagggacccgtaaagggtggaaacgtaccgaaaacggtaccgttggtacggccgttagacctaccgtattcgttagttcttactacttccttccccgctcttaccg

SEQ ID NO: 244123 - DNA, 804 bp, Homo sapiens
  misc_feature: GYAE6OF01CHXPX.11.71.G05.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagcgagagataccacgaccggtgctcgatttagtgtcgtcgcaagagagagggggggaggaactgctcagttaggacccagagggaaccatggaagccccagctcagcttctcttcctcctgctactctggctccagatagcaccggagaattgtgttgacacagtctccagcccacctgtctttgtctccgaggggaanacgccaccctctcctgcgacgggccagtcagagttagtaacngtacttacttacgcctacggtaaccaaacgaacgaaaccgtcggaccaacggacctcccgaggtccctcctactactcttagtgtatcgactaactacccgaacggacgggaccacgtcggacccaccccgcgaccgtacggttcagggtcggacgtggggttcgggtcgtacgggaactacggtacctttaccgaccttccgtaccaacgtacgtacccgacggtaactaccggaccgttaagggtccggtaacccgttaggggtaacggtttaacgttttaccggacgttttaagtttttaacttaccgttcgttaacgacggtacgtaacggttaccgttagtaccggttacgttcgggtaacccgtttccccgttaacccgggttaccgggaaacccggtaacggggtaacccctaacggggttaaaccggtaaaacgggttaaaaacccgtttaaaacggtaccggttagggtacggtaaccttacccgggaaccttaaacccgttacgttttacccgttagggtttaccccttcgttaacccgtttaccccggg

SEQ ID NO: 244124 - DNA, 806 bp, Homo sapiens
  misc_feature: GYAE6OF01BU0HH.11.71.G05.1.454.CMB.1.raw
  modified_base (214)..(214): a, c, t, g, unknown or other
  misc_feature (214)..(214): n is a, c, g, or t
  modified_base (247)..(247): a, c, t, g, unknown or other
  misc_feature (247)..(247): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctagcctccagatagcaccgggagtaaattgtgttagacacagtctccagccctacccttgttctttgtcctaccggaagggggaaacncgccctaccctctccgtgcgacggccagtcagngttattacagtctacttagccgtacggtaaccaacgacgaaaccgtggaccaacgacctcccgacggccttcctacacttctagtgatcgacctactaccgaacgcggacctacgtcggacccacccgagtccgtaggtcgaggtcgacgtggtgggtcgtagggactagtaccttcaccgttccacaaccgttacacgtaccgactaccggtacctaaaggtccgtaccggttaggtaacggttttacgttttacggtaaccttttaaaggtttttaccttaacggtagtttaacccggaccgttaccggtaacggtttacttaaccgggttacccggtaaggtttaccggttaaccccgtttacccgttaaccccggggttaacccgggtaaaccggaaaaccggggttaccgtaaacccgggtaaaacggtttaaacgggtaaaaacccggtttaaacggtccgggtaacgggttacggtaccttaccgaacccgtttaacgaccggttttcctaccggtttaccttaccgttacccggtttccccgttaacccgg

SEQ ID NO: 244125 - DNA, 669 bp, Homo sapiens
  misc_feature: GYAE6OF01DNGO5.11.71.G05.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (345)..(345): a, c, t, g, unknown or other
  misc_feature (345)..(345): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaancgcccacctctcctgcagggccagtcagagtgtaacngtctacttagcctaggtaccaanacgaaacctggaccagacctccgagcctcctnatctatgatcgcactaccgaacgacgggcccaacgtcggacccaccccngaccgtaggtcacggtggcgtaggttcgggtactggggacaggtcctttacgaccttctaccacctactcaggccacgtccgtaacgacgtccgttaggtaacggttagtttttcggactttaggttttacgttacgttacgtacgacgtacgtacgtacgttacgtaccggttaactacgggtaaccttcccgtaaccggtttaccgggaacccggtaacgggaaccctaacggtacgtaaacggtaaaaacgttaaaccggacgttaggtacggtcgtacggaaccaccttacgtcttagttccctttacgtacgtttcccg

SEQ ID NO: 244126 - DNA, 754 bp, Homo sapiens
  misc_feature: GYAE6OF01BZ63Q.11.71.G05.1.454.CMB.1.raw
tcagcgagagataccacgaccggtgctcgatttagtgtcgtcgcaagagagaggggggaactgctcagttaggacccagagggaaccatggaagccccagctcagcttctcttcctcctgctactctggctccagatagcaccggagaaattgtgttgacacagtctccagccacctgtctttgtctccgaaggggaagacgccaccctctcctgcgagggccagtcagagtagttaacagtcttacttacgcctaggtaaccaacgaacgtaaacctggaccacgacctcccgaggtcctcctacatctaatgatcgactactaccgaacgacgggaccacgtcggacccaccccgagtccgtaggttccgaggttcggaccgtagggttcggggtacgtaggggaacctacggtacctttcaccttccgtaccaaccgtactaccgaacgaccgtaacggtcccgtaaggaccggtccgttagggtaaacggtttattttcggaacgttttaagttttacgttacgttcggtacacggtaccgtaggttaccgttacgtacggtaacggttacggtaaccctcccggttaacccgttaccgggaaccgtaacggggaccctaaacgggtaacggttaaacgggtaaaaaccgtttaacggaaccggttttggacggtacccttacggaccctaaccgttacgtttccgttacggtttaccctttaccgtacccgtttccccggttaaccccg

SEQ ID NO: 244127 - DNA, 645 bp, Homo sapiens
  misc_feature: GYAE6OF01A5R2H.11.71.G05.1.454.CMB.1.raw
  modified_base (306)..(306): a, c, t, g, unknown or other
  misc_feature (306)..(306): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaaactggaggacgtcgtggggggagcgtggtccagcctgggagtccctgagactctcctgtacagcctctggcttcaccttcattacctatggcatcgcactggggtcccnccagacctccgaggcgagggggctgggagtgggngctagtttnttcatatgataggaaactgtgtacttctattcgacgtccgtccggtaggaacgggccgtacttcgacccgttccaccgaagacgaactaacgttaccgacggccacgtacgcttaggtactacgtagaacaaagtcgaaaccgacgtcctaggacggtacgtacgtacgggaacggaccgtacgggtcgttaggttacgtacttttaggttacggtacggaaccggttaaaagttacgttttaccgtaaggttaacggggtaacgggttccggtaaaccggggtttacccgggggg

SEQ ID NO: 244128 - DNA, 644 bp, Homo sapiens
  misc_feature: GYAE6OF01ATAJH.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggaggcgtggtccagcctggggagtccctgagacctctcctgtacagcctctggcttcaccttcattacctatggcatcgctacgtcggggccccgcagacctccgagggccgagggggctgggaggtgggtggctagtttattcatagtgagtaggaaatgtgtactttactattcagtactccggtggaacgggtccgtattaccgacccgttctaccgaggaacgtaactaacttcccgaaggtcccaaccgtacggtcttacgtaacttccgtcgaacctaaagttcgaaactacggtacccgtaggaagtacgcgtagggaaccggacgtaccggtcgttaggttacgttaacgttatagggtacggaacgtaaagttacgtttacgtaaggtaaggtacgggttcggtaacgggttaccgggggg

SEQ ID NO: 244129 - DNA, 557 bp, Homo sapiens
  misc_feature: GYAE6OF01EQ0RD.11.71.G05.1.454.CMB.1.raw
  modified_base (200)..(200): a, c, t, g, unknown or other
  misc_feature (200)..(200): n is a, c, g, or t
  modified_base (259)..(259): a, c, t, g, unknown or other
  misc_feature (259)..(259): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaanagaaacctggccagactcccaggctcctcatctatgatgcatccaacacggggcccactcggccaccccagcccaggttcagtggcaggtgggtctgggacagacttcactctcaccatcagcagcctagacgcctgaggtattttgctaagttttattactgtcagccagtcgtatcgactggacttccgtaccgtttcggaccgtaagggaccaacgtacgtaaggtaaacttaaaacgacgttggtaggctcgaccacctattactcgttacctttctacgttcccgttaccccg

SEQ ID NO: 244130 - DNA, 605 bp, Homo sapiens
  misc_feature: GYAE6OF01C3MN3.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctgagactctcctgtacagcctctggcttcaccttcacttacctatggcatcgcacgtggtcccgccagacctccgaggcgagggggctgggaggtgggtggctagttatttcattagtgataggaaattgtgtactttctattcagtacctccggtaggaacgggtcctacttcgtacccgtctaccgagtaacgacctaagttccgaggtcacgacgtcttgtactcgtagactaaagtacgaaaccgtcgtaccgtaggacgtacgtcgtaggacggaccgtacgggtacttacggttagttaacttaccgtgtaacggtaacgtaaacgttatttacgaagttagggtagggttaaccggg

SEQ ID NO: 244131 - DNA, 655 bp, Homo sapiens
  misc_feature: GYAE6OF01C72JU.11.71.G05.1.454.CMB.1.raw
  modified_base (265)..(265): a, c, t, g, unknown or other
  misc_feature (265)..(265): n is a, c, g, or t
  modified_base (347)..(347): a, c, t, g, unknown or other
  misc_feature (347)..(347): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtggggggaggcgtggtccagccgtgggaggtccctgagactctcctgtacagcctntggcttcaccttcattacctatggcatgcacgtgggtccgccagacctccgaggccgagggggctggagtgggtgctagttnttcatatgagtaggaaatagtgtacttctattcgagtacctccggtaggaacgggtcccgtattccgacccgttaccgtccgaaggtaacgacctaaagtttcccgaacggtacctaccacggtaccttagtactcttaggacaaagttgaaccctaggccctaggaacgacgtacgtacgggaacggtaccgtacgggtctttaggtacggtttaatttaccggttaggttacggaaccgttaaaaggttaacttttaccgtaaagttagggaacgggttaggtaaccggggtttaacccggggggg

SEQ ID NO: 244132 - DNA, 602 bp, Homo sapiens
  misc_feature: GYAE6OF01ERHAC.11.71.G05.1.454.CMB.1.raw
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
  modified_base (578)..(578): a, c, t, g, unknown or other
  misc_feature (578)..(578): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaanacgccaccctctcctgcagggccagtcagagtagttaacagtctacttagccttaggtaaccaanacgaaacctggacccaagacctcccgaggcctccatatctatgatgcatccaaacgcgggacccacgtcggacctaccccgagcccgtaaggttccaggtcggacagggttcgggtcgagggaccaggtaccttcacgtccacaccatacagcacgacctagacgtcgtaggtaggttatttacggctttaagtttacttcgtgtacagtccagtaccgtatcgagttacgactccgtacgttcggacgaacggtacacgacgttaaaggtaaacttaacgtacgttggagcctgacctacccgtattccgtnttacctcttacgtcccgtaccccg

SEQ ID NO: 244133 - DNA, 813 bp, Homo sapiens
  misc_feature: GYAE6OF01BY5LV.11.71.G05.1.454.CMB.1.raw
tcagcgagagataccacgaccggtgctcgatttagtgtcgtcgcaagagagaggggggaactgctcagttaggacccagagggaaccatggaacgccccagctcagcttctcttcctcctgctactctggcctcccagatagcaccggagaattgtgttgacacagtcctccagccctacccttgttctttgtccgtaccgaaggggaacacgcccaccctctcctgccagggccagtcagtagtgtaaacagtctacttagccgtggtaaccaagaacgaacctggccaagacctcccgagcctcctcacttctagtgatcgctacaccaacggacgggacccacgtccggacccaaccccgaggtacccgtaagggttccgaacggtcggaccgtagggttcgggtcgtacggggacctaacggttaacctttccgtaacccgtctaccgaaccctagtaccgagtacccgaaccgtccgttaacggaccgttaccgttaaaggtacgggtttaactttttcggaacgttttaaacggttttttaaccttacggttacggttacccgtaacgggttaccgttaacggtacgtttaacggttaccggtaacgttaccgggttacttaccccggttaacccggttccgggaaaccggtaacgggggtaaccctaaacgggtaaccgggttaaacggttaaaaaccgttaaacccggtaggttaccgggttaaggcccgttaaccgaacccgttaccggtaactttcccggttactttaccctttaacgttaccccgtttcccgttaaccccgg

SEQ ID NO: 244134 - DNA, 606 bp, Homo sapiens
  misc_feature: GYAE6OF01DDIYV.11.71.G05.1.454.CMB.1.raw
  modified_base (311)..(311): a, c, t, g, unknown or other
  misc_feature (311)..(311): n is a, c, g, or t
  modified_base (598)..(598): a, c, t, g, unknown or other
  misc_feature (598)..(598): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtgggagtccctgagactctcctgtacagcctctggtcttccaccttcacttacctatggcatgcacgtgggtcccnccagacctccgaggcgagggggctgggaggtgggtgctagttattcatatgagtaggaaatgtagtactttctattacgagtacctccggtaggaacgggcctaagttccaccggttcctaccgaagaacgtaactaacgttcccgaaggaccaacgaccgtacttaggtatacgtacgaacaaaagtcgaaaccgtagaccctagaagacgacgtaggaacggaccgacgggtcgttaggtagttaacttcgtgtacgaacgtaaaggttatttacgtaagtaagnggttacgg

SEQ ID NO: 244135 - DNA, 668 bp, Homo sapiens
  misc_feature: GYAE6OF01DQ27N.11.71.G05.1.454.CMB.1.raw
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (385)..(385): a, c, t, g, unknown or other
  misc_feature (385)..(385): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtggggggagcgtggtccaggccgtggggacgtccctggacgactcctcctgtaacngcctntcggcttcaccttcattacctatggcatcgctacgtcgggtccgccagacctccgaggcgagggggctgggaggtgggtggctagtttattcattatgaatagggaaattggtntaacttctaattcaaggtaccttccggtaggaacgggccgtattccgaccgtctaccaagtaacgtaactaacttaccgacggtaccaacgtaccgtcgttagtacttctacgtaactaaacgtagaaaccgacggtacccgtaggaacgacggtacgtagggaacggtaccgtacggtacgttaggtagtttaacgtttacgttagggttacggaaccggtaaaagttacgttttaaccgttaagtaagggtacgggtacggtacgggttaacccggggggg

SEQ ID NO: 244136 - DNA, 714 bp, Homo sapiens
  misc_feature: GYAE6OF01C8AOE.11.71.G05.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (260)..(260): a, c, t, g, unknown or other
  misc_feature (260)..(260): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgagggggaaangccaccctctcctgcagggccagtcagagtgttaacngctacttagcctggtaccaanagaaacctggaccagactcccaggcctcctcatctatgatgcactaccaaacgacgggcccaacgtcggacccaccccagcccgtaaggttcaggtcggcgtaggtcggggtcgtggggcaacggtaccttcactccttaccgaacctagttaccacggcctaacggaccccgttaaggaaccgtcccgtaggtacgggtttattttcggacgttagtttttaacttacgttgtaccgtacgtaccgtaggtcgttagtaccggtaacgttgggtaaccttaccgtacccgtttaccggggaacccgtaaacgggaccgtaaaccggtaacggttaaacgggaaaaaccgtttaaaccggaaccgttcggggtacggtccgttacggaaccctaacccgtacgtttaccgttaccggttacttttacccgtaccgtttcccccgttacccccgg

SEQ ID NO: 244137 - DNA, 809 bp, Homo sapiens
  misc_feature: GYAE6OF01D3YFJ.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccagtggtagtttgggctgagcgttgggttttcctcgttgcttcgttttaagaggtgtccagtgtcaggtgacaacgtggaggagtcggtgggggagcgtggtctagccgtgggacgtccctgacgactctcctgtacagtcctgtcggtccttacctacctttctaactttaacctagtcggactacgtcgaccgtaccggtccgggtaccccgaccgaacggtacccgtacccggaggggccgggagggggggtccttaggggtacgggttcgggggtcgggtaccgttaaggttttacgtttacgtaagttagtaggtaaggtaaggggtaaaattaggttacgttaacctttagttaacgttaccgaacgttacccgttcgggtaacgggtaaccggggtacccgttaacttaccccggtaacccgttccgttaacccgaaaggtaacgtaaccttaaccgttaccgaacggtaccctaaccgacgtaccgttagtactacgttacgaactaaacgtacgaaacgacggtaccgtaggaacggtacgtaccgtacgggaacggtaccggtacggtcgttaggtttacgttacgttaggtacggtaagtaaccggttaaaagttcgtttaaccgtaaggttaacgggtacgggttaacggtaccggggttaccggggg

SEQ ID NO: 244138 - DNA, 752 bp, Homo sapiens
  misc_feature: GYAE6OF01EKUFN.11.71.G05.1.454.CMB.1.raw
  modified_base (178)..(178): a, c, t, g, unknown or other
  misc_feature (178)..(178): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (356)..(356): a, c, t, g, unknown or other
  misc_feature (356)..(356): n is a, c, g, or t
tcagcgagagataccacgaccggtgctcgatttagtgtcgtcgcaagagagagggggctgggagaggagcccagcactagaagtcggcggtgtttccattcggtgatcagcactgaacacagaggactcaccatggagtttgggctgagcttgggttttcctgttgcttcttttaagnggtgtccagtgtcaggtgcaacgtggaggagtcgtgggggagcgtggtccaggccgtgggacgtccctgacgctctctgtacngcctcnggtcttcaccttcattacctatcggcatcgactacgtcggggtcccacgacgactccgaggcgaggggctgggagtgggtggctagttnttcatagtgtagtaggtaaattggtagtaccttttacgtatttacgaacgttaccgttcccgggtagggtaaccgggtacccgtaacgtttaccgtaaccccggttccgttaaccccgtaacggtaaccggtaaaccgttaaaccgttttcccggaaacgggtacccgtaaaccgtaccccggtaccgtttacggtttaacttcccgtacggaacctaaaacggttaccggtaaaccgtacggtacccgttaggaaccggtacggtaccggttagggaacggtaccgtaacggggttccgttacgggttacgtttaacggtttaccggttagggttaggaaaccgggttaaaagttaccgttttaagaaacggtttaagggtaggggttaaccggg

SEQ ID NO: 244139 - DNA, 691 bp, Homo sapiens
  misc_feature: GYAE6OF01C9JBJ.11.71.G05.1.454.CMB.1.raw
  modified_base (266)..(266): a, c, t, g, unknown or other
  misc_feature (266)..(266): n is a, c, g, or t
  modified_base (363)..(363): a, c, t, g, unknown or other
  misc_feature (363)..(363): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagtctgggttttcctcgttgcttcttttaagaggtgtccagtgtcaggtgcaactggaggagtcgtgggggacgcgtggtccagccgtgggacgtccctgagactctcctgtacagccctntggccttctaccttctacttacctatcggcactgcacgtcggtccgaccagactcgaggcgagggggctgggaggtgggtggcgtagttattcattntaggtagtaggtaatagtagtacttctacttcgagtaactccggtaggaacgggtccgtacttccacccgttacctacgaacgaacgtaccaagtttacccgaggtaccaacgacgtcgtacgttaacttctacggtaactaaacgtaacgtaacgtaacccgtaccgtagaacggtaacggtcccggttagggaacgggaaacccgtaacggggtcccttaggtaacgtttaccgttaacgttcgggttaaggtaacccggttaaaagttaactttcggttaaaagttaggggtaaacggtcgggttaacgggttaaccccgggggg

SEQ ID NO: 244140 - DNA, 831 bp, Homo sapiens
  misc_feature: GYAE6OF01EVMZG.11.71.G05.1.454.CMB.1.raw
tcagcgagagataccacgaccggtgctcgatttagtgtcgtcgcaagagagaggggggggagaggagcccagcactagaagtcggcggttgtttccattcggtgatcagcactgaacacagaggactcaccagtggagtttgggctggagtcgttgggtttttccctcgtttgcttacgtttttaaggaggttgtccagttgtcgtagggtgactaaacgtgggaaggtacggttcggtgggggggacggtcggtcgggttccacgggcccggttagggggaacggttcccctggacgtaccttccgttccgtgtaaccacggtcccgttcgttcggtcctttaccctacccttttacctaactttaacccgttagttcggactaagttcgcctaccggttccggggtacccgccgacggacccgttccggacgggtaccgggacgggggtcgtcggggtaggtgggggtcggtacgttaggttttatttacgtaagttagtaggtaagtacggtaaagttagtcgttaccttagttaactttacgtacggtaccgttccgggtaacggaacgggtaccgttacgttacccgtacccgtcgttaccgaagtaacgtaacgttaacgtacccgacgacaccgtacgtccgttagttacttacgtacgaactaagttaacgaacgtaccgtacgtagaacgaggtacgtacggaaccggtacggaaccggtacgttaggttacgtttaacgtttaacgggtgttacggtaacgttaaagttacgtttaagttaaggtaagggtacgggttacggtaacggggttaccccgggg

SEQ ID NO: 244141 - DNA, 683 bp, Homo sapiens
  misc_feature: GYAE6OF01EBW0A.11.71.G05.1.454.CMB.1.raw
  modified_base (151)..(151): a, c, t, g, unknown or other
  misc_feature (151)..(151): n is a, c, g, or t
  modified_base (206)..(206): a, c, t, g, unknown or other
  misc_feature (206)..(206): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccgganaaattgtgttgacacagtcctccagccaccctgtctttgtctaccgaggggaaanacgccctaccctctcctggcagggccagtcagtagtgttaacngtctacttagcctggtaaccaacgagaaacctggaccagacctcccgagctcctanactctangactgacatccaacgcggccacgtcggacccaccccgagtacccgaggtttccaggttcggacgtacgggttggggtccgtacggggaaccaaggtacctttaccgacttcctaccgaaccctagtaccgacgtacgaacgtcccgttaagaccgtcgtaggtagttacgtttgactaggttttactacgtgttacaggtctacggacgttacacggtacgtacggtacttaccgtacccgttacggaaccgtaacgggacctaaggtaacccgttagggtaaaaaccttaaaccggtacgttacgggtacgtcgtaccggtacctaacccgttgtaccctttgggtaccctttcaccggttttacccccg

SEQ ID NO: 244142 - DNA, 666 bp, Homo sapiens
  misc_feature: GYAE6OF01CDU26.11.71.G05.1.454.CMB.1.raw
  modified_base (275)..(275): a, c, t, g, unknown or other
  misc_feature (275)..(275): n is a, c, g, or t
  modified_base (331)..(331): a, c, t, g, unknown or other
  misc_feature (331)..(331): n is a, c, g, or t
tcagcgagagataccacgaccggtgctcgatttagtgtcgtcgcaagagagaggggggtctgggagaggagcccagcactagaagtcggcggtgtttccattcggtgatcagcactgaacacagaggactcaccatggagtttgggctgagcttgggtttttccctcgttgcttcttttaagaggtgtccagtgtcaggtgcaacgtgggaggagtcggtggggggaggcggtggtccaggccgtggggacggtccctgacgactctcctgtacngcctcgtggtccttccacctttcaacttacctatggctatcgcacgtcgggtcccnccagacctccgaggcgagggggctgggaggtgggtggctagtttacttcatagtgagtaggaaattgtcgtacttactattacgacgtacgtcggtaggacgggtaccgtacttccgaccggttcctaccgagtaccgtaactaaccgttcccgaacgtccgaaccacggtcttacgtacttcgtagaaccgtaaatccggaaacgtaccgtacctagaacggacgtaccgtagggaacggtacccgtaacgggtcgttacggtagtttacgttacgtacgggtaacgtaacgtaaagtttactttaagtaaggtaagggtagggttaaccgggg

SEQ ID NO: 244143 - DNA, 606 bp, Homo sapiens
  misc_feature: GYAE6OF01CZB5O.11.71.G05.1.454.CMB.1.raw
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (320)..(320): a, c, t, g, unknown or other
  misc_feature (320)..(320): n is a, c, g, or t
  modified_base (367)..(367): a, c, t, g, unknown or other
  misc_feature (367)..(367): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (576)..(576): a, c, t, g, unknown or other
  misc_feature (576)..(576): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagtcttgggttttccctcgttgcttcttttaagaggtgtccagtgtcaggtgcaacgtgggaggagtcgtggggggaggcgtggtccagcccgtggggacgtccctgagactctcctgtacngtccctntggtcttccaccttcacttacctatggcatcgcacgtcgggtcccnccagcctccgaggcgaggggctgggagtgggtgctagtttattcatntgataggaaatgtntacttntattcaagtacgttcgtaggaacgggtcctacgttccaccgtctaccgaagtacgtaactaacttaccgaggtaccacaccgtctcgtatccgtagtacaaagtacgaaaccgtacgtaccgttagacggacgtacgtaggaacggacgtacggtacgtgttacgtattacgtagtagacgtaaagttnttactaagtaggacgtggtacggtacgggg

SEQ ID NO: 244144 - DNA, 567 bp, Homo sapiens
  misc_feature: GYAE6OF01A7FC8.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagacctccaggcagggggctgggagtgggtgcagttattcatatgatggaaatgtgacttctattcagactccgtagaacgggccgattcgaccgttctcccgagacgactaacgttccacggcacacgcttagtacttctagactaaatcgaaactacggaccttagacggagtcgtaggaacggtaccacgggtacctggtagttaacgttacgtgggtacgaacgtaaagtactttactaagttaggaagggttacggg

SEQ ID NO: 244145 - DNA, 932 bp, Homo sapiens
  misc_feature: GYAE6OF01DHMMV.11.71.G05.1.454.CMB.1.raw
tcagcgagagataccacgaccggtgctcgatttagtgtcgtcgcaagagagagggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggagcgtggtcccagccgtggggacgtccctgacgactctcctgtaccagtcccttcgtcgggtcctttacctaccctttctaactttaaccctatcgggactagttccggcctaaccggtttcggggtccccgacccgaacggtacccttaccccggaaggggtccgggtaacggggggggtccttgggggtaagggttcgggggtacgggccttaaggttttaacttttcgaaagtttagttaggtaagttaaggggtaaaaattcgggttagtaacccttttagttaattaccgtaacggtacccgtttccgggtagggaaacgggtcccgtaacgtttacccgtaaccccgtccgttaacccgaacgtaacgtaaaccgtaacgtttcccgaacggtacccaaaccgttacccggtacgtttacgttaacctttaccgtaacggtaaacctaaaacggttaaccggaaaccgtaaccgggtacccgttaaggggtaaccggtacgggtacccggttaacgggaaaccggggtaacccggtaaccggggttaacccggtttacgggtttaacggttttaaacggttttaacccggttacggggtttaaaccgggttaaaacccgggttttaaaaacgggttttaaaccgttttttaaccgggtttaaaacggggtttaaacgggggttaaacgggggtttaaaccccgggggg

SEQ ID NO: 244146 - DNA, 672 bp, Homo sapiens
  misc_feature: GYAE6OF01B7B6Y.11.71.G05.1.454.CMB.1.raw
  modified_base (178)..(178): a, c, t, g, unknown or other
  misc_feature (178)..(178): n is a, c, g, or t
  modified_base (314)..(314): a, c, t, g, unknown or other
  misc_feature (314)..(314): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggtagtttgggctgagcttgggttttcctcgttgcttcttttaagnggtgtccagtgtcaggtgcaacgtggaggagtcgtgggggaggcgtggtccagccgtgggacgtccctgagtacctctcctgtacagcctgtggcttcaccttcacttacctatcggcatcgcacgtcgggtcccnccgacgacctccgacggcgagggggctgggaggtgggtggctagtttattcgattagtgtaagtaggtaaaattgtcgtaactttctattcgacgtacgtcccggtagggaaccgggtccgtactttaccgacccgttctacccgtaagtaacgtaaccttaacgttcccgaagggaccctaacgtacccggtcttacggttactcgttacggaaccttaaagtacgaaacgtacgaccgtagaaggcgtacgtaggaacggaccgacggtacttggtaacgtttacgttacgttggtacgtaacggtaaaagttgtttaacgtagtaaggtagggtaccgtaacgggttaccggggg

SEQ ID NO: 244147 - DNA, 896 bp, Homo sapiens
  misc_feature: GYAE6OF01DNN6M.11.71.G05.1.454.CMB.1.raw
  modified_base (198)..(198): a, c, t, g, unknown or other
  misc_feature (198)..(198): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccagtggagtttgggctgagcgttgggttttcctcgttgccttcttttaagaggtgtccagtgtcaggtncaactgggaggagtcgtgggggagcgtcggtccagccgtgggacgtccctgacgactctccgtgtaccacgtcctgtggtccttacctacccttctaactttaacccgtagtcggacctagtcgcctaccggtcggggtacccccgaccaacggaccgtcccggaaggggccgggtaagggggggtccgttaggggaggggttcgggggtacgggtaccttaaggtttacttttacaagtttagtaggtaagttaaagggtaaaacgttaggttacgttaacctttctaacgtttaccgaaaggtaccccgtttaccgggtagggaaacccggggttccgtaaccgttacccgtaaccccggttcctacccggaaaggtaaccgtaacccgttaaacgtacccgacgggacccaaaccggtaccggtccttaacgttacgttcgtaacggtaaaccttaaaacggtaccgtaaaccgtacggacccgttaagggaaccggtacgtaacggtacgggaaaccggtaacccggtaccgggttaccgtttggtttaacccgggtttaaagttttcccggttaaacggggttaccgggttaaaacgggttaaaacgttttacccgggtttttacttaaaaggggttaaggggtttaacgggttaaacccggggttaacccgggggtttaaaccccggggggg

SEQ ID NO: 244148 - DNA, 727 bp, Homo sapiens
  misc_feature: GYAE6OF01DI853.11.71.G05.1.454.CMB.1.raw
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccacctgtctttgtctccgagggaaagagccaccctctcctgcgacgggccagtcagtagttacgttaacacgtcttaacgtacgccgttacggtaaccaaacgaacgaaaccgtcggacctaacgaccctcccgacggcccttacctactacttcgtatgactcgacctaactacccgaacggacgggaccctacggtccggacccctaaccccgacgaccgtacggttacgaggtcggacgtagggttcgggtcgtacgggacacgttaccttacacctcctaccgaacctatccgacgtacgaccgacgtaacggactccggttaggtaacgtttagtttcgaacttttaagttttattaccgtgtaccgagtacgtacgttaccgttacgtacgacgggttacgtaccttcccgttaaccggttaccgggaaccgaacgggtaaccctaacgggtaacgtaaacgggtaaaaacgtttaaccggtaacgttggacggtcctaccgacctaacgtattccgttacgtttctaacccgtcgttacccccg

SEQ ID NO: 244149 - DNA, 627 bp, Homo sapiens
  misc_feature: GYAE6OF01CD7W0.11.71.G05.1.454.CMB.1.raw
  modified_base (347)..(347): a, c, t, g, unknown or other
  misc_feature (347)..(347): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagccgtgggagtccctgagactctcctgtacacgcctcgtggccttcacccttcattacctatggcatgcacgtcgggtcccgccagcctccgaggcgagggggctgggacggtgggnggctagtttacttcatatgaagtagggaaatgtcgtacttctattcagtactccgtaggaacggccgtattccgaccgtctaccgagacgaactaacgttaccgaggtccacgaccgctacgttactccgtagacctaaagtacgaaacctacggtaccctaggacgtagccggtaacgggaacgggtaccgtaacgggtccgttaggttacggttaacttacggttagtaccggaacgtaaagttacgttttagaaggttacgggtagggttaaccggg

SEQ ID NO: 244150 - DNA, 850 bp, Homo sapiens
  misc_feature: GYAE6OF01AG3S4.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcggtgggggaggcgtggtccagccgtgggacgtccctgagacctctccgtgtacagtcctcgtcgtccttcctaccttactacttacctagtcgactagtcgaccgtacggtccgggtccccgaccgacgtaccgtaccggacggggaccgggtacgggggtcggtaggggtacgggttcggggtacgggtacgttaagttttacgtttacgtaagttaagttagggtaaagttaaagggttaaacgtttacggttaacgttaaccgtttacgttaacgttaccgtaaccggttacccggttaccgggtaacgggtaaccgggtacccgttacgttacccgtacccgttaccgtaccgtaacggtaaccgtaaccgttaaccgtaccggaaccggtacccgtaacccgttaaccggtaccgtttacgttaaccgttaccgtaacgtaaaccgtaaacgtaaccgaaaccgtaccggtaccgtaacggacggtacggtaccggtacgggaaccggtaccggtacggtaccgttaggttacggtttaacgttacggtacggtaaccggtaaacggttaaacgtttacgtttaacgttaagggttaagggttacgggttacgggttaacccggggttaccgggg

SEQ ID NO: 244151 - DNA, 830 bp, Homo sapiens
  misc_feature: GYAE6OF01CMJ13.11.71.G05.1.454.CMB.1.raw
  modified_base (161)..(161): a, c, t, g, unknown or other
  misc_feature (161)..(161): n is a, c, g, or t
  modified_base (179)..(179): a, c, t, g, unknown or other
  misc_feature (179)..(179): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggtttccngttgctcttttaagagtntccagtgcaggtgcaactggaggagtcgtggggagcgtggtccagtcctggggacgtccctggagtaccgtctcccgtagtaccagcccttacgtgggaccttttccaacccgtttcaacgttttaccctagttccgggactaacgttcggacctaaccggtttcgggggtcccctacccgaacggtaacccttcccgaacgggggtccggaaggggggggtcccttagggggaacgggttcgggggtacggtcccttaagggtttttactttttccgaaagttaggttacgggaaattacgggggtaaaaattacgttcgggtaaaaccctttttcgaaacgttttaccgaaacggttaccgttaccccggggtaagggtaaacccggggttcccgtaaacggtttaccccgtaaccgttccccgtaaccccggtaacgtaacggtaaaccggtaacctttaccggaacgggtacccgaaccgaacccggtcgttaacgttacgttacgtacggtaacctaaagtaccggtaaccgaacggttccgtaaggacggacgtcctagggtaccgaacggtacggtcgttcgggttataacggttacgtcggtacgacgtaaacgttacgttatacgtaggtacggttaacggg

SEQ ID NO: 244152 - DNA, 624 bp, Homo sapiens
  misc_feature: GYAE6OF01D242D.11.71.G05.1.454.CMB.1.raw
  modified_base (363)..(363): a, c, t, g, unknown or other
  misc_feature (363)..(363): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagttttgggctgagtcttgggttttcctcgttgcttcttttaagaggtgtccagtgtcaggtgcaactggaggagtcgtgggggaggcgtggtccaggcctggggacgtccctgacgacctctccgtgtacagcctctcggcttccaccttctaattacctatcggctatcgccacgtcggggtcccgaccagacctccgacggcggagggggctgggaggtgggnggctaggttattcatatgagtaggaaattagtgtacttctattcaagtacgtccggtagaacgggcctacttcaccgtctacagagaactacgtcaggaccacacgtctagttactccgtagaacctaagtacgaacgtacgaccctagaggtacggtacgtacgggaacggtaccgacgggtcgttaggttacgtttacgttacgtagggttacaaacgggttaaattagtttaacctaaggtagggtagggtaacgggg

SEQ ID NO: 244153 - DNA, 703 bp, Homo sapiens
  misc_feature: GYAE6OF01A4G4X.11.71.G05.1.454.CMB.1.raw
  modified_base (177)..(177): a, c, t, g, unknown or other
  misc_feature (177)..(177): n is a, c, g, or t
  modified_base (259)..(259): a, c, t, g, unknown or other
  misc_feature (259)..(259): n is a, c, g, or t
  modified_base (330)..(330): a, c, t, g, unknown or other
  misc_feature (330)..(330): n is a, c, g, or t
  modified_base (594)..(594): a, c, t, g, unknown or other
  misc_feature (594)..(594): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatgggagtttgggctgagcgtggtttcgcgtagctctttaagaggtntccagtgtcaggtgcaacgtggaggagtcgtgggggagcgtggtccagccgtgggacggtccctgacgtactctcctgtacncgccttccgtggccttcctaccttcaacttaccgtagtcggacacgttggacctaccggtcggggtacccnccgaacgtccgtccgaaggtccggagggggtcctagggtacggtgggttcggactagtttactttacgagttaatacggtaagttaggaaacgttaggtagtaccctttataagttccgaagtaaacgtccggtaaggaaccgggtctacttaccgacccttcgtaccgtaacgaacgtaaccgtaacttccgaaacgggccaaccgtaaccggtcttacggtactacggtacaccgtaaagtcgaaacgtcggcgtacggaanggttaccagggacgacggtacggtaccgttcgttaagttacgtttagtggtacgaaacggtaatttacttacgttaagtagggtacgggtacgtacggggttaccgggg

SEQ ID NO: 244154 - DNA, 581 bp, Homo sapiens
  misc_feature: GYAE6OF01A5IQ2.11.71.G05.1.454.CMB.1.raw
  modified_base (195)..(195): a, c, t, g, unknown or other
  misc_feature (195)..(195): n is a, c, g, or t
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtncaacgtggaggagtcgtgggggagcgtggtccagccgtggggacgtccctgacgactctcctgtacncgtcctctggcttcaccttcattacctatggcatcgctacgtgggtccnccagacctccgaggcgaggggctgggagtgggtgctagttattcatatgagtaggaaatgtgtacttgtattcagtctcgagacggtctatcaccgtctcagacactaactccgacggcaccgacgtctagtactcgtagaactaaagtacgaaccaggtacccgtagacgacgtcgtacggacggtacgacggtcgtagttgtaacgttacgtggtacgagtaaagttctttaacgtagtagggtacggtggtaacgggttaccggggg

SEQ ID NO: 244155 - DNA, 623 bp, Homo sapiens
  misc_feature: GYAE6OF01ATKY2.11.71.G05.1.454.CMB.1.raw
  modified_base (500)..(500): a, c, t, g, unknown or other
  misc_feature (500)..(500): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctggggacgtccctgagactctcctgtacagcctctggcttcaccttcattacctatggcatgcacgtgggtcccgccagacctccgaggcgagggggctgggaggtgggtggctagtttattcatatgatggaaatgtgtacttctattcagtaccgtcggtaggtaacgggccgtatttcccgaacccgttcctaccgagtaacgaactaacgttacccgaaggacccaaccgacgtcttagttactcgtagaacctaaagtcgaaaccncgaccgttaggaacgacgcgtaggacgggaccgtacgggtcttaggttacgttacttaccgtggtacggaacgtaaagttctttacgtaagtagggaacggttggtaaccgggttaccggggg

SEQ ID NO: 244156 - DNA, 662 bp, Homo sapiens
  misc_feature: GYAE6OF01AW6HE.11.71.G05.1.454.CMB.1.raw
  modified_base (306)..(306): a, c, t, g, unknown or other
  misc_feature (306)..(306): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccaggccgtggggaggtccctgagacctctcctgtacagcctctggccttcaccttcattacctatgcatgcactcgggtccnccagacctccgaggcgagggggctgggacgtgggtggctaggtttattcattagtgagtaggaaatgtgtacttctattcagtacgtccgtaggaacgggtcccgtattacccgaccgttccgtacccgaacggtaacgtaaccgtaaaccgtttcccgaacgggacctaaccgtaccggtcgttacggtaacttccgtagaaccctaaaagttcgaaaccgacggtacccgtaggaacggacgtacgtacggacggaacccgacgggtccttagttagttaacgttacgttaggtacgaacggttaaagttctttaacgtagttaaggaacggttcggaagggttacccgggggg

SEQ ID NO: 244157 - DNA, 770 bp, Homo sapiens
  misc_feature: GYAE6OF01DBSLM.11.71.G05.1.454.CMB.1.raw
  modified_base (206)..(206): a, c, t, g, unknown or other
  misc_feature (206)..(206): n is a, c, g, or t
  modified_base (404)..(404): a, c, t, g, unknown or other
  misc_feature (404)..(404): n is a, c, g, or t
tcagcgagagataccacgaccggtgctcgatttagtgtcgtcgcaagagagagggggtctgggagaggagcccagcactagaagtcggcggttgtttccattcggtgatcagcactgaacacagaggactcaccatggagtttgggctgagtcgttgggttttcctcgttgccttagttttaaggaggtgtccagtgtacgaggtnacaacgtgggaaggaggtcggtggggggagtcgtcgggtcctaggcccggtgggacggttccccaggacgtacctcctccgtgtaccacgtccctcgtcgtccttacctaccttctactttaaccgtagtcggactatcgaccgtacggttcggtacccgacctaagccgtccggaaggggcggagggggtatcgggnggtcgggtgtacgtagtttatcaagttagtgtaagtacgggtaaatacggtacgttaactttcttaacgtacgtaaacgtccgtaaccgggtaggaaccgggtccgtaacttcccgacccgttacgtaccctaagaacgtaaccgtaacttacccggaacgtaccctaaccgtacgttaccgttaagtacttaccgtaacgtaacgtaaacgtaccgtaaacctaccggacctaacggaacggtacgaacggttaacgggacgaaccggttaccggcggttaaggttacgttactttaaggtaccgtaacgtaacggttaaagtttaacgtttacggtaaaggtaacggttggggttaaaccgggg

SEQ ID NO: 244158 - DNA, 829 bp, Homo sapiens
  misc_feature: GYAE6OF01CTM8L.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatgggagtttgggctgagcgttgggttttcctcgttgcttcttttaagaggtgtccagtgtcaggtgcaacgtggaggagtcggtgggggaggtcgtcggtccagccgtggggacggtccctggacgtaccttcctccgtgtaccacgtcccttcgtggtcctttaccaccctttctaacctttaacctagtcggccaagttcgaccgtaccggttcggggtcccgacccaacggaccctcccggaaggggccggaacggggggtccttaggggacgggttggggtacgggtacttaaggtttactttcgaatttagtaggtaagtagggtaaaagttcggtagttaactttcgttaagttaccgtaacggtaacccgttacgggtaaggtaaaccgggggtcccttaacgtttaccccgtaccggttacccgttacccgtaaaggtaacgtaaaaccgttaaccgtttacccggaaaccggtcccgaaaccgtaccggtaccgtttaggttaacctccggtttaacgaaacccgtaaagttacccggaaaccgtccgtaaccggttaaggaccggtacggtaccgtaacgggaaaccggaccggtacggtaccgttacgggttagttaactttaccggtagtacgtaaccggtaaagtttacgtttagaaacggtagggttaacgggtaccgggg

SEQ ID NO: 244159 - DNA, 678 bp, Homo sapiens
  misc_feature: GYAE6OF01AK2P0.11.71.G05.1.454.CMB.1.raw
  modified_base (162)..(162): a, c, t, g, unknown or other
  misc_feature (162)..(162): n is a, c, g, or t
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
  modified_base (320)..(320): a, c, t, g, unknown or other
  misc_feature (320)..(320): n is a, c, g, or t
  modified_base (357)..(357): a, c, t, g, unknown or other
  misc_feature (357)..(357): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccagtggagtttgggctgagcgtggtttccncgttgctcttttaagaggtgtccagtcgtcaggtncaactgggagagtcgtgggggagcgtggtccaggccgtggggacgtccctgacgacctcgtcctgtaccngcctctggcttcaccttcgattacctagtcggcagtgcctacgtcgggtcccnccgagacctccgaggcgagggggcctgggagttgggnggctaggtttacttcgatagtgaagtagggtaaatggtcgtacttctattcgacgtaccgttccggaggtacgggtccgtacgttacccgacccgttcctacccgtaagacgtaacccgtaacgttacccgaagggtacccaacccgtacgtccgttacggttaacttaccgtacggaacctaaacggttcgaaaccgtacgtaccgtaggaaggtaccgtaggtacggaacgggaaccgtaccgggtacgttggttagttaacgttcgttaggtaacggtaacgtaaacgttatttagtaacgtagggtacggtaccggg

SEQ ID NO: 244160 - DNA, 802 bp, Homo sapiens
  misc_feature: GYAE6OF01AX0FA.11.71.G05.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccgagggaancgcccaccctctcctgcgacggccagtcagagttagttaacngtacttacgttacgcctaggtaaccaacgtacgaaaccgtcggaccacgacctcccgaaggccttcctactatctatgaactcgacctacgtacccaacggcgggaccctacgtccggacccctaaccccgagtaccccgttaggtaccgacggtcggacgtaacggggttcgggtacgtacggggactacggttaccttaccaccgttcctaccgtaaccctataccgacgactaaccggtacccgtaagaccggtaccgttaggttaacggtttactttacggtaaccgtttagtttttaaccttaccggtacgttacgaacggtaccgacggtttaaccgtaacgtttccggaacggttccggtacctttaccccgggtaccccggtttaccgggaacccggtaaacgggtaacccctaaacgggttaaacccggttaaaaacgggttaaaaaccgtttaaaccggaccggtttagggacccgggttacccttaaccggaccctaccggttacttcccggtttaccgttacccttaccgtaccgttaccccccgg

SEQ ID NO: 244161 - DNA, 702 bp, Homo sapiens
  misc_feature: GYAE6OF01B0193.11.71.G05.1.454.CMB.1.raw
  modified_base (243)..(243): a, c, t, g, unknown or other
  misc_feature (243)..(243): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctccagatagcaccggagaaattgtgttgacacagtctccacgccaccctgtctttgtctccgaggggaaacacgcccaccctctcctgcgacgggccagtcagagtgttaacngtctacgttacgcctaggtaaccaaacgacgaaaaccgtcggccaaggtacctccgacggcctcctcactcgtaatggaatcgacactaccaacgacgggaccacgtacggcccaccccgacgtaccgacggttccgaggtcggtacgagggttcgggtcggtacggggaactacggtaccttcgaaccttacgtaccaacctactaccgacgacctaacgcctaacggacgtcccgtaggtacgttagttttacgacgtttatttaacttacgttcgtacgtacgcgtaacgtcgttaactcggtaactcggtactacccgtaaccgttaccgggactaacgggaacctaacggtaaacgtaacgtaaaaccgtaaacggtaacgttcgggtacgcgttaccggacctacgttaccgttacgtttacgtaccctttactcccctttccgttaaccccg

SEQ ID NO: 244162 - DNA, 530 bp, Homo sapiens
  misc_feature: GYAE6OF01BVB7U.11.71.G05.1.454.CMB.1.raw
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (432)..(432): a, c, t, g, unknown or other
  misc_feature (432)..(432): n is a, c, g, or t
  modified_base (481)..(481): a, c, t, g, unknown or other
  misc_feature (481)..(481): n is a, c, g, or t
tcagcgagagataccacgaccggtgctcgatttagtgtcgtcgcaagagagaggggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacngcctctggccttcaccttcattacctatggcatgcacgtgggtccnccagctccagggcagggggctggagtgggtgcagtttacttnatatggaatggaaatggtntacttcgtattcagtacctcgaggaggcgtattcaccgtctcagagacaacttccgagcacacgntagtatctagaccaatacgaacagcctagagacgataggaggacacggngtggtattacttcgtgtagacgtaatactttagatagggtaggtacggg

SEQ ID NO: 244163 - DNA, 658 bp, Homo sapiens
  misc_feature: GYAE6OF01DBSRF.11.71.G05.1.454.CMB.1.raw
  modified_base (176)..(176): a, c, t, g, unknown or other
  misc_feature (176)..(176): n is a, c, g, or t
  modified_base (294)..(294): a, c, t, g, unknown or other
  misc_feature (294)..(294): n is a, c, g, or t
  modified_base (548)..(548): a, c, t, g, unknown or other
  misc_feature (548)..(548): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcggtgttcgcgtagctcttagaggtntcagtgtcagtgcaagtggagagtcgtggggacgcgtgccagccgtggcggtccaggactctctcctagccagccctgtcgccttctaaccttcgtactttaacctagttggaccttntacgccgtacgtccgggcccacgaccgtaccgtaccggacggtcgggtacggggctaggggtacggtcgggtagtacttagttacttactagtagtacgtaagtagtaacgttagagttaccttatacgtacgtacgttacgtcgtacggtacgtcgtacgtaccgtccgtacgtaaccgtagtaacgtacctacgtaccgagtaccaacgtcgtacgtgtaccgtacgtacaacgtaaccgtacgacgtacgngtacgtacgtacgacgacggtacggtacggtacgtacgttacgttaagttacgttacgttacggtacgtaacggttaacgttacgttagttaaggtaggtacgggtacgg

SEQ ID NO: 244164 - DNA, 746 bp, Homo sapiens
  misc_feature: GYAE6OF01DP30L.11.71.G05.1.454.CMB.1.raw
  modified_base (188)..(188): a, c, t, g, unknown or other
  misc_feature (188)..(188): n is a, c, g, or t
  modified_base (371)..(371): a, c, t, g, unknown or other
  misc_feature (371)..(371): n is a, c, g, or t
  modified_base (440)..(440): a, c, t, g, unknown or other
  misc_feature (440)..(440): n is a, c, g, or t
  modified_base (598)..(598): a, c, t, g, unknown or other
  misc_feature (598)..(598): n is a, c, g, or t
  modified_base (679)..(679): a, c, t, g, unknown or other
  misc_feature (679)..(679): n is a, c, g, or t
tcagcgagagataccacgaccggtgctcgatttagtgtcgtcgcaagagagagggggtctgggagaggagcccagcactagaagtcggcgtgtttccattcggtgatcagcactgaacacagagactcaccagtggtagtttgggctggagtccgttgggttttcctcgttgcctttagttttaaggnggttcgtccagtgtcgaggtgacctaacgtgggaggtacggtcggtagggggacgtcggttacggtacccaggtcccggtaggggaccggttcccctaggaccgtaccgttccgtcccgtagtacccgacgtcccttcgtacggtcctttacctaccctttactacgtttacctagtccgganacgtgaccgtacggtcggggtacccaccgtagaccgtccgaggtcggaggggctagggtcgttaggggntaccgttagtttacttacgattagtagtaagtaggaaaagttggtacttactttcgttaagtccgaaacgttcccgtacggtaggaacgggttacctacgttaccccgtacgtcctacgtagaaccgtacttacgtccgaacggtcccaacgtccgtnttaacgtactaccgtagaacctaaagtcgaacgttacgaccgttagacgacgtacgcggtaacgtccggtacgttacggtnttaccgtaagtttcccgaaggtacgtaaataacgttacgtttaagagttaagggtggttaacccggg

SEQ ID NO: 244165 - DNA, 935 bp, Homo sapiens
  misc_feature: GYAE6OF01C8DLA.11.71.G05.1.454.CMB.1.raw
tcagcgagagataccacgaccggtgctcgatttagtgtcgtcgcaagagagaggggtctgggagaggagcccagcactagaagtcggcggtgtttccattcggtgatcagcactgaacacagaggactcaccatgggtagtttgggctgagtcgttgggttttcctcgttgtcttacgtttttaaaggaggttcgtacccgtaggttgtccgaagggttgaccgaaacggttggggaaggtaggttacccggtgggggacggtccggttcgggttacccgaggtcccggttaggggaccggttcccccgtaggaaccgtacccttccgttcccgtagtaaccgtacgttcccgttccgtaccgggttccctttacccgtaacccctttacttaaaccgttttaaccccgtaagtaccgggtacccgtaagttaccggtcccggtaaccggttaccggggtcccccgacccgtaacggtacccgtaccgggaacgggccgggtaagggggtccgttaagggggtacgggttcgggggttaccggtaaccgtttaacgtttttaacgtttctaaagtttaacgttacggtaaggttaaaggtaaaaacggtttggttaccgttaaacgttttccgttaagtttaacccggacgtttaacccttaccgggtaacgggtaacgggtacccgtaccgtttaccgtaccgtacccgtaccgtaacgtaacgtaacgtaacccgttaccgaaccgaccgtaaccgaccgtacgttacgtacttacgtacgtaacgtaaacgtactaacgtaccgtacgtacgtaggacgtacgtacggaccggacgtaccgtcggttaacgttagtttaacgttaggttacccccggttaagtaacggttaaacgttaacgttaacgttaacggtaggtacggttaaacggg

SEQ ID NO: 244166 - DNA, 611 bp, Homo sapiens
  misc_feature: GYAE6OF01BSYV7.11.71.G05.1.454.CMB.1.raw
  modified_base (485)..(485): a, c, t, g, unknown or other
  misc_feature (485)..(485): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagtcgttgggttttccctcgttgcttcgttttaagaggtgtccagtgtcaggtgcaactggaggagtcgtgggggagcgtggtccagccgtgggacgtccctgacgactctcctgaccacgcctcgtggccttcaccttctattacctagtcggcatcgactacgtcgggtcccacgagacctccgaggcgagggggctgggaggtgggtggtactagttattcatagtgagtagaatgtagtacttatattcgagtaccgtcggtaggacggtactacttacgaccgtctacccgaagacgaactacgtccgagaccacacgtctagtactcgtanacctaagacgaacgagtccgagacgagtacgacgaccggtaacgcggtacgttaggttactttaacgttcggtagtaggaaccgttaaagttacgtttaacgtagtaacgggtcggttaaccgggg

SEQ ID NO: 244167 - DNA, 523 bp, Homo sapiens
  misc_feature: GYAE6OF01EV0VY.11.71.G05.1.454.CMB.1.raw
  modified_base (205)..(205): a, c, t, g, unknown or other
  misc_feature (205)..(205): n is a, c, g, or t
  modified_base (299)..(300): a, c, t, g, unknown or other
  misc_feature (299)..(300): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (423)..(423): a, c, t, g, unknown or other
  misc_feature (423)..(423): n is a, c, g, or t
tcagcgagagataccacgaccggtgctcgatttagtgtcgtcgcaagagagagggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaancgcccaccctctcctgcagggccagtcagagtgttaacagctactagcctggtaccaacagaaacctggccagactccacggctcctcatctannancncatccaaccagggccactcggcaccccagccaggttcagtggcagtggggtctgggacagacttcactctcaccatcagcagcctagagcctgacggtatttgtactagttttattacngtcagcgtagcgtatcgactggactcaccgttcggaccaacgggacacggaactacggaaataacgaacgtgtcggctgcacgtatctatcttcatcccg

SEQ ID NO: 244168 - DNA, 709 bp, Homo sapiens
  misc_feature: GYAE6OF01ACJBU.11.71.G05.1.454.CMB.1.raw
  modified_base (186)..(186): a, c, t, g, unknown or other
  misc_feature (186)..(186): n is a, c, g, or t
tcagcgagagataccacgaccggtgctcgatttagtgtcgtcgcaagagagagggggtctgggagaggagcccagcactagaacgtcggcggtgtttccattcggtgatcagcactgaacacagaggactcaccatggagtttgggctgagcttgggttttcctcgttgctactttttaagaggtntccagtgtcaggtgacaacgtgggaggagtcggtggggagcgtggtccagccgtgggtacgtccctgacgtacctctcctagtacacgcctcgtggtccttcaccttcacttacctatggacctagtcactacggtcgggtcccaccacgacctccgtacggggacgagggggtccgtagggtggtggggcgtacgtagtttactttcgaattagtagtagttaacggaaagtttggtaacgtacctttacgttattaccgagttaacccgttccgggtaagggtaaccggtccgtaacgtttccccgacccggttcaaccccggttaaggaaccgttaactaaccgtttaccggaaggtaccctaaccggaccgtcgttaacgtacgttaccgtacggaacctaaagtacggaaccgacgtaccggtagaacggtacgtacgacggacggtaccgaggttcccgttagttcgtaacgttgacgtgtaaacgtaagttactttaggaagtcgggtaggtacgg

SEQ ID NO: 244169 - DNA, 662 bp, Homo sapiens
  misc_feature: GYAE6OF01A7MH8.11.71.G05.1.454.CMB.1.raw
  modified_base (272)..(272): a, c, t, g, unknown or other
  misc_feature (272)..(272): n is a, c, g, or t
  modified_base (371)..(371): a, c, t, g, unknown or other
  misc_feature (371)..(371): n is a, c, g, or t
  modified_base (391)..(391): a, c, t, g, unknown or other
  misc_feature (391)..(391): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggttgtccagttgtcagggtgctaacgtgggaggagtcggtggggggaggcggtggtccaggcccgtggggagtccctgacgactctcctgtacngcctctggcttcaccttcatttacctatggcatgcacgtcggggtccgccagacctccgaggcgagggggctgggagtggggtgctagtttattcattntgatggaaatgtgtactttntacttcagtacctcggtaggaacgggccgtacttcgacccgttctaccgtaagaacgaacctaacgttacccgagggacccaagaccgtcgttagtacgttactggaacctaaagtacgaaccgtacggaccctaggacgtaacgcgttacgggaacggacccgtacggtccgttaggttacggttaactttaacggtggtaacggaacggtaaaagttacgttttacgaagttaaggggacggttacgggtaacgggttaacccgggggg

SEQ ID NO: 244170 - DNA, 635 bp, Homo sapiens
  misc_feature: GYAE6OF01A4WB9.11.71.G05.1.454.CMB.1.raw
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagcctaccctgttctttgtctccgaggggaaacgcgccaccctctcctgcagggccagtcagtagtgttaacagtctattacgccgtaggtaaccaacagaacctggaccacgacctccgagcctcctctatctatgatcgacacgtaccaacgcggccactcggaccacccgagccgtaggtcaggtcggcgtaggtcggtcgaggactagtactcactctaccactagtacacgtcacgtaccgtagacgtcgtacggtagttacgtttgtactttagttttaactacgttagtacgtacggtactacggtacggtactcgtaacgtacggtactaccgtaccgttacggaaccgaacgggtccaacgggtaacgtaacggttaaaaccgttaaacggtaacgttggtaccggcttccgacctaacgtacgttcgttaagttccttacctccgttccccg

SEQ ID NO: 244171 - DNA, 925 bp, Homo sapiens
  misc_feature: GYAE6OF01B2DWR.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgttgggttttcctcgttgcttacgttttaagaggtgtccagtgtcaggtgcaacgtggaggagtcggtgggggagtcgtggtccaggtccgtggggacgtcccgtggacgtactcgtcctgtaccacgtccctcgtcggtccttccacctttactactttacccgtagtcggtcagttcgaccgtaccggttccggggtccccaccgtaacgacccgttacccggaagggccggtaacgggggggtccttagggggtacgggttcgggggttacggccgttaaggttttacgtttcgaagtttacgtaggggtaagttaagggtaaaacgttcggttacggttaacccttttacgtaacgtttaccgtaaacgggtaccctttacccggggtaaggggtaacccgggtacccgttaaccgtttacccggtaaccccggttaccgtaacccggtaaacgggtaaaccgtaaacccgttaaacgtttacccccgggaaacgggtaaccccgtaaccggtaacccggttacgttaaccgggtttaacttacccgttaccgggtaaaaccgttaaaacggttcccggtaaaaccggtaccggttaccccgtaagggttaacccggacggtaaccgggttaacgggaaccggtaacccggttaccggggttacccgttagggttaacggttaacgttttaccgggtacggttaacgggaaaccggttaaacgtttacgtttacggtaaacggttagggggttaaccggttaaccggggg

SEQ ID NO: 244172 - DNA, 787 bp, Homo sapiens
  misc_feature: GYAE6OF01CW2U1.11.71.G05.1.454.CMB.1.raw
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
  modified_base (201)..(201): a, c, t, g, unknown or other
  misc_feature (201)..(201): n is a, c, g, or t
  modified_base (277)..(277): a, c, t, g, unknown or other
  misc_feature (277)..(277): n is a, c, g, or t
  modified_base (345)..(345): a, c, t, g, unknown or other
  misc_feature (345)..(345): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatgggagtttgggctgagcttgggttttcctcgttgcttacttttaagnggtntccagtgtcagggtncgaactgggaggagtcggtgggggagcgtggtaccaggccgtggggacgtccctggagtactcctccgtgtaaccngtccctcgtggtccttccaccctttcaactttaccctaagtggtaccatcgtcaccggtcgggtcccnccgaagtacccgtccgacgggtcggaggggggtccgtaggggaggtcggggtacggcctaggttttaacttcgtaagttaagtacggaagtagggtaaaattacggtgttaaccgttcgtttaacttacgacggtacccgttccgggtaagggaaccggggtccctaacgtttcccgtaaccgttacccgtacccgtaacgaacgtaaccgtaaccgttacccgaggtaacccgaaccgtacgtaccgtacgttaactacgtacggtaacctaaacgtaccggtaaaccgtacgtccgtaaggtaacgaccggtacggttaacggacgggtaaacccgtacgggtaccgttagggttacgtttaacggtttacggtacggttacgggaaaccgttaaaaggttaccttttaggtaaaggtcggtaaggggttaaacccgggg

SEQ ID NO: 244173 - DNA, 564 bp, Homo sapiens
  misc_feature: GYAE6OF01BP477.11.71.G05.1.454.CMB.1.raw
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagccgtggggacggtccctgacgactctcctgtacagcctctggcttcaccttcattacctatggcatgcacgtcgggtccgccagactccgaggcgaggggctgggagtgggtgctagttattcatatgatagaaatgtgtacttctattcagtactcgtagaacggcgattccaccgtctcgagacgactaagttccaggccaacaccgtntcgtactcngacaaatgaacgagtctagacgagcgtaggaggaccgaacggtcttaggttagttaacgttcgtaggttacgaacgtaaagttactttacgtagtaggtagggttaccggg

SEQ ID NO: 244174 - DNA, 628 bp, Homo sapiens
  misc_feature: GYAE6OF01ASMB4.11.71.G05.1.454.CMB.1.raw
  modified_base (310)..(310): a, c, t, g, unknown or other
  misc_feature (310)..(310): n is a, c, g, or t
  modified_base (602)..(602): a, c, t, g, unknown or other
  misc_feature (602)..(602): n is a, c, g, or t
tcagcgagagataccacgaccggtgctcgatttagtgtcgtcgcaagagagaggggagaggctgaggaggaggctccaggaggctattccaaggcaggggttccgggccctggggctgaagggcgccgaccctatgcagtgtctggcccctctgctgcacagaagaaaagggccttggagggcagagggcaggctatgaccagggccctgggcaagtcaggcccactcacgtaggggaggccatgctggagcggcagggtcaggggcttcgaggggctcggggacccaccagaacgccatctgacgaacngtcgtccatggtcaagccaggcacccataaaacggcgtaggacgtcggggacctaagtcggggcagtggacgtccggtaccgtggacgggtggaccaccggtagtcgggaccaggagcgtaggacggccaagcgtaaggacgacctacgtcggaactggtacgccgtacggtacccgtccccgggtacaacggggaccacggaacggaccggtccgacgttaccgggacccgtggtccgtcggccccggaccgcccccgtctacccgaggccttacggccggtacggggtcncccgtaggccgaaggaccgggacccg

SEQ ID NO: 244175 - DNA, 994 bp, Homo sapiens
  misc_feature: GYAE6OF01A8ZE0.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccagtggagtttgggctgagtcgttgggttttcctcgtttgtctttacgtttttaaaggaggttcgtcctaggttgttaccgaagggttcgactaaacggtgggaggtaggttcggtggggggacggtcgtcggtaccgaggtccgtggggaacggtccctaggacgtaccttcgtcctaggtaaccacggtcccttgtcggtcctttaccgtaacccttttaccgaacttttaacccgtaaggttcggtacctaagttccggaccgtaaccggttccgggggttaccccgacccgtaacggtaaccccgttcccggaacgggggtaccggggaacgggggggtccgttagggggtaacggggtttcgggggggttacggtaaccggttaaacgttttttaacggttttacccgaaaggtttaacggtttaggtaaaacgggtttaaggggttaaaaaacgtttcgggttaacggtttaaaccttttaccggttaaactttaccgggaaacgttaacccggttaccgggtaacggggtaaaccgggtaccccgttaacgtttacccgtaaccccggtttccgtaaccgaaaggtaaccgtaaaccgtaacggttacccgaacggacctaaaccggtaccgttacgttacggttaacttaccgttaacgaaaaccgtaaagtaccgaaaccgtacgttaccggtaaggaacggtacgacggttacgggaaacggtaccgtaccgggttacgttacgggtttaacgtttaacggttacgtaagggttaacggaaaccgtttaaaggttacctttttaagggtaaggtaacgggtaacggttacggggtaaccggtttaacccgggggg

SEQ ID NO: 244176 - DNA, 813 bp, Homo sapiens
  misc_feature: GYAE6OF01CZXE4.11.71.G05.1.454.CMB.1.raw
  modified_base (389)..(389): a, c, t, g, unknown or other
  misc_feature (389)..(389): n is a, c, g, or t
  modified_base (722)..(722): a, c, t, g, unknown or other
  misc_feature (722)..(722): n is a, c, g, or t
tcagcgagagataccacgaccggtgctcgatttagtgtcgtcgcaagagagagggggtctgggagaggagcccagcactagaagtcggcggttgtttccattcggtgatcagcactgaacacagacggactcacatggtagtttgggctgagtcgttcgggttttcctcggttgtccttacgtttttaaggaggtcgttccgagttgtcgaggtcgacaacgtgggaggagtcggtggggggacgtcggtcggtccgaggtccgtggggtacgtcccgtaggacgtaccttcgtaccgtagtacgtacgtccctcgtcggtccttacctacccttactaaccttaccgttacgtcggactacgtcgtaccgtaccggtccgggtacccncccgaacgtaccctaccgggagggtaccgggacgggggtcttagggggtcggttcggggtaggtaccgttaggtttactttacgtaagttacggtaggtaacggttaagttaaacgtaggtacgtttactttactaccgttacgtaaccggtaccgtcgggtaacggggtaccggtaccggtaccgtttaccgacccggtttaccctacgtacgtaacgtaaccttaaccgttaccggtacggtaccacccggacgtcctttacgtaactcgtaacgactaaacgtcgaaaccgtcgagttacgacggacgtacggacgacggtacgtacggngtttcgtaaccgtttagttaccggttaggtaacccttaaagggtttaaacgttacttttaaggtaacggtagggttaccggtaaccggggg

SEQ ID NO: 244177 - DNA, 789 bp, Homo sapiens
  misc_feature: GYAE6OF01EBHAI.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgttgggttttcctcgttgtccttacgttttaagaggttgtccagtgtacaggtgacaacgtggaggagtcggtgggggacggcgtggtccaggccgtgggacggtccctgacgacttccgtcctagtacacgtcccgtcgtcggtcctttaccctaccctttaccgtaactttaaccgttagtcgggactagtcgtaccgtaccggtccggggtaccccgacccgtaacggacccgtaccggacggggtccgggacggggggtcgtgggggtagggttgggggtacggtacgttaagtttactttacgaattagtaggtaagtaaggtaaacttagggtacttaacctttacgttaacgttcgaaaccgtaccggttaccgggtaggggtaaaccgggtacccgttacgttacccgaccggttaccctaccgaacgtaaacgtaaacgttaacccgttaccggaacggtaccctaacgtacccgtaccgttacgttaactccgtaacggaaacctaaagttacggaaccgtacggtaccgtaggacgtacgcgtaaggacggtaccgacggtcgttagttaagttacgttcggagtacgtaacgtaaagttacttagtaaggtacggtggtaaccggg

SEQ ID NO: 244178 - DNA, 668 bp, Homo sapiens
  misc_feature: GYAE6OF01AVFSZ.11.71.G05.1.454.CMB.1.raw
  modified_base (320)..(320): a, c, t, g, unknown or other
  misc_feature (320)..(320): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtgggaggagtcgtggggggagcggtggtccaggcccgtggggacggtccctgacgactcctcctgtacagcctcgtggccttcaccttcacttacctatggcattcgctacgtcgggtcccnccgtacgactccgaggcgagggggctgggaggtgggtggactagtttattcgatatgagtagaaagttgtagtactttctatccgagtaccgtccgtagggacgggtccgtactccgtaccgtacctaccgacgaacgacctaagttacccgaggtccaaccgtacgtacgttagtaactccgtagtacctaaacgtcgaaaccgacgtacccgtaagacgtacggcgtaggaacgggtccgtacgggtccgttaggttacggtttagttaccgtaggttacgtaacccggtaaagttacttttacgaggttaagggtaagggttaccggtaacgggtttaccggggg

SEQ ID NO: 244179 - DNA, 710 bp, Homo sapiens
  misc_feature: GYAE6OF01CWG73.11.71.G05.1.454.CMB.1.raw
tcagcgagagataccacgaccggtgctcgatttagtgtcgtcgcaagagagaggggggaggaactgctcagttaggacccagagggaaccatggaagccccagctcagcttctcttcctcctgctactctggctcccagataccaccggagaaattgtgttgacacagtctccggcaccctgtctgcgtctccgtaggggaaacagtcaccctctcctgcagggccagtacaaaatattaacaactactagcctgtaccaacagaacctgccaggctccaggcctcctcatctatgatgctatttaggacggccacgtggacactccccaccgtaggttcaggtcggcgtaggtcgggttcgtcggggacacggtaccttcgtatttccgacctacccacgttcccgacgacgtacccgtaaggacgtaccgttaggtaacgtttaaggttttttacgacgtttaaagtttttaactttaaccgttacgttacctaaccgtacgggtacgtaacggaccgacggtaccgtaccgggtcccgttaccgggacccggttacgggttacccgggaaccggtaaacggggtaaccgtaaaggggtacggtaacggtaaccggaacggtaaccggaacgttgggtacgggtctacggacccgtacctacgttcgttcgttcctttacctaactttccccgttcccgtacgtaccg

SEQ ID NO: 244180 - DNA, 893 bp, Homo sapiens
  misc_feature: GYAE6OF01A7766.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccagtggagtttgggctgagtcttgggtttttcctcgttgtcttagtttttaaggaggttgtccgaggtgtcgaggtcgacgaacgtgggaggtaggtcggtgggggaggcggttggtccaggccgtaggggacggttccccgtgacgtaccttcctccgtagtaccgagtcccttcgtcggttccttaccctaccctttcgtaacttaccgtagttcggacctagtcgactaccggttcggggtcccaccgtacgtaccgtccgagggtccggacggggggtctaggggtacgggttgggtacggtacgttaaggttttacgttacgaagtttacgtaggtaaacgtttaaggggtaaatttaacggttaccgttaaccgtttttacgttaacgtttaccggaaacggtttaccccgtttaccggggtaacggtaaccggggtccccggtttaactttaccccggtaaccccgtttaccgtaaaccccgtaacggggtaaactaaacccgttaaacccggttaacccgaaccggttaaccccgaaccgttacccgggttaaccttacggttttaactaacccgttaagaaaccgtaaaacgttaccgaaacggtccgttaacccgtaggaaccgggtactacgggacgggtaacgggtaacccgtacgggttagtaccggtttagtttaaacggtccggttaggtaaccggttaacggttaaactttagttaacgaagggttaagggtacggttaccgggg

SEQ ID NO: 244181 - DNA, 793 bp, Homo sapiens
  misc_feature: GYAE6OF01AQN6S.11.71.G05.1.454.CMB.1.raw
  modified_base (216)..(216): a, c, t, g, unknown or other
  misc_feature (216)..(216): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgttgggttttcctcgttgcttcttttaagaggtgtccagtgtcaggtgcaacgtggaggagtcgngggggagcgtggtccagccgtgggacggtccctggacgtactccgtcctagtacacgtcccttcgtcggtcctttaccgaccctttacgtactttacccgtaatcggactagtacggcctacggtcggggtcccaccgacgacctcccggaagggccggagggggtcgtcgggtaggtggggtacggcttaggtttactttcgaagttagtcggtaagttaagggtaaacttagggttcgttaacgtttccttaagtttaccgaacggttaccgttacggtaaggggaacggtccgtactttaccgaacccgttcgtaaccgtaaggtacgaaacttaacgttccgaacggtaccgtaaccgacgtccgttagttactccgtaacgtaacgaaacgtacggtaaaccgtcggtaccgtagaacgtacggtacgtacgggaacggtaaccgtacgggttaaccgttacgggtttacggttaacctttaacgggttacggttaaaccgggtaacggtttaaaaccggtttaacgttttaacggtaaaccgtttaaggggtaacgggtttaacccggggg

SEQ ID NO: 244182 - DNA, 778 bp, Homo sapiens
  misc_feature: GYAE6OF01CS1H4.11.71.G05.1.454.CMB.1.raw
  modified_base (759)..(759): a, c, t, g, unknown or other
  misc_feature (759)..(759): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccagtggagtttgggctgaggtcgttggttttccgtcgttgccttacttttaagaggtgtcctagtgtcaggtgacgaacgtgggaggtagtcggtgggggaggcggtcggtccaggccgtggggacggttccccgtgacgtacctccttcccgtgtacgacgtcctgttcggtccttacctaccctttactaacctttacccgttaagtcggactacgttcgcgtaccggtcggggtcccgccgtaacggtcccgtaccgacgggccggtaacggggggtccgtagggtacggtggggtacggtacgttaggttttacttacgtaagttagttaggaaacggttaggtaaagttacgttacggttacctttacgttaagttaccgtaacgtacccgttaccgggtacgggtaaccgggtacccgttacgttacccgtacccggttaccctaccggtaacgtaacgtaaacctacggttaaccgacgtaccgaaccgtaccgtacgttacgtaacgtctacgtaaactaaacgtaaccgaacgtacgacgtaggacgtacgtacgtagacggtacgtcgtagttacgttagttcgtagtggtacgtaagtaagttaacgtcgtaagtacggnggtacggtaggttaccggg

SEQ ID NO: 244183 - DNA, 740 bp, Homo sapiens
  misc_feature: GYAE6OF01EW4NT.11.71.G05.1.454.CMB.1.raw
  modified_base (292)..(292): a, c, t, g, unknown or other
  misc_feature (292)..(292): n is a, c, g, or t
  modified_base (428)..(428): a, c, t, g, unknown or other
  misc_feature (428)..(428): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccagtggagtttgggctgagtcttgggttttcctcggttgtcttacgtttaaggaggtcgtaccgagttgtcgaggtgaccgaagtggaggtacgtcggtagggggacgtcggtgtccgacggtccgtgggtacgtccctggagtcctcctcgtcgtaacncgtccgtcgtcggtccttcctaccgttctaacgttacctagtcggtacagtcgacctacggttcgggcccgtacacggtcctacccggagggacggacggggtctacggggtggtacgggtcggattaacggtttnttacgtagtaggtaggtaagtaagtaaacgttcgtacgtactttaccgtagttaaccgtagtacccgttacggacgggttacgggaccttacgttacccgaacgttcctacggaacgtactaaccgtacgtaccgacggcctaacgcgttacgtgtacctagtcgtaaactaagtccaaacggttaccgacgttagaacgggtcgacgtacgggtacggaacccgtcggttagttaccgtaggtttaacctttggaacggttagttaaacgttaccgtttataaccgttagggacggtacggggttaacggg

SEQ ID NO: 244184 - DNA, 1006 bp, Homo sapiens
  misc_feature: GYAE6OF01DCWAQ.11.71.G05.1.454.CMB.1.raw
tcagcgagagataccacgaccggtgctcgatttagtgtcgtcgcaagagagaggggggaggaactgctcagttaggacccagagggaaccatggaagccccagctcagcttctcttcctcctgctactctggctcccagatgcaccggagtaattgtgttgacacagtcctccacgccctaccctgtttctttcgtcctaccgaaggggaacgacgccctacccttcctccgttggaccggacggggaccctaacggtccgaaggtaacggttaacgttttaaaccacggttaccctttaaccgtttaccggtacccgttaccgggtaaaccctaaaaccgaacggtaaaaccctccggggaacccctaaccggttaccccgtaccccggtacggtacccctttcccctaaccgtacttaccgtttaagtacggtacgttacgaacccgtacgtaaccccgtaacggaacccgggtccctaaccgtccccgggtaccccaacccccgtacggttaccccggttacgggttaccgtacggggttacgggaaccggttagggggtttccgggggtacggttaacgggtacttaaaccgggttaccctttaccctaaccgtttcccgtaaccctaaccggttacggtacccgaacggtaccgtaacccgttccgttaaacggggtaccgtttaccgtagggtttaacccggttttagttttaacggttaccgtttttaacgggtttttaccttaaccgggttcgtaaccgtaacggttcgtaaccgttaccggttaagtttcccggtaaggttaccggttaccgtacccggttaccccgggttacgtaaacccgggaccggttaaccggaacccggtttaaacggaaaaccgggtttaaaaaccttaaaccggggttacgttccgggttaacgttcccgtaccgtaacccgttacttaccggttttcccgttaagttttcccctttaccgtccccttttaacccccggg

SEQ ID NO: 244185 - DNA, 953 bp, Homo sapiens
  misc_feature: GYAE6OF01D2LQ4.11.71.G05.1.454.CMB.1.raw
  modified_base (161)..(161): a, c, t, g, unknown or other
  misc_feature (161)..(161): n is a, c, g, or t
tcagcgagagataccacgaccggtgctcgatttagtgtcgtcgcaagagagaggggagaggctgaggaggaggctccaggaggctattccgaaggcgagggggttccggggccctgggggctggaacgggccgccgaccctatgcagtgtctcggcccctntgctcgcacgaaggaaaggaaaacgggccgttgggacggcgaaggagggcacggctagtacggaccgacgggcccgtagggacaaacggtccgaacgggcccccaacgttacgaacggtaggggggacggaccctagtcggtccgtagggacggcgggacggacggggtacggaggggtccgttacgggacgggggtccgtaccgggggaaccccaacgaaggaaccgccgtacgtacgacggaacgaacgtagtacgtaccgacggtcggtacgaacggccgacggacctaaaccgaaagtaaacggcggtagggacgggtaccggggacgtaacggcgggactacggtacgacggtcccgttaccggtaggaccgggttccggaaccgtaccgggtacgtacgggaccgtagggtaaccgaccgggttacggaaccggtaaccggaaacggttaccgaacgggtaaacggtacccggttaacgggttaccgggttacggttaccgggtaccggtacccggtttacccgggtaacccccgggttacccgggaaacgggacccggttaaaccgtaaacccgggaccgggtaccgggttaccggttaacccgggttcccggtaacccgggttccggggtacccgggttaccccggaacccccgggtccccccgggtaccccccgttaacccgggttaacccggggtcgggtcccgggttaccgggccgggttaacccggggttcgtaacccccggtaggggaaccccggtaaacggggacccgtaaccccggg

SEQ ID NO: 244186 - DNA, 644 bp, Homo sapiens
  misc_feature: GYAE6OF01ARC58.11.71.G05.1.454.CMB.1.raw
  modified_base (166)..(166): a, c, t, g, unknown or other
  misc_feature (166)..(166): n is a, c, g, or t
  modified_base (204)..(204): a, c, t, g, unknown or other
  misc_feature (204)..(204): n is a, c, g, or t
  modified_base (604)..(604): a, c, t, g, unknown or other
  misc_feature (604)..(604): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacanagtctccagccaccctgtctttgtctccgaggggaaanacgccaccctctcctgcagggccagtcagagtgttaacagcttacttacgcctaggtaaccaacgacgaaacctggaccaacgtacctcccgaggtcctcctcattcctagtgactcgcactaccgaacgcgggacccacgtcggcccaaccccgagccgtaggttcaggtcggcgtagggtgggtcgtagggactagtcttaccacgttcctacgacctagtacacgacacgtacctagaccgtcgtaggtaacgttatttggactttaggtttacttcgtgtacgagtcgtaggtcgtacgtcggtactcggacttacccgtaccgttaaccgacggaacggtacctacggtaaacgttaaggaaaaacgttacgtaacggtggtacggttccgtacnccgaaccgttcttccgtacgttacttcctccgttaccccg

SEQ ID NO: 244187 - DNA, 862 bp, Homo sapiens
  misc_feature: GYAE6OF01A52YK.11.71.G05.1.454.CMB.1.raw
  modified_base (204)..(204): a, c, t, g, unknown or other
  misc_feature (204)..(204): n is a, c, g, or t
  modified_base (254)..(254): a, c, t, g, unknown or other
  misc_feature (254)..(254): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctccagatagcaccggagaaattgtgttgacacagtctccagccacctgtctttgtcctaccgaggggaaanacgccctaccctctcctggacgacgggccaggtcaggtagtagttaaacnggtacttaacttacggaccgtacgggtaaacccaaaacgtaacggtaaaaacccgttcgggacccgaacggtaacccgttaccccgaacgggtcccttaccccgttaccgtaaacttacccgttaagttaacggtaacgttacgggaacctaaccttaaccccggtaaaaccggaccgggggtaacccgaaccggttccgggaaaccccgtaacccccgaacggttaacccggtaaacgggttacgtaacggggtacggaccgtaaggggttcgggggttacgtagggggaacctaagggtacccttacgaccttaccgtaccaacctacgtcgtaacgcaaccgtcctaaggacgtaccggtaaggtaacggttaagtttccgtaacgttaacgtttttacgttaacgtcggttaacaaggtaccgtaagtaccgttaacggtacgtaacggtaggtaccttaccggaaccgtttacggaaccgggtaaacggacgaaacccggttaagtaaacggtaaaaacgttaaaccggtacggttacgggacgtccgttacgaaccctaactacgttaaccgttagttacccttacgtacccgttaccccgg

SEQ ID NO: 244188 - DNA, 621 bp, Homo sapiens
  misc_feature: GYAE6OF01EESZY.11.71.G05.1.454.CMB.1.raw
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgtaacngctacttagcctggtaaccaacagaaacctggaccagacctccaggtctcctcatctatgatgcactccaacgagggccacgtcgacccaccccagcctaggttcaggtcgcgtaggtcggggtcgtaggggactaacggtccttcactctaccacctagtccagtcaacgccgtagacgtcccgtggtaacggttattttacgacttaaggttttacttacgtcgtactagtcaggtcgttactacgtacgtggtactccgtaccggttcggaccgaacgggaccacggtaacgtacggtaaaacttaaaccggaacgttggtacgggtcctacggtaccctaaccgttactaccgttgtttactttccacgtttaccccg

SEQ ID NO: 244189 - DNA, 821 bp, Homo sapiens
  misc_feature: GYAE6OF01B1U7T.11.71.G05.1.454.CMB.1.raw
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcacatggagtttgggctgagcttgggttttcctcgttgcttacgttttaaggaggttcgtccagttggtctaaggtnacgtaacgtgggacggagtcggtaggggggagtccgttcggtccgacggccgtggggacggttccctaggacgtactcgtaccgtagtaacncggtcccttcgtcggtaccttacctaaccgtttactaacctttaaccgtagtcggtactagtacgtccgtaccggtaccgggtacccaccgtaacgacccgtacccggtacgggcgggtaacgggggccgttaggggacgggttcggggtaggtacgttaggtttactttacgaagttagtacggtaagtaagggtaaaagttacggttagttaacctttacgttaacttaccgtacggtacccgtaccgggtaggtaaccgggtacccgttacgttacctacccgtaccgtaacccgaaggtaccgtaaccgtaacgttacccgaggaacccacgtacccggtacttacgtacgtaccgtagtaaccgtaagtaccgaacgtaccgtacgtaacggacgtacgaccgtaggaaccggtaccgtaaccggttcgttaacggttacgttaacgtcggttaacggtaacgttaaaggtaaacgtttacgtttaagtaacgggtaacggtacgggttaaaccgggg

SEQ ID NO: 244190 - DNA, 650 bp, Homo sapiens
  misc_feature: GYAE6OF01DZLR7.11.71.G05.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
tcagcgagagataccacgaccggtgctcgatttagtgtcgtcgcaagagagagggggaactgctcagttaggacccagagggaaccatggaagccccagctcagcttctcttcctcctgctactctggctcccagatacgcaccggagaaatttgtgttgacactagtctcagccacctgttcttgctcgagggaancgccacctctccngcaggccagtcagtagtacgttaacacgtccttacgttacgccttaggtaaccaagaacgaaacctcggaccagtacctcccgaggtcctcctacagttctagtgactgacctactaccgaacgacgggcctacgtcggaccctacccgagtaccctagggttccaggttcggctagggtcggtctacggggactaagtccttcactcgtaccaacgtatacgacgctacgacctaagacgtccgtaggtaggttactttcgacgttagttttacgtgtactaggtctacgtcgtacggttacgtacgtcggacgttcgtaactcccgttaaccgttacgggaccgaaggtaccgtaccgtaagttaaacggtaaacttaacgtacggttgacgtcgttacaccttaaccgtcttacgtcttacgttcctacgttacccc

SEQ ID NO: 244191 - DNA, 873 bp, Homo sapiens
  misc_feature: GYAE6OF01D57FH.11.71.G05.1.454.CMB.1.raw
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagataccactggagaaatagtgatggacgcagtcctccacgccaccttgtctgtgtcgtccgaaggggaaancgcccaccctctccgngccgacgggccagtcaggtagttggtacgaccaaactaaccttgaccgttcggtaaccacgacctaacggaaaccgtcggaccgacggtccctaccccgaggtcccttccgtccgtacttccgttaagtcggtacgcctaccgtacccgaccggaccgggccgtaacgttcggtacccgtcccgacgtaccgtacggtttcgaggtcgggtacgagggttcgggtcggtaagggacgtagttaccgttacgtacccttcctaccgtaacctaacgtacgaccgtacgtaccgtccgtacgacgttaaccgttacgtaaggttaaccggttttacgtttttaccggtttaaccttttttaacggtttttttaacccgtaggttaccggttaacggtacgtttaacgggtttaacccgtttaaaccggtttacccggttacccgggtttacccctttacccgggttttaaacccggtttaacccggttttaccgggaaaccggggttaaacccgggaaaccgttaccggttaaaaccggtaaaccgttaaaaaccggttaacgaaaaacccggttacggttaaacggggtccggttaaaccctccgggtaaacccttaaccggttaccgtttccgttcgttttaccccgg

SEQ ID NO: 244192 - DNA, 749 bp, Homo sapiens
  misc_feature: GYAE6OF01A2NOB.11.71.G05.1.454.CMB.1.raw
  modified_base (170)..(170): a, c, t, g, unknown or other
  misc_feature (170)..(170): n is a, c, g, or t
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (598)..(598): a, c, t, g, unknown or other
  misc_feature (598)..(598): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggcctcccagatacgcgaccggagaaattgtgttgacacngtctccagcccaccttgtctttgtctccgaaggggaaacncgcctacctctccngcgacgggccagtcaggtagttacgttaacgacgtcttaacgtacgccttacggtaaccaacaacggtaaaccgtcggaccaacgtacccgtacccgacggtcccttacctcgtaacttcctaagtacgtaactcggacctaacctaccccgaacgggtaccgggacccaacgggttccggaaccccaaccccggtagtaccccgttaagggttccgtaacggtcgggaccggtaacggggtttcggggtaaccgtacggggaacccgttacgtacccgttaccgtaccgtacctaaccacctacgtaccaacggtcctacggtaccgtagccgtaacggtggtacgttattcggtattactttatcggtcganacgtctaacgggtctaagtccgtacggtacgaccctcgtaacccggttgaaccggacgtaacgacgtaaagttaaaccggaaacttaacgacgtcgggacgtactaccgtaacctacgttacgttacttacgttcctacgtccgtaccccg

SEQ ID NO: 244193 - DNA, 718 bp, Homo sapiens
  misc_feature: GYAE6OF01BH2XH.11.71.G05.1.454.CMB.1.raw
  modified_base (198)..(198): a, c, t, g, unknown or other
  misc_feature (198)..(198): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccacctgttctttgtctcgagggaancgccacctctcctgcgacgggccagtcagtagtagttaacagtcttacttagcctacggtaaccaacgaacgtaaaccgtcggaccaacgaccctcccgacggtcctacctacacttctatcggtaatcgacctaaccgtaacccgaaaccggacgggtacccaacggtccggacccctaacccccgacggtacccgtaacgggtttaccgaacgggtcggtaccggtacggggttcggggttaccggtaacggggtaaccgtaacggttaccgtttaacccgtacccgttaccctaccgtaaccgtactaccgacggtaccgacgtaccgtaagtaccgtcgttaggtacggtttgtttcgacgtttaacggtttcttacgtcggtacagccgtacgtcgtaacgtccgtagtgtacctccgtaccgtacggaacgtacgacgacgtaagtaacgtaaacttaacgtacgtcggacgctacgactacgtcttacgtcttacgttcctacgtcccttccg

SEQ ID NO: 244194 - DNA, 862 bp, Homo sapiens
  misc_feature: GYAE6OF01A5FV3.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatcggaggtttcgggctggagcttgggttttcctcgttgccttacttttaagaggtgtccagtgtcaggtgacaacgtggaggagtcgtgggggaggcgtggtccagccgtgggacgtcccgtgagacctctccgtgtacacgcctcgtgtcttccgaccttcattaccctatcggcctagtcgaccgtacgttcggggtacccaccgacgtaccgtccggtacggggccgggaacggggggtccctaggggtacgggttcgggggttaggtaccgtttaagtttacgttttaccgaagtttaggtacggtaaggtttaacggtaaaacgtttaggttacggttaaccttttacgaaccttttaccggaacggtaacccggtttcccgggtaaagggtaaccggggttacccgttacgtttaccccgtacccgggtttaccctacccggtaagggtaacccttaaaccggttaaccgttacccggaaccggacgaacccggttaccgtacccgtttaaggttaacccttacggtacgtaaaccgtaaaacgttaccgaaaccggttaaccgaccggttacggaacggttacggttaaccggaacggaacgggtaaccgtaccgggtttcgtagggttaacgtttaccgtttaggtacggttggtaaaacccgttaagttacctttacgtaacggttacgggaggtttaccggggtaaccgggttaccggggg

SEQ ID NO: 244195 - DNA, 785 bp, Homo sapiens
  misc_feature: GYAE6OF01BN0O9.11.71.G05.1.454.CMB.1.raw
  modified_base (191)..(191): a, c, t, g, unknown or other
  misc_feature (191)..(191): n is a, c, g, or t
  modified_base (412)..(412): a, c, t, g, unknown or other
  misc_feature (412)..(412): n is a, c, g, or t
  modified_base (425)..(425): a, c, t, g, unknown or other
  misc_feature (425)..(425): n is a, c, g, or t
  modified_base (441)..(441): a, c, t, g, unknown or other
  misc_feature (441)..(441): n is a, c, g, or t
  modified_base (478)..(478): a, c, t, g, unknown or other
  misc_feature (478)..(478): n is a, c, g, or t
  modified_base (518)..(518): a, c, t, g, unknown or other
  misc_feature (518)..(518): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccagtggagtttggctgacgtcgttgggtttttcctcgttgtactttacgttttaaaggnggttcgttccaggttcgtacgagggttcgaccgtaaacgtggggaaggtacggttccggggtaggggggacggtccggttcgggttcccgaacggtcccgggttaggggtaaccggttccccgttaggaccgtacctttcccttaccgttacgtaccgaccgtcccttcggttccggttcctttacctacctttctaactttacctattcggctatcgtcncggttcgggtccnccgaccgttacgccgnggcggcgggcgtgggtggtgggtgcttacgtttactntagtagtagtagtaaggtaaacttgtacgttaccttagtnttacgacgtacgtcgtaggtacggtctacgttcaccgttcaccgaagtactaactaccgttacgacgacgtaacgtcgtacgttacgtacgtacgtacgtaacgtaagaaccgtaacgtcgtaccgttacggaagtacgtaccggaacggtacggaccgtacgggtttacgtacggtttagtttaaacggttccgtacgggttaagaaccggttttaaacgttacgttttaaaggaagggtttaaaccgggtaggggtttaaccggg

SEQ ID NO: 244196 - DNA, 723 bp, Homo sapiens
  misc_feature: GYAE6OF01BF53E.11.71.G05.1.454.CMB.1.raw
  modified_base (182)..(182): a, c, t, g, unknown or other
  misc_feature (182)..(182): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtntccagtgtcaggtgcaactggaggagtcgtgggggagcgtggtccagccgtgggacggtcctgacgactctcctgtacacgcctcgtggacttcaccttcattacctatggcatgcacgtggtcccgcacgactccgaggtccgagggggctgggaggtgggtacgtcgtagtttagtttcagtaagtggtaagtaagggtaaactaggttacgtaacctttacgttaactttaccgtaacggtaaccgttccggtagggaacgggtacccggttaacttaccgaacccggttaccgtacccgtaacggtaacgtaacgttaaactttacccgaacgggtaccaaccgtaccgtaccgtttacggtaattcccggtaagtaacctaaacggttacggaaactacggacccgtaggaaacggtacgtacgacgggaaggtaccgtaccggtacggttacgtaggtttaaccttaaaggtcggttaacgaaccgggttaaaacgtacgttttaacgtaaacgttagggtaaggggtaaccggg

SEQ ID NO: 244197 - DNA, 958 bp, Homo sapiens
  misc_feature: GYAE6OF01CG653.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggacctcaaccagtggtagtttgggctgagtcgttgggttttcctgttcgtcttacgtttttaaaggaggttcgtaccgtaaggttgtaccgtaagggttcgaccgtaaacggtgggaggtaacggttcggggtaggggggcggtccggtggtacccgaggtccggtggggacgttcccgtaggacgtaccttccgtccgttggtaccacggtcccttacggtcggtaccctttacctaccctttactaaactttacctaggtcggcctatccgacctaccgggtcgggtcccaccgtaacgtacccgtacggacgggtaccgggaagggggtcctggggaagggttcgggtaacggtccgtttaagtttaccgtttactaaggtacttaggtaaagttaacgggtaaataccgggttactttaaccgtttagttaacccgttacggtaaaccggttacccgtttaccgggtaacggggtaacccggtaccgttaaccgttaaccccggttaccccgtaccgttaacccggaaacgttaacggtaaccttaacgttccccggtaaaggtacccctaaactccggtaccgtttaacggttacttaccggtaactaaaccgaaaacggtttaccgaaaccgtacccgggtaacgtaaccgggtaacgggtacccggttagaaacccgggggtacggtaaccccggtaaacggttacggtttaacggttaaccggtttacggtttaaaccggtaccgggttaaactaaacgggtttaaaacgtttccgggttttaaacggtaaggttaaccggggttacggtttaaacccggggggg

SEQ ID NO: 244198 - DNA, 787 bp, Homo sapiens
  misc_feature: GYAE6OF01CSB2D.11.71.G05.1.454.CMB.1.raw
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggcctcccagatgcaccggagaaattgtgttgacacagtcctccggccacctgtcgtgcgtcctccgtacggggaaactacgtccaccccgtctccgtgcgacggaccctaagtactaaaattacttaaacctaaaccttacttacgtcccgttacggttaccaaaccgtacggaaaacccttcggaacccgtaggtccctacccgacggtccttcctacctagtacctaagttgactagtacgtttaacggttaacgggaccggtacccgacggttcggaccctaccgtcccccgtaaccggtacggttacgtacggtcgggacgtagggtccgggtacgtcgggtaacgtaggttaccttcgtctttaacccnccgtaaccncgttacgccgtactacccgtagacgtaccgtaagtaagtttcgttagactttagtttaacgttactacggtacacgtacggttagacggcgtaacgaccgggttcccggaccgtacgggtacccgttacggttaacccggaaccggtacgggaacgttaacgggtaggacttacggaaccgtaccggtacgtcggttacggcccgtaatccgtaacccgtagttacccttacgggttcctaaccgttaccctaccccgtttcccgccttaaaccgg

SEQ ID NO: 244199 - DNA, 845 bp, Homo sapiens
  misc_feature: GYAE6OF01CGRMD.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagtcgttgggttttcctcgttgtcttcttttaaggaggtcgtccagtgtcgaggtgactaacgtgggaggtaggtcggtgggggaggcggtcggtccacggtccgtaggggaccggtccctggacgtacctccgtccgtcgttaaccgcgtcccttcgtcggttcccttcctaacccttacgttacctttaaccgtagtggcctacgtcgaccgtaccggtccgggtccccgaccaacggtaccctacccggacgggtacgggacgggggtccgtgggggtagggttcgggggtcgtacgttaacggtttacgtttacgaagttagtacggtaagtaacggtaaagttcgtacgttaacctttagttacttaccggaacgttaccgtccgggtaagggtaaccggtcccgtacgttacccgtacccgtcccgttaacgaaggtaaccgtaaccgtaaccgttaccgacggtacctccgtaccgtcgttaacgtacctaggtacgtaaccgtaaacgtaccgtaacgtccgaccgttagacggtacggtaacgtacgggaaccgggtaacggtaccggttacgtttacgggttaactttaacgggttacccggttaacggttaacggttaaaccgggttaacttttaaccggtttaaccggttaaggttaacccggggtacgggtttaaacccggggg

SEQ ID NO: 244200 - DNA, 854 bp, Homo sapiens
  misc_feature: GYAE6OF01DACE3.11.71.G05.1.454.CMB.1.raw
  modified_base (167)..(167): a, c, t, g, unknown or other
  misc_feature (167)..(167): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
tcagcgagagataccacgaccggtgctcgatttagtgtcgtcgcaagagagaggggggaggaactgctcagttaggacccagagggaaccatggaacgccccagctcagcttctcttcctcctgctactctggctcccagatagcaccggagaaattgtgttgacanagtctccagccacccttgtctttgtccgtaccgaagggaagtaccgccctacccgtctcctgccgtacgggccagtcgaagtagtcgtaacagtaccttacgtacgccgtacggtaacaacgaacggaaccgtcgaccgaacgtaccctaccgagtccttccactntaccttagtctacgngtacctaactaccccgaacggacccggggacctacggtacccggtacccaacccccggtacgtacccggttacggttaccggagggttaccggaccgttaaggggttccggggtaccggttaaggggaccttaaccggccctttaccaaccctccggttaaccccaaacttacccgagtacccgaacgtacccgtaccgtaacggaccgtaccgttaggtacggtttacgtttacgtaccgtttaaaggtttttacgttacgtttacgaccgtaacggtttacccgaacgggtttacgttaaccggtaacgtttaccggtacgtttaaaccgttcccgggtacccgtttaacccggggaaccgtttaaccggggacccctaaacggtaaaccggtaaacggttaaacgttaaacccggtaacggtttagggaccgggtccctacgggttacccaaccgggttaccttaccgtttaccggttacttacccgttcccgttaaccccgg

SEQ ID NO: 244201 - DNA, 878 bp, Homo sapiens
  misc_feature: GYAE6OF01AX26E.11.71.G05.1.454.CMB.1.raw
  modified_base (213)..(213): a, c, t, g, unknown or other
  misc_feature (213)..(213): n is a, c, g, or t
  modified_base (272)..(272): a, c, t, g, unknown or other
  misc_feature (272)..(272): n is a, c, g, or t
  modified_base (849)..(849): a, c, t, g, unknown or other
  misc_feature (849)..(849): n is a, c, g, or t
  modified_base (871)..(871): a, c, t, g, unknown or other
  misc_feature (871)..(871): n is a, c, g, or t
tcagcgagagataccacgaccggtgctcgatttagtgtcgtcgcaagagagaggggggaggaactgctcagttaggaccagagggaaccatggaagccccagctcgacgcttctcttcctcctgcctactctcggctcccagtatacgcaccggagaacttggtgtgacacagtctccagaccacctgttctttgtctaccgaaggggaaacncgtacctaccctcgtccctggaccacggggcctagtctaaggtacgttacgttaaaacncgtccgttaacttaaccggccttagggaaaccctaacgtaaccgtaaaccggttcggacctaacggtacccttaccccggaagggtcccctttacctacgtaaaccctttaccgtaacgtacgtaacggtttacgaaccttaacccggtacccgaaaccggtaaaccggggttccccgaaaccgttaccggaacccccgtaacccgtaaacccggttaccccggtttaacgggttacctaaaccgggggttcccggtaaaccgtaaccggggggtacggtttaaccccggaggggtaaacccccgttaaggtaaccctttacccgaacccgtttacccttaaacgaacccggttaacggtaacccttaaccgggaccgtaaccgtaaccggtaaccgtacggtaaccgggtttacggaacggtttaacttttacgggaacgtttaacgtttaaccttacggtacgttaacgacggtaccgttaaggtccgttaacgtaccgtacgtacggtactaccggttaccttacggaaccgtaggtaccacggtacgtacgtaaacgtaccgatacgtagacncgacgtactacgtctatccgtntacgtcc

SEQ ID NO: 244202 - DNA, 846 bp, Homo sapiens
  misc_feature: GYAE6OF01A81I8.11.71.G05.1.454.CMB.1.raw
tcagcgagagataccacgaccggtgctcgatttagtgtcgtcgcaagagagaggggggggagaggagcccagcactagaagtcggcggtgtttccattcagtgatcagcactgaacacagaggactcaccagtggagtttgggctgacgcttgggttttcctcgttgcttacttttaagcggtcgtccagtcgtcaggtgccaacgtgggacggagtcggtgggggacgcggtcggtcagtccgtgggacgtccctgacgtacctctacctgtacagtcctgtggtccttccgacctttcaactttacctacgtcggactacgtacggcctaccgggttcgggcccggaacctaacggtaccgtacccggaaggggccgggtaacggggggtaccttaggggtaacgggtttacgggggtacggtaaccgttaaaggtttttaacgtttaccgtaaattaacggttacgggtaaagttaacgggtaaaaactttcggttaacgttaacccgttttaaccttaaacgtttacggaaacggtacccggttacccggttaacgggtaaccgggggtcccgttaacttaccccggtaacccggttaaccgttaccccgtaaaaggtaccgtaaacccggttaaacggtttaccccgaaccgggttaaaccaacccggtaaccgttctaacggttacgtcgtaaccgaacgtaaacgtagaacccgtggacccgtaaggacgacgtacgacggacggtaccgaccgtggtttacgtaagttccgtttaaggcgtaacgaaaggttaacgttaacgtttacaagggttaggtacggtacgggttaaaccggg

SEQ ID NO: 244203 - DNA, 837 bp, Homo sapiens
  misc_feature: GYAE6OF01CNLWF.11.71.G05.1.454.CMB.1.raw
  modified_base (166)..(166): a, c, t, g, unknown or other
  misc_feature (166)..(166): n is a, c, g, or t
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
tcagcgagagataccacgaccggtgctcgatttagtgtcgtcgcaagagagaggggggaactgctcagttaggacccagagggaaccatggaagccccagctcagcttctcttcctctgctactctggctccagatagcacggagtaaattgtgttgacacagtcnccacgccctacctgttcttgtcctacgaagggaanacgcccaccctctccngcgacgggcctagtcgaagtagttagtaaacngtacttacgttacgaccgtacgtaacccaaacgtaacggaaacccgtggacccgaagtacccgtcccgacggttccctaccgtactacgttaccttaagtaggactacgtaccaccgtaaccgaaccggtaaccggcccaacgggtccgaccccgacccccgtaacggtcccgtaacgggttccgaacgggttcgggacgtacgggggttccggggtacggttaccgggaacctaacgttacccttaccgtaccctaccgtaccctaaaccgtcctaccgaccgtaccgacgtaaccgtacggtaccgtacggtagggtaacggttttagttttaccgacggttttaaagttttaccgttaccggttaggttaccgtacggtaaccgttacggtaacgtttaaccgggtacggttaaccggtacggttaacccgttaccccggttaccgggttaaacccggaacccggggtaaacggacccgtaaacggtaacgtaaaccgggttaaaaacgtacgtacggtcgggtacgtacctcggaccctaacgttctaccgttcgtttaaccctcgttaccgttaccccgtccg

SEQ ID NO: 244204 - DNA, 741 bp, Homo sapiens
  misc_feature: GYAE6OF01A652S.11.71.G05.1.454.CMB.1.raw
  modified_base (152)..(152): a, c, t, g, unknown or other
  misc_feature (152)..(152): n is a, c, g, or t
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
tcagcgagagataccacgaccggtgctcgatttagtgtcgtcgcaagagagaggggagaggaactgctcagttaggacccagagggaaccatggaagccccagctcagcttctcttcctcctgctactctggctcccagatagcactggaanaaatgtgatgacgcagtctccagccacctgtctgtntcncgaagggaagcgccacctctccgngacgacggccagtcaagtgtggttaggacactaacgttacgccgtacggtaaccgagacgaacgaaaccgtcggacccgtaggccctaccgacggtccctccgtacctattaccgttagtcggtacacaccgtaccgaacccggtacgggtccctaaccggtttccggttaccccacggtcccgtacggttaccgaggtcgggtcgtagggttcgggtcctaggacgtacgacgttcgttaccacgttacccgtacaccgtactaccgaaccgtccgtcgtacgtacgtacgtaacggtaacgttagtttacgtaacgtttacgttttacttaccgttacggtactaagttaccgtaagttaaacgttaacgttaacggttaccggtaccgtttaccgggaacggttaccgggaacccggtaacgggtacgggttaaacgggtaacggtaaacggtaaaccggtaacgtaacggttcggtaccgcgttaccgaaccttacgtacgttcgttaccgttcctacccgg

SEQ ID NO: 244205 - DNA, 768 bp, Homo sapiens
  misc_feature: GYAE6OF01A6825.11.71.G05.1.454.CMB.1.raw
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (365)..(365): a, c, t, g, unknown or other
  misc_feature (365)..(365): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctaccgagggaanancccacctctcctgccagggcccngtaccagagtagttaacngtcttactacggcctcggtaaccaacaggtaaacctggccaagacctcccaaggccttcctacactcttatgacttggcctaactcccgaacgaccgggccacgtcggaccaccccganacccgaggttccaggtcggccagggtacgggtactgggaccaggtacctttacgacctcctacgaaccctatacgacgccgtaggacccgttaaggcggacccgttagggtaacggtttacgttttacggaacgtttaacggttttaactttaacggttcggttaccgttaacgggcctaggttaacccgttacggttaccgggttacgttaacgggttacctttaccccgtaaccccgggtttcccggggtaaccggtaacgggtaaccgtaaacccggttaacggtaaacgtaaaaaccggttaaaccgtaacgggtttaccgggtacggggttaccctaggtacccgtaaaccctacgttacgttacccggtttacctttcccgttaacgttccccccgg

SEQ ID NO: 244206 - DNA, 767 bp, Homo sapiens
  misc_feature: GYAE6OF01A32Y5.11.71.G05.1.454.CMB.1.raw
  modified_base (188)..(188): a, c, t, g, unknown or other
  misc_feature (188)..(188): n is a, c, g, or t
  modified_base (236)..(236): a, c, t, g, unknown or other
  misc_feature (236)..(236): n is a, c, g, or t
  modified_base (335)..(335): a, c, t, g, unknown or other
  misc_feature (335)..(335): n is a, c, g, or t
  modified_base (731)..(731): a, c, t, g, unknown or other
  misc_feature (731)..(731): n is a, c, g, or t
tcagcgagagataccacgaccggtgctcgatttagtgtcgtcgcaagagagagggggtctgggagaggagcccagcactagaagtcggtggtgtttccattcggtgatcagcactgaacacagaggacctcaccagtggtagtttgggctgagtcgttgggttttcctcgttgtcttacgttttaagnggttgtccgtagtgtcgaggttgacacgtggaggagtcggtagggggngtcggtggtccgacgtccggtgggacggtcccgtgacgtactccgtccgtagtacacgtcctcgtacggtccttccgtaccttctacttactagtcgcngtctacgtacgtcggtccacgtacgacctcggacgggtacggtaggggtcgtagggtagggtccgggtaggtaccgttaggtttaccttacgtaagttcggtaaagtaaggttaggtaaacgtttcggtaactttactttacgttacttacggtacgtaccggtaccgtaggtacgggtaacccgttacgttaccccgtaccgttaccctaaccggaacgtaactaacgtaccgtaccgtaacgtaccgtaccgtaccgtacgttacgttactacctacgttaacgacgtaaccgtaaccgtctacggtacgacgtaccgacggtacgaaccggtaggtacggtcgttaacggttacgttacggttaccggttacgtacggtaacgttaaacgttntttaaccggtaagttacgggtaaggttaacccgggg

SEQ ID NO: 244207 - DNA, 727 bp, Homo sapiens
  misc_feature: GYAE6OF01A3294.11.71.G05.1.454.CMB.1.raw
  modified_base (180)..(180): a, c, t, g, unknown or other
  misc_feature (180)..(180): n is a, c, g, or t
  modified_base (601)..(601): a, c, t, g, unknown or other
  misc_feature (601)..(601): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcttgggttttcctcgttgcttcttttaagnggtgtccagtgtcaggtgacaacgtggaggtagtcggtgggggagcgtggtccaggccgtgggacgtcccgtgacgtctcctccgtgtaccacgtcctcgtcggtccttcctaccttactactttaccgtagtcggacctagtcgccgtacggtccggggtccccaccgaacgtacccgtccggaagggccgggacggggggtcctggggtagggttcggggtcggtacgtaaggttttactttacgagttaagttaggtaagtaagggtaaattcggtagtacctttctaagttaccgaggtacccgtacggtacgggaaccggtccttaacgttccaacctcgtaccctacgaagtaaccgtactaacccgttaacgaaacgtaaccgacggttactacgtactaccgaactaaagtanaaccgacgtccgtaaggagtaccggaccggtaggacccgtacggtgtaccggttagttaccgttagacgggtaacggaacgggtaaacgggaactcggacggtacgacggtcgggaccgggtaggg

SEQ ID NO: 244208 - DNA, 810 bp, Homo sapiens
  misc_feature: GYAE6OF01BX0KD.11.71.G05.1.454.CMB.1.raw
  modified_base (203)..(203): a, c, t, g, unknown or other
  misc_feature (203)..(203): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacaggaggactcacctagtagggtgtttgggctaggagtccgtttggggtttttccctcggttgtcctttacgtttttaaaggnggttcgtcccgtaggttcggtccgagggttacaccgtaacggttagggagggtacggttccggggtaggggggacggtccggttcgggtcccgaacgggtcccggtagggggtaccggttcccccgaggtaacgtcccttccgtacccgttagtaccgaccgtcctcggtaccgtccttcccgttaccttactactttaccgtgtacggactacgtcggaccgtaccggtccgggtcccctaccgaccggtacctcggggaaccgggtccgggaaggggggtcttacgggggaggttcggggtgtccgttaagttttagttaccgtaagttacgtaggtaaggttaagtaaacggttagtttaccggtacttttacgtaacgttaccggacgttaccgggttcgggtacggaaccggtcgttaccgttacgacccggtacacgtacgactaacgtaccgtccgacggtaccacgtaccgtctatactcgtaagaccgtaagaccgtagtacgacgtgtaacgagtacgtaggaccgtcgtacggttcgtcgtatcggtttacgaggtagttaacgtcgttacgttagtaaggtggtcgggtaacggg

SEQ ID NO: 244209 - DNA, 728 bp, Homo sapiens
  misc_feature: GYAE6OF01B16IN.11.71.G05.1.454.CMB.1.raw
  modified_base (163)..(163): a, c, t, g, unknown or other
  misc_feature (163)..(163): n is a, c, g, or t
  modified_base (181)..(181): a, c, t, g, unknown or other
  misc_feature (181)..(181): n is a, c, g, or t
  modified_base (269)..(269): a, c, t, g, unknown or other
  misc_feature (269)..(269): n is a, c, g, or t
  modified_base (344)..(344): a, c, t, g, unknown or other
  misc_feature (344)..(344): n is a, c, g, or t
tcagcgagagataccacgaccggtgctcgatttagtgtcgtcgcaagagagagggggtctggagaggagcccagcactagaagtcggcggtagtttccattcggtgatcagcactgaacacagaggactcaccatggagtttgggctgagcttgggttttccncgttgcttcgttttaagnggtgtccagtgtcaggtgctaacgtggaggagtcgtgggggagcggtgtccagccgtgggacgtccctgacgtactctccgtgtaccngtcctcgtggtccttccgacccttctaagtttacctatgggcctaacgttcgactaaccggttcggggtaccccnccggtaagacccgttccggaagggccggtaacgggggtcccgttaggggtacggttgggggtaccggtacgttaacggttttaactttccgaaagtttacggtagtaagttaacgggtaaaacgttggtacgtaacgttttcgttaacgtttacggaacgttacccgttacgggtaaggtaacggggtcccttaaacgttccgaaccggttccgtaaccgaacggaactaccgtaaacgttccgaacggtacccgtacgaccgtatttacgacttcgtacgaccgtaaagtccgaaacgtcgtactggagaacgtcgagtacggtaccgcggtgtacgtgttactgtacgtgtaaaccgtaattacgttatagtaggagtacgg

SEQ ID NO: 244210 - DNA, 835 bp, Homo sapiens
  misc_feature: GYAE6OF01A8BQ2.11.71.G05.1.454.CMB.1.raw
tcagcgagagataccacgaccggtgctcgatttagtgtcgtcgcaagagagaggggggaggaactgctcagttaggacccagagggaaccatggaagccccagctcagcttctcttcctcctgctactctggctccagatagcacggagaaattgtgttgacacagtctccagcccaccctgttctttgtctaccgaaggggaaagacgcccaccctctccgtgcgacgggccagtcagtagtacgttaacagtcttacttagccgtacggtaaccaaacgaacgaaaccgtcggacccacgaccgtacccaggccttcctactactcttatagatcgactacgtaccgaaacggaccgggtaccctacgtaccgggaccccaacccccgacggacccgttaacgggtttccgaagggttcgggtaacgggtacggggtttcgggggttacccgtaagggggaacccgtaagggttacctttacccgaacgtttcccttaaccggaaaccctacgttaacccacgtacccgtaccggtacgtaacgggaccgtaccggttacggtaagggtttacgtttttacgtaacgtttaacgtttttaagtttaacctggtaccgtacgtcgtaacgggtacccgtttaacgtcccggttaagtacggtacccgttacccgttaacccggttacgggaacccgggtaaacgggtaccgtaaaccggtaacggttaaaacggtaaaaaccggtttaaaaccggtacggttaggtacggtacgtaccggaaaccttaccgtacggttccttaccgtttaccttcgttaacccgtttaccccgg

SEQ ID NO: 244211 - DNA, 744 bp, Homo sapiens
  misc_feature: GYAE6OF01EKYMG.11.71.G05.1.454.CMB.1.raw
  modified_base (162)..(162): a, c, t, g, unknown or other
  misc_feature (162)..(162): n is a, c, g, or t
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
  modified_base (388)..(388): a, c, t, g, unknown or other
  misc_feature (388)..(388): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctccagatagcaccggagaaattgtgttgacanagtctccagccacctgttctttgctaccgagggaaancncctacctctccngcnggcagtcagagtntaacngctacgtagcctagtaaccaacaacgtaaacctggaccgtacgacctaccgaggtcctcctnactctatgactcgactacgtaccgaacggacggtaccacgtccgacccaccccgacgtaccgtaggttacaggtcggacgtagggttcgggngtacggggacaacgtaccttcgaccttcgtaccacgtactaccgacgccgtaacgtacctaaggaccgtccgtaagggttaaggtttaacgtttttcgtagttaactttttaacgttcgttacgttacccgtaagtaccgtaaggggttaccgttaaccgggtacgtaacggtttacggaaccggtttacccggttaacccgggtttacccgggaaaccggtaacggggtaacccgtaacgggtaacgtaaaaacgttaaaacggtaaaccgtagttccgggtacggtacgtacaccccggtaacttacgttccggtaacgttaccctttacggttaccctttccccgtaacccgg

SEQ ID NO: 244212 - DNA, 497 bp, Homo sapiens
  misc_feature: GYAE6OF02FKXHT.11.71.G05.1.454.CMB.1.raw
  modified_base (202)..(202): a, c, t, g, unknown or other
  misc_feature (202)..(202): n is a, c, g, or t
tcagcgagagataccacgaccggtgctcgatttagtgtcgtcgcaagagagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggatttgctagtttattactgtcagcagcgtatcgactggatcaccttcgccaagggacacgactaggaattaacgaactgtagctgcacatctgtcttctatccg

SEQ ID NO: 244213 - DNA, 596 bp, Homo sapiens
  misc_feature: GYAE6OF02H5SOR.11.71.G05.1.454.CMB.1.raw
  modified_base (258)..(258): a, c, t, g, unknown or other
  misc_feature (258)..(258): n is a, c, g, or t
tcagcgagagataccacgaccggtgctcgatttagtgtcgtcgcaagagagagggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaanagaaacctggccagactcccaggctcctcatctatgatgcatccaacagggccactggcacccagccaggtcagtggcagtgggtctgggacagacttcactctcaccactacgacgacacgtaccgtagaccgtcgtaggtaaggtttagtttcgacgtttaagtttttaactttacgttcgttacgagtacgtacgtacgtacgtacgtacgtaggtactaccgtaccgttccggaaccgaacgggacaacgtacgtaaggtaaacgttaaccgtaacgttggtacgtacgtcgaccgactacgttcgtacgttcctactaccttcccgttccccg

SEQ ID NO: 244214 - DNA, 498 bp, Homo sapiens
  misc_feature: GYAE6OF02IKDWJ.11.71.G05.1.454.CMB.1.raw
  modified_base (200)..(200): a, c, t, g, unknown or other
  misc_feature (200)..(200): n is a, c, g, or t
  modified_base (491)..(491): a, c, t, g, unknown or other
  misc_feature (491)..(491): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagccctgaggattttgctagtttattacttgtcagcagcgtatcgactggatcaccttcggccaagggcacgactggaattaacgaactgtggctgcacatctgtctcntctcccg

SEQ ID NO: 244215 - DNA, 502 bp, Homo sapiens
  misc_feature: GYAE6OF02INMOR.11.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (481)..(481): a, c, t, g, unknown or other
  misc_feature (481)..(481): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacngctacttagcctggtaccaacagaaacctggccagactcccaggctcctcatctatgatgcatccaacagggccactggccaccccagccaggttcagtggcagtgggtctgggacagacttcactctcaccatcagcagcctagacgcctgaggtatttgctagtttattactgtcagcagcgtatcgactggatctaccgttcgaccgaaggacacgactaggaaacttaacgactgngctgcacatctgtcttcatcc

SEQ ID NO: 244216 - DNA, 618 bp, Homo sapiens
  misc_feature: GYAE6OF02JPYH0.11.71.G05.1.454.CMB.1.raw
  modified_base (234)..(234): a, c, t, g, unknown or other
  misc_feature (234)..(234): n is a, c, g, or t
  modified_base (305)..(305): a, c, t, g, unknown or other
  misc_feature (305)..(305): n is a, c, g, or t
  modified_base (473)..(473): a, c, t, g, unknown or other
  misc_feature (473)..(473): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgtggtttcgcgtagcgtctttaagaggtgtcagtgtcaggtgcaactggaggagtcgtgggggaggcgtggtccagcctgggnggtccctgagctctcctgacagcctcgtggcttcaccttcattacctagtggctatgcacgtggggtcccncgacgacctccgaggcgagggggctgggtaggtggggtcggacgtagtttattcgagttagtgtaagtacggtaaattagtcgtactttacttagttcgtaagtacgttccggtaggaacggtccgtagttaccgaccgtctcgaagtacgaactactacgacgcacncgtctagtactcgtacgacgtaacgtcgaacacgtaccgtagaacgtacgtcggtaagaacggaccgtacggtacgttcggtaagttacgttacgtaggtacggtaacgtaaaggttactttaacgtaaggttaggtaggtacgg

SEQ ID NO: 244217 - DNA, 513 bp, Homo sapiens
  misc_feature: GYAE6OF02I676D.11.71.G05.1.454.CMB.1.raw
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctggggaggtccctgagactctcctgtacagcctctggcttcaccttcattacctatggcatgcactgggtccgccagactccaggcagggggctgggagtgggtggcagttattcatatgatggaaatagtgacttctattcagactccgtgaagggccgattcaccgtctccagagacaattccaggcacacgctgtatctgacaaatgaacagcctgagagctagaggacacggctgtgtattactgtgacgtaagtattactataggaggtgacgtacggggg

SEQ ID NO: 244218 - DNA, 512 bp, Homo sapiens
  misc_feature: GYAE6OF02HS3MS.11.71.G05.1.454.CMB.1.raw
  modified_base (486)..(486): a, c, t, g, unknown or other
  misc_feature (486)..(486): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcacgcctagagcctgaggtatttgctagtttattacttgtcagcagccgtatcgactggactcaccgttcggaccaagggacacgactaggaaattaaacgaacttggnggctgcaccatcctgtcttcattccc

SEQ ID NO: 244219 - DNA, 585 bp, Homo sapiens
  misc_feature: GYAE6OF02HG9RG.11.71.G05.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (293)..(293): a, c, t, g, unknown or other
  misc_feature (293)..(293): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
tcagcgagagataccacgaccggtgctcgatttagtgtcgtcgcaagagagagggggaacgtgctcagttaggaccagaggaaccatggaagcccagctcagcttctcttcctcctgctactctggctccagatagcaccggagaaattgtgttgacacagtctccagccaccctgtctttgtctccaggggaaanagccaccctctcctgcagggccagtcagagtgttaggancaacttagcctggtaccagcagaaacctggccaggctccaggctcctcatctatggtncatccacaggccactgttccagcagtcagtgcagtggtctgagcagngttcatctnaccatcgaacgctgcagtctgaatagtttgcgtagtttattaactgttactagcaagtactaaataacgtaggtcctacgggtacgttcgtaccgaacgggtaacccgtaaagggtacggtaaacgtacgtaaaccgtaaacgtaacggttacggaaccggttaggaccgttaaacccgaacgttacgtaaccggttctttaccgtaacgttacctttaccccgaccgttaacccg

SEQ ID NO: 244220 - DNA, 524 bp, Homo sapiens
  misc_feature: GYAE6OF02IYI01.11.71.G05.1.454.CMB.1.raw
  modified_base (425)..(425): a, c, t, g, unknown or other
  misc_feature (425)..(425): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggaggcgtggtccagcctgggaggtccctgagactctcctgtacagcctctggcttcaccttcattacctatggcatgcactgggtccgccagactccaaaggcgagggggctgggagtgggtggcagttattcatatgatggaaatagtgacttctattcagactccgtgaagggccgattcaccgtctccagagacaattccaggcacacnctgtatctgacaaatgaacagcctggagagctgaggacacggctgtgttattactaggtgacggaaagtatttactataggaggttgacgttacggggg

SEQ ID NO: 244221 - DNA, 669 bp, Homo sapiens
  misc_feature: GYAE6OF02F7J8T.11.71.G05.1.454.CMB.1.raw
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaacgtggggagtcgtggggagggcggtggtccgacgccgtcgggaggtccgtcgagactctcctcgtacacgccgtcctgcgttctaccttctacttacctactggcgatgcacgtcgggtccgcccacgactccgacggcgacggggcggtggaggtggggtgggcgtagtttagtttactatagtgtagtaggtaaagtagttgtacttacttattactagtacgtccgtaggaacgggccgtacttcctacccgtccttcgaacgagaactaacgttaccacggaccaccacgtcttgttatctcgactaaatacgaacacgtcctaggaagacgcgtacggaagggaacccgacgggtcgttaggttagttaacgttttaccgtaggttggaacccggtaaaaaggtttacttttcttaagggtaaagggtacggggttacggtaacccggggttaccggggggttaccgg

SEQ ID NO: 244222 - DNA, 498 bp, Homo sapiens
  misc_feature: GYAE6OF02F4SQS.11.71.G05.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaanagccacctctcctgcagggccagtcagagtgttaacngctacttagcctggtaccaanagaaacctggccagactcccaggctcctcatctatgatgcatccaacagggccactggcaccccagccaggttcagtggcaggtgggtctgggacagacttcactctcaccatcagcagcctagagcctgaggtattttgctagtttattactgtcagcagcgtatcgactggatcaccttcggaccaaggacacgactagaattaacgagtgtggctgacacatctgtctcatctcccg

SEQ ID NO: 244223 - DNA, 512 bp, Homo sapiens
  misc_feature: GYAE6OF02FNQRH.11.71.G05.1.454.CMB.1.raw
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctctggcttcaccttcattacctatggcatgcactgggtcccgccagactccaggcagggggctggagtgggtggcagttattcatatgatggaaatagtgacttctattcagactcgtgaaggccgattcaccgtctccagagacaacttccagcacacgctgtactctgacaaatgaacagcctagagagctgacgacacggctgtgtattactgtgacgtaagtatttacgtagtagaggtagacgtacggggg

SEQ ID NO: 244224 - DNA, 498 bp, Homo sapiens
  misc_feature: GYAE6OF02FSF05.11.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (489)..(489): a, c, t, g, unknown or other
  misc_feature (489)..(489): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacngctacttagcctggtaccaacagaaacctggccagactcccaggctcctcatctatgatgcatccaacagggccactggccaccccagccaggttcagtggcagtgggtctgggacagacttcactctcaccatcagcagcctagacgcctgaggtatttgctagtttattactgtacagcagcgtatcgagtgactcaccttcgaccaaggacacgactagaataacgaactgtgctgcactatctntcttcatcc

SEQ ID NO: 244225 - DNA, 547 bp, Homo sapiens
  misc_feature: GYAE6OF02J15VK.11.71.G05.1.454.CMB.1.raw
  modified_base (305)..(305): a, c, t, g, unknown or other
  misc_feature (305)..(305): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtcccnccagacctccaggcagggggctgggaggtgggtggcagtttattcatatgatggaaatagtgtacttctattcagactcgtagaggccgattcaccgtctcagagacaatccagtcacgacgctgtatctagaccaaatcgaaaccagtccctaggaacgacgacgtagaacgggtaccacgggtcgtaggtcgttaagttacgtgtagacgtaaagtactttactagttaggaggttacgg

SEQ ID NO: 244226 - DNA, 512 bp, Homo sapiens
  misc_feature: GYAE6OF02GLK82.11.71.G05.1.454.CMB.1.raw
  modified_base (439)..(439): a, c, t, g, unknown or other
  misc_feature (439)..(439): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccgccagactccaggcagggggctggagtgggtggcagttattcatatgatggaaatagtgacttctattcagactcgtgaaggccattcaccgtctccagagacaattccaggcacacgctgtatctgcaaatgaacngcctagacgagctagagacacggctggtagtattacgtgtagacgtaaagtactttactaagtagaggtacgg

SEQ ID NO: 244227 - DNA, 545 bp, Homo sapiens
  misc_feature: GYAE6OF02ICZJI.11.71.G05.1.454.CMB.1.raw
  modified_base (256)..(256): a, c, t, g, unknown or other
  misc_feature (256)..(256): n is a, c, g, or t
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
  modified_base (385)..(385): a, c, t, g, unknown or other
  misc_feature (385)..(385): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacngcctctggcttcaccttcattacctatggcatgcacttgggtcccnccagacctccgaggcgagggggctggaggtgggtgctagtttnttcatatgataggaaatgtgtacttctattcagactccgngacgggccgtatcaccgtctcgagagacatccaggcacacgctgtatctagacaatcgaacacgacctgagacgcgtaggagacacggcttggtacgtacttacgtggtacgtaacgaagttacgttactagttacggtaggtacggtacggtacggggg

SEQ ID NO: 244228 - DNA, 508 bp, Homo sapiens
  misc_feature: GYAE6OF02HUX0X.11.71.G05.1.454.CMB.1.raw
  modified_base (203)..(203): a, c, t, g, unknown or other
  misc_feature (203)..(203): n is a, c, g, or t
  modified_base (483)..(483): a, c, t, g, unknown or other
  misc_feature (483)..(483): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactcccaggctcctcatctatgatgcatccaacagggccactggccacccagccaggttcagtggcagtgggtctgggacagacttcactctcaccatcagcagcctagacgcctggagtatttgctagtttattactgtcagcagcgtatcgactggatcaccttcggaccgaaaggacacgactaggaaacttaacggaacttgnggctgcacatctgttcttcattccg

SEQ ID NO: 244229 - DNA, 509 bp, Homo sapiens
  misc_feature: GYAE6OF02GNHDD.11.71.G05.1.454.CMB.1.raw
  modified_base (303)..(303): a, c, t, g, unknown or other
  misc_feature (303)..(303): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccncagactccaggcagggggctggagtgggtgcagttattcatatgatggaaatagtgacttctattcagtacctccgtgaacgggccgtattcaccgtctccagagacaattccaggcacacgctagtatctgacaaatgaacagcctagagagctgagacacggctgtgtatacgtgtagacgtaagtatttacagtagaggtacg

SEQ ID NO: 244230 - DNA, 529 bp, Homo sapiens
  misc_feature: GYAE6OF02FWUZR.11.71.G05.1.454.CMB.1.raw
  modified_base (305)..(305): a, c, t, g, unknown or other
  misc_feature (305)..(305): n is a, c, g, or t
  modified_base (406)..(406): a, c, t, g, unknown or other
  misc_feature (406)..(406): n is a, c, g, or t
  modified_base (445)..(445): a, c, t, g, unknown or other
  misc_feature (445)..(445): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtgggtccagcctgggaggtccctgagactctcctgtacagcctctggcttcaccttcattacctatggcatgcactgggtccnccagcctccaggcagggggctggagtgggtgcagttattcatatgatggaaatgtgacttctattcagactccgtgaagggccgattcaccgtctccaganacaattcccaggcacacgctgtatctgacaaatcgaacngcctggaagagcgtagacggacacgggcttggtagttattacgtgtggaaccgtaaagtactttactaagttaggaggttacgg

SEQ ID NO: 244231 - DNA, 541 bp, Homo sapiens
  misc_feature: GYAE6OF02H8HX3.11.71.G05.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (262)..(262): a, c, t, g, unknown or other
  misc_feature (262)..(262): n is a, c, g, or t
  modified_base (384)..(384): a, c, t, g, unknown or other
  misc_feature (384)..(384): n is a, c, g, or t
tcagcgagagataccacgaccggtgctcgatttagtgtcgtcgcaagagagagggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacngctacttagcctggtaaccaanagaaacctggccagactcccaggctcctcatctatgatgcatccaacaggccactggcaccccagccaggttcagtgcagtgggtctgggacagacttcactctcaccatcagcagcctagngcctgaggtatttgctagtttatactgtcagcagcgtatcgatggactccgtaccgttcggccaaagggtaccaacgtacgtacgggaaaatttaaccggaaacttggttacggacttacgacctactactaccgttacgttcttacactttccccg

SEQ ID NO: 244232 - DNA, 533 bp, Homo sapiens
  misc_feature: GYAE6OF02FYXT0.11.71.G05.1.454.CMB.1.raw
  modified_base (203)..(203): a, c, t, g, unknown or other
  misc_feature (203)..(203): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactcccaggctcctcatctatgatgcatccaacagggccactggccaccccagccaggttcagtggcaggtgggtctgggacagacttcactctcaccatcagcagcctagacgcctgagtatttgctagtttattactgtcagcagtcgtatcgactggactcgtaccgttcggaccaacgggacacggtactaggaaacttaacgaacgtagtacggactagaccacctagttccgttagtcctttacattcccg

SEQ ID NO: 244233 - DNA, 515 bp, Homo sapiens
  misc_feature: GYAE6OF02GQEEM.11.71.G05.1.454.CMB.1.raw
  modified_base (261)..(261): a, c, t, g, unknown or other
  misc_feature (261)..(261): n is a, c, g, or t
  modified_base (359)..(359): a, c, t, g, unknown or other
  misc_feature (359)..(359): n is a, c, g, or t
  modified_base (388)..(388): a, c, t, g, unknown or other
  misc_feature (388)..(388): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctntggcttcaccttcattacctatggcatgcactgggtccgcacgactccaggcaggggggctgggagtgggtgcagttattcatatgataggaaatgtnacttctatcagctcgtgaggcatcactcncagagacacttcagcacacgctgtatctgacaaatcgaacagcctagacgagcgtagagacacggctgtagtatacgtgtacgacgaagtactttacgtagtaggtacggtagacggttaccggggg

SEQ ID NO: 244234 - DNA, 668 bp, Homo sapiens
  misc_feature: GYAE6OF02I15Y0.11.71.G05.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (328)..(328): a, c, t, g, unknown or other
  misc_feature (328)..(328): n is a, c, g, or t
tcagcgagagataccacgaccggtgctcgatttagtgtcgtcgcaagagagagggggaggaacgtgctcagttaggacccagaggaaccgatggaagccccagctcagcttctcttcctcctgctactctggctcccagatagcaccggagaaattgtgttgacacagtctccagccaccctgtctttgtctccagggaaanagccaccctctcctgcagggccagtcagagtgttaacagctacttagcctgtaccaacagaaacctggcagactccaggctcctnatcgtatgatgcatccaaanaggcccaactggcccaacccngaccccaggttaccagtcggctacgtggggtccagggtacaaggtaccttacacgtctaccaaccgtataccgagacaacggacccttaacggtaaccgccgttaacgtacgggtaaacgtttttacggaccgttaaaccggtttttaatttaaaccgtttcgttaccgtaagtaccgtacggtacgttacgtacggtaccttagggtaccttaccgtacccgttccggtaacccgaaagggtaaccaacggtaccgttacggtaaaacgttaaaccgtaaccgttagttcggtaccgtacgactaacccgacttaccgtagtcctttacgactttcccg

SEQ ID NO: 244235 - DNA, 515 bp, Homo sapiens
  misc_feature: GYAE6OF02G8JIC.11.71.G05.1.454.CMB.1.raw
  modified_base (358)..(358): a, c, t, g, unknown or other
  misc_feature (358)..(358): n is a, c, g, or t
  modified_base (404)..(404): a, c, t, g, unknown or other
  misc_feature (404)..(404): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
tcagcgagagataccacgaccggtgctcgatttagtgtcgtcgcaagagagaggggggagagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggagtccctgagactctcctgtacagcctctggcttcaccttcattacctatggcatgcactgggtccgccagactccaggcagggggctgggagtgggtggcaggttattcatatgatggaaatgtnacttctattcagtactccgtgaagggccgattcaccgtctccaganacattccaggcacacgctgtatctgacaaatcgaaacagcctgagagctgagacacggntaggtntaattacgtgtgacgtaagtntttacgtataggtaggtgtaacggg

SEQ ID NO: 244236 - DNA, 523 bp, Homo sapiens
  misc_feature: GYAE6OF02FZ16L.11.71.G05.1.454.CMB.1.raw
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaagagccaccctctcctgcagggccagtcagagtgttaacagctacttagcctggtaccaacagaaacctggccagactcccaggctcctcatctatgatgcatccaacgagggccacgtggccaccccagccaggttcagtggcagtgggtctgggacagactcactctcaccatcagcagcctagacgcctggagtatttgctagtttattactgtcagcagtcgtatccgatggactctaccgttccggaccaaagggaccacgtacgtaggaaacttaaacgaactaggtacggactgacacatctgtcttacattcc

SEQ ID NO: 244237 - DNA, 625 bp, Homo sapiens
  misc_feature: GYAE6OF02HL9BA.11.71.G05.1.454.CMB.1.raw
  modified_base (366)..(366): a, c, t, g, unknown or other
  misc_feature (366)..(366): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccactggcatccccaccaggttcaggtggcaggtggtctggacagtacttcatttcncacctatccgcacgcctagacgtcctagaagtattttcgacttagttttacttactcgtacaacgacgcgttagcgacgcgacggccgtccgggcgtaccggttccgggaccggtaaacggggaaccgtaaggggtacgggtaaacggtaccgaaacgggtaccgtaacgttcggtacgggtaccgtcggacccgtaacctaacgttccgtagtttacccgttactaccgtttcccgtttaccccgtattccgtaacgg

SEQ ID NO: 244238 - DNA, 509 bp, Homo sapiens
  misc_feature: GYAE6OF02GAS0R.11.71.G05.1.454.CMB.1.raw
  modified_base (200)..(200): a, c, t, g, unknown or other
  misc_feature (200)..(200): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactcccaggctcctcatctatgatgcatttaggaggccactggcatcccacccaggttcagtggcagtgggtctgggacagcttcattctcaccatccgcagcctagagcctgaagtattttgctagtttatactgtacaacagcgtagcagcaggcctccggcgacgttcggccaagggaccaggtggaagtcgagcgaacgtggtggctgcaccatctgtcttcatccttcccg

SEQ ID NO: 244239 - DNA, 532 bp, Homo sapiens
  misc_feature: GYAE6OF02G3FQJ.11.71.G05.1.454.CMB.1.raw
  modified_base (364)..(364): a, c, t, g, unknown or other
  misc_feature (364)..(364): n is a, c, g, or t
  modified_base (397)..(397): a, c, t, g, unknown or other
  misc_feature (397)..(397): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctggggaggtccctgagactctcctgtacagcctctggcttcaccttcattacctatggcatgcactgggtccgccagactccaggcgagggggctgggagtgggtgctagttattcatatgatggaatgtgacttntatcagactcgtgaaggcatcaccgtctcaganacatccaggcacacgctgtatctgactaaatgaacagcctaggagacgcgtaggaacggacacggctggtagtaacttacgtggtacgacgtaaagtactttacgtagtaggtaggttcgaacggttacgggggg

SEQ ID NO: 244240 - DNA, 568 bp, Homo sapiens
  misc_feature: GYAE6OF02IT1ST.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggagtccctgagactctcctgtacagcctctggcttcaccttcattacctatggcatgcacgtgggtcccgccagactccgaggcgagggggctgggagtggggtgctagttattcatatgataggaaatagtgactttctattcagtactccggtaggaacgggccgtattccgaccgtctccagacgacaattccaggcacacgctgtatctgacaaatcgaaacagcctaggagagcgtaggaacggaccacggtcttaggtaggttaacttacgtggtacgacggtaaaagttcttttacgtaagtagggtaggttacgacggttacgggggg

SEQ ID NO: 244241 - DNA, 597 bp, Homo sapiens
  misc_feature: GYAE6OF02G6UHO.11.71.G05.1.454.CMB.1.raw
  modified_base (384)..(384): a, c, t, g, unknown or other
  misc_feature (384)..(384): n is a, c, g, or t
  modified_base (469)..(469): a, c, t, g, unknown or other
  misc_feature (469)..(469): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtggggggaggcgtggtccagccgtgggacggtccctgagacctctcctgtacacgcctctggcttcaccttcattacctatcggctatgcacgtcgggtcccgccagacctccaggcgagggggctgggaggtggggtggctagttattcatatgataggaaattagtgtacttntattcaagtcctacggtgaacgggccgtattccaccgtctccgaagacgaactaacttccgaggaccacacgtctgttactctanacaagtacgaacacgcctagagcgtcgaggaaggaccgacggtcttaggtagttacttacgtaggtaggtaaccgtaaaggttacttttacgtaagttaggtacgggtacggtacggttaccgggggg

SEQ ID NO: 244242 - DNA, 506 bp, Homo sapiens
  misc_feature: GYAE6OF02GCCL3.11.71.G05.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacngctacttagcctggtaccaanagaaacctggccagactcccaggctcctcatctatgatgcatccaacagggccacgtggccaccccagccaggttcagtggcagtgggtctgggacagacttcactctcaccatcagcacgcctagacgcctgaggtattttgctagtttattacttgtcagcagtctatcgactggactctaccttcggaccgaaggacacgactaggaactaacgaagtgtgctgcacatctgtctcatctcccg

SEQ ID NO: 244243 - DNA, 510 bp, Homo sapiens
  misc_feature: GYAE6OF02FQ6U0.11.71.G05.1.454.CMB.1.raw
  modified_base (300)..(300): a, c, t, g, unknown or other
  misc_feature (300)..(300): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccnccagactccaggcagggggctggagtgggtggcagttattcatatgatggaaatagtgacttctattcagactcgtgaagggccattcaccgtctccagagacaattccaggcacacgctgtatctgcaaatgaacagcctgagagctagagacacggctgtgtattactggtgacgtaagtatttctatagaggtcgacgtaccggggg

SEQ ID NO: 244244 - DNA, 571 bp, Homo sapiens
  misc_feature: GYAE6OF02FWMX6.11.71.G05.1.454.CMB.1.raw
  modified_base (150)..(150): a, c, t, g, unknown or other
  misc_feature (150)..(150): n is a, c, g, or t
  modified_base (161)..(161): a, c, t, g, unknown or other
  misc_feature (161)..(161): n is a, c, g, or t
  modified_base (167)..(167): a, c, t, g, unknown or other
  misc_feature (167)..(167): n is a, c, g, or t
  modified_base (170)..(170): a, c, t, g, unknown or other
  misc_feature (170)..(170): n is a, c, g, or t
  modified_base (172)..(173): a, c, t, g, unknown or other
  misc_feature (172)..(173): n is a, c, g, or t
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcgngttcgctagcncttaanagncnntcagncatgagntcngggagctgccagctggagtcctgagctctcctgtacagcctctggcttcaccttcattacctatggcatgcactgggtccgcagctccaggcaggggctggagtggtggcagtattcaatntganagaatgtcacttnactnagctcgtagaggcgtatctaccgtctacagacacactacgtaagaacacgtctacgtttactacgaaagtcgaacacgtcctagacgacgtaccgtaatacgaaccgtaccgggtaccgttagttaacgtttacgttacggtacggtaacggtaacggtaacggtaacggttaccggggtacccggtaaccggtaaaccggttaaaccgttaaccgtaaccgttacgttacgggtaaccgg

SEQ ID NO: 244245 - DNA, 545 bp, Homo sapiens
  misc_feature: GYAE6OF02HYTF0.11.71.G05.1.454.CMB.1.raw
  modified_base (200)..(200): a, c, t, g, unknown or other
  misc_feature (200)..(200): n is a, c, g, or t
  modified_base (307)..(307): a, c, t, g, unknown or other
  misc_feature (307)..(307): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagacctccaggctcctcatctatgatgcatccaacngggccacgtggccaccccagccaggttcagtgcaggtgggtctggggacagacttcactctcaccatcagcagcctagacgcctgaggtattttgctagtttattactgtcagcagcgtatcgactggatctaccgttcggaccaaagggacaacgtacgtaggtaaacgttaaacgaacgtcggtacggacgtcgaccaccgtacttcgtacgttccttactacttcccttaccccg

SEQ ID NO: 244246 - DNA, 525 bp, Homo sapiens
  misc_feature: GYAE6OF02GARLL.11.71.G05.1.454.CMB.1.raw
  modified_base (441)..(441): a, c, t, g, unknown or other
  misc_feature (441)..(441): n is a, c, g, or t
  modified_base (459)..(459): a, c, t, g, unknown or other
  misc_feature (459)..(459): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccgccagactccaggcagggggctgggagtggggtggcaggttattcatatgatggaaatgtgactttctattcagactcgtgaagggccattcacgtctccagagacaattccaggcacacgctgtatctgacaaatgaaacngcctgagagctagagacncggctgtgtattacgtgtgacgtaaagtattttactaagtaggtagggttacgacggttacggggg

SEQ ID NO: 244247 - DNA, 610 bp, Homo sapiens
  misc_feature: GYAE6OF02H9WJ4.11.71.G05.1.454.CMB.1.raw
  modified_base (306)..(306): a, c, t, g, unknown or other
  misc_feature (306)..(306): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctggagactctcctgtacagcctctggccttcaccttcatttacctatcggcatgcacgtgggtcccnccagacctccgaggcgaggggctgggagtgggtggctagttattcatatgataggaaatgtgtacttctatcagtactccgtagacgggctattcaccgtctaccagacgactaacttccgaggcaccgacgtctgtactcgtagactaaagtcgaaccacgacctaggaacgtacgcgtacggaacgtaccgacgggtcgttaggttacggttaactttaccgtaggtacggtaaccggtaaagttacgttttaccgtaaggttacgggtaacgggttacggtaacgggttaacccggggggg

SEQ ID NO: 244248 - DNA, 498 bp, Homo sapiens
  misc_feature: GYAE6OF02FH7XB.11.71.G05.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaangccacctctcctgcagggccagtcagagtgttaacngctacttagcctggtaccaacagaaacctggccagactcccaggctcctcatctatgatgcatccaacagggccactggcaccccagccaggttcagtggcagtgggtctgggacagacttcactctcaccatcagcagcctagacgcctgaggtattttgctagtttattactgtcagcagcgtatcgactggactcaccttcggaccaagggcacgactaggaactaacgactgtgctgaccacatctgtctcatctcccg

SEQ ID NO: 244249 - DNA, 550 bp, Homo sapiens
  misc_feature: GYAE6OF02I8XD5.11.71.G05.1.454.CMB.1.raw
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (459)..(459): a, c, t, g, unknown or other
  misc_feature (459)..(459): n is a, c, g, or t
tcagcgagagataccacgaccggtgctcgatttagtgtcgtcgcaagagagagggggctgggagaggagcccagcactagaagtcggcggtgtttccattcggtgatcagcactgaacacagaggactcaccatggagtttgggctgagctgggttttcctcgttgctctttaagaggtgtccagtgtcaggtgcaactggaggagtcgtgggggaggcgtggtccagccgtgggaggtccctggagactctcctgtacngcctctggcttcaccttcattacctatggcatgcactgggtcccnccagacctccgaggcgagggggctgggacgtggggtgcagttattcatatgatggaatgntacttntatcagactcgtagaggctatcaccgtctaccagacgactacttccgaggctaccgacgtctagtactcctagactaaagtcgaaacncgcctagagacgccgtagacgggacacgggtcgtggttacttagtaccgtggttacgacgttaaagtctttacgtaagtaggaggttacgg

SEQ ID NO: 244250 - DNA, 670 bp, Homo sapiens
  misc_feature: GYAE6OF02HGK3S.11.71.G05.1.454.CMB.1.raw
  modified_base (200)..(200): a, c, t, g, unknown or other
  misc_feature (200)..(200): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctccagatagcaccggagaaattgtgttgacacagtctccagccaccctgtctttgtctccgaggggaaangccaccctctcctgcagggccagtcagatgttaacagctacttagcctggtaccaacagaaacctggaccagactccagctcctcatctatgatcgcactccaaacacgggaccaactcggccaacccccgagcccgaaggtttccaaggtgggacctagggtgggtctaggggaacaaggtacttcactctacaaccatacacgcacgacctagacgtacctaggtaacggtattttgacttaaggttttaacttacgttagttacacgtcagtacgttagtacgtaacgtgggtaacttaccgtaacccgtttccgggaccgaaaacgggggtaccaaacgggtaaccgttaacggtaaaaacgtttaaaaccggtaacggttacggtacgggtaccttaacggacccgtaaccctaagtttcccgttacggtttaccgttttaccgtacttccccgtttaaccccgg

SEQ ID NO: 244251 - DNA, 521 bp, Homo sapiens
  misc_feature: GYAE6OF02IRUFS.11.71.G05.1.454.CMB.1.raw
  modified_base (302)..(302): a, c, t, g, unknown or other
  misc_feature (302)..(302): n is a, c, g, or t
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggtttcctcgttgctcttttaagaggtgtccagtgtcaggtgcaactggaggagtctgggggaggcgtggtccagcctgggaggtccctgagactctcctgtacagcctctggcttcaccttcattacctatggcatgcactgggtccnccagactccaggcagggggctggagtgggtggcagttattcatatgatggaaatgtgacttctattcagactcgtgaacgggccgtattcaccgtctccagacgactaatccagttcacacgctgtatctgacaaatgaactagcctagagagctgacggacacgggcttggtagttacttacngtagacgtaaagtntttacgtaataggaggtacgg

SEQ ID NO: 244252 - DNA, 535 bp, Homo sapiens
  misc_feature: GYAE6OF02HWBTC.11.71.G05.1.454.CMB.1.raw
  modified_base (202)..(202): a, c, t, g, unknown or other
  misc_feature (202)..(202): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccgggagaaattgtgttgacacagtctccagccaccctgtctttgtctccaggggaaagngccaccctctcctgcagggccagtcagagtgttaggagcaacttagcctggtaccagcaagaaacctggccaggctcccaggctcctcatctatggtgcatccaccgagggccactcggtttcccagtccaggttcaggtggcaggtgggtctggagacagagttcactctcaccatcaacggcctgcagtctagaagtatttgctagtttatactgtcagctagtataatacgtgccgtacggacgttcggaccaagggacctaaggtaggaacgtacgaaacgtacgtggtggctcgacacctagtctagtcttcacttcctcccgctacg

SEQ ID NO: 244253 - DNA, 588 bp, Homo sapiens
  misc_feature: GYAE6OF02G80B8.11.71.G05.1.454.CMB.1.raw
  modified_base (262)..(262): a, c, t, g, unknown or other
  misc_feature (262)..(262): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggagtccctggagactctcctgtaccagcctntggcttcaccttcattacctatggcatgcactgggtcccgccagacctccgaggcgagggggctgggagtgggtgctagttattcatatgataggaaatgtnacttntatcagtctcgtgacggccgatcaccgtctccagacgacaattcccaggccacacgcttgtactctagactaaagtgaaaccacgaccgtagacgacggacgtaggaacggtacgaccggtgttacggttagttaacgtttaccttgggtacgtaaccggtaaagttacgttttacgtaaggttaacggtaacgggttacggtaacggttaccgggggg

SEQ ID NO: 244254 - DNA, 603 bp, Homo sapiens
  misc_feature: GYAE6OF02JK1WH.11.71.G05.1.454.CMB.1.raw
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
tcagcgagagataccacgaccggtgctcgatttagtgtcgtcgcaagagagagggggggaggaggagccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggacggtccctgagctctcctgtacagcctcgtggcttcaccttcattaccatcggcatgctactgggtcccncagacctccagggcagggggctggaggtgggtgctagtttattcgatagtgataggaaatgtgactttntagttcagacttccggngaacgggctatcacgtctcaganactacttcacggcacgcgtactgtaatctagactaaatcgaaacacggtaccctaggaacgacgtacgtacggaagtaaccgaaccggtcgttaggttaacggtaaccttttacgtagggtcgtaaccggtaaagttaccgtttaccgttaagtaagggtacgggttacggtaacgggttaacccgggggg

SEQ ID NO: 244255 - DNA, 521 bp, Homo sapiens
  misc_feature: GYAE6OF02GKOZT.11.71.G05.1.454.CMB.1.raw
  modified_base (364)..(364): a, c, t, g, unknown or other
  misc_feature (364)..(364): n is a, c, g, or t
  modified_base (514)..(514): a, c, t, g, unknown or other
  misc_feature (514)..(514): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacacgggccactggaccaccccgagcctaggttcaggtggcaggtgggtctgggacngacttcactctcaccatcagcacgcctagcgcctgaggtatttgctagtttattactgtcagcagtcgtatcgactgtatccgacgttcggaccaagggacaacgacgtagaaacttaacgactagtcgactagacactatctgtcttcncttcccg

SEQ ID NO: 244256 - DNA, 505 bp, Homo sapiens
  misc_feature: GYAE6OF02GH9RD.11.71.G05.1.454.CMB.1.raw
  modified_base (203)..(203): a, c, t, g, unknown or other
  misc_feature (203)..(203): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactccaggctcctcatctatgatgcatccaacagggccactggcaccccagccaggttcagtggcagtgggtctgggacagacttcactctcaccatcagcagcctagagcctgagtatttgctagtttattactgtcagcagtcgtatcgactggactcctaccgttcgaccaaggacacgtacgtaggaaataacgaactagtagctgcacatctgtcttcattccc

SEQ ID NO: 244257 - DNA, 523 bp, Homo sapiens
  misc_feature: GYAE6OF02IW0GM.11.71.G05.1.454.CMB.1.raw
  modified_base (178)..(178): a, c, t, g, unknown or other
  misc_feature (178)..(178): n is a, c, g, or t
  modified_base (304)..(304): a, c, t, g, unknown or other
  misc_feature (304)..(304): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtgggggaggcgtggtccagcctgggaggtccctgagactctcctgtacagcctctggcttcaccttcattacctatggcatgcactgggtccncagactccaggcagggggctgggagtgggtggctagtattcatatgatggaaatagtgtacttctattcagctcgtgacggcgattcacgtctcagagacatcagcacacgctagtatctagacaaatgaacagtccgtagacgagcgtaggaacgacgacggctaggtgttacgtacgttgtacgacgtaaacgtgtttactagttaggaggtacggg

SEQ ID NO: 244258 - DNA, 559 bp, Homo sapiens
  misc_feature: GYAE6OF02GWHU4.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgtggttttcctcgttgctctttaagaggtgtccagtgtcaggtgcaactggaggagtcgtgggggaggcgtggtccagcctgggaggtccctgagactctcctgtacagcctctggcttcaccttcattacctatggcatgcacgtcgggtccgccagacctccaggcgagggggctgggagtgggtggctagttattcatatgataggaatgtgtacttctattcagtactcgtagaggccgtattcgaccgtctaccagacgactacttccaggtcacacgtctgtactcgtgactaaatcgaaacagaccgtagacgagcgtaggacggacacggacgtggttagttacgttacgttagtaggtaaccgtaaggttacttttacgtaagttaggtaggttacggg

SEQ ID NO: 244259 - DNA, 664 bp, Homo sapiens
  misc_feature: GYAE6OF02GXTBH.11.71.G05.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaanagcccaccctctcctgcagggccagtcagagtgttaacngctacttagcctggtaccaacagaaacctggccagacctccaggctcctcatctatgatgcatccaacgagggccacgtcggcccacccagcccaggttcaggtcggcgaggtcggggtctggggaactacggtactttccgaaccgttctaccgaccctataccgagacacgtacccgttaaggacgtacccgtaggaacggttactttcggaccgttaagttttacttaaccgtcggttacacggtactaggttaccgttaacgttccggtaaccgttgggtaaccttccgtaacccgtttaccgggaaccggaaacgggtaacccaccggtaacgtacgggtaaacttaaaccggacgttacggtacggctacggactacccgtacgttccgttacggttaccttacctacttccccg

SEQ ID NO: 244260 - DNA, 558 bp, Homo sapiens
  misc_feature: GYAE6OF02GAJLF.11.71.G05.1.454.CMB.1.raw
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggcttcaccttcattacctatggcatgcactgggtccnccagacctccgaggcgagggggctggagtgggtgcagttattcatatgatggaaatgtntacttctattcagtactcgtagaagggcattccaccgtctccagacgacaacttccaggcacacgctagtactctgacaaatgaaacgagcccgtagaacgagcgtaggacggacgacgggtactggttacgttaatttaccgttggttacggtaacggtaaagttacgtttacgtaagttaaggagggttacggg

SEQ ID NO: 244261 - DNA, 591 bp, Homo sapiens
  misc_feature: GYAE6OF02GE0NA.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagagatgtccagtgtcaggtgcaacgtggaggagtcgtgggggagcgtggtccagcctgggagtccctgagactctcctgtacagcctctggccttcaccttcaatttaccctagtggcatcgactacgtcggggtcccgccagtacctccgaagggcgagggggctgggaggtgggtgctagttattcatatgataggaaatgtgtacttctattcagtaccttccggtaggaacgggcctacgttccgaccgttcgtaccgaagtacgaactaacgttccgaacggccaacaccgtctagtactcgtagacaaagtacgaactacgctagagacgctaggacgacgacgtcgttaggtacgttagttacgtgtacgaacgtaaagttctttacgtaagtaggtaggtagtaaccggg

SEQ ID NO: 244262 - DNA, 642 bp, Homo sapiens
  misc_feature: GYAE6OF02IT6LH.11.71.G05.1.454.CMB.1.raw
  modified_base (303)..(303): a, c, t, g, unknown or other
  misc_feature (303)..(303): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctggggacgtccctgacgctctcctgtacagcctctggcttcaccttcattacctatggcatgcacgtcgggtccnccgagactccgaggccgagggggctgggaggtggggtggctagttattcatatgataggaaatgtgtacttctattcagtacctcggtaggaacggcgtattccgtaacgtcctaccgagagaactaacgttccaaggccaaccgtacggtacttacggttactcgtagacctaaaagtcgaaacacgtacctggaacgtacgtacgtaggaaacgggtaccgtacgggtaccgttaggttacgttaacggtttaccgtgggtaacggaaccggttaaaggttacttttaccggtaagttaacggggtaaggttaccggtaacgggtttacccgggggg

SEQ ID NO: 244263 - DNA, 580 bp, Homo sapiens
  misc_feature: GYAE6OF02F9OG6.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtggggggagcgtggtccagcctgggacgtccctgagactctcctgtacagcctctggcttcaccttcattacctatggcatgcactgggtcccgccagacctccgaggcgagggggctgggagtgggtggctagttattcatagtgataggaaataggtgtacttctattacagtaatccggtaggaacgggccgtagttccaccgttctaccgagaacgactaattccgaggcacgacgctgtactctagacaaatgaacagacctgaacgagctaggaacgacgacggcgtaggtacgttaattacgtaggtagtaacgtaagttactttacgtaagttacggtagggttacgtaccgggttaccggggg

SEQ ID NO: 244264 - DNA, 857 bp, Homo sapiens
  misc_feature: GYAE6OF02GR6LO.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccagtggtaggtttgggctgagtcgttgggttttcctcgttgcttcttttaaggaggtgtccagtgtcgaggtgacaacgtgggaggtagtcgtgggggaggcggtggtccaggccgtggggacggtcccgtggacgtactcctcctgtacagcctgtcggtccttccaccctttcaactttacccctagtggacctagtcggacctacggttcggggtccccgaccgaacggtacccgttcccggaaggggcccgggaagggggggggtccctttagggggggaacggggtttcggggggggttacgggtaccggtttaaaggggtttttaaccttttcgaaagtttaaggttaagggtaaggtttaaaggggtaaaaatttacgggtacgttaaaccctttttacttaaagtttacccgaaaacgggttacccgttacccggggttaaggggaaacggggttccccggtaacgtttacccgaacccggtttacccttaccgaaacgggtaacgtaaacctaacgtttacccggaaccggtaccaaccggtaaccgtacttcggttaacgttctacggtaacctaaagttacggaaacgtacgtacccgttaggaacggtacgtacgtacggaacggtaccgtacggtacgttaggtacgttacgttacgtggtacgaacgtaaagttctttacgtaagttaggtagggtacgtacgggttaccgggg

SEQ ID NO: 244265 - DNA, 560 bp, Homo sapiens
  misc_feature: GYAE6OF02G8O4G.11.71.G05.1.454.CMB.1.raw
  modified_base (307)..(307): a, c, t, g, unknown or other
  misc_feature (307)..(307): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagcctgggaggtccctgagactctcctgtacagcctctggcttcaccttcattacctatggcatgcacgtgggtcccnccagacctccgaggcgaggggggctggggagtggggtggctagttatttcatatgataggaaatgtgacttctattcagactccgtagaacgggcctattcaccgtctccagacgacaattccgaggccacacgctgtactctagacaaatgaaccagccgtagacgacgcgtagacggacgacggtacgtggtacgttaattacgtaggttacgacggtaaagtacttttacgtaagttacggtaggtacgg

SEQ ID NO: 244266 - DNA, 553 bp, Homo sapiens
  misc_feature: GYAE6OF02FVNI6.11.71.G05.1.454.CMB.1.raw
  modified_base (496)..(496): a, c, t, g, unknown or other
  misc_feature (496)..(496): n is a, c, g, or t
  modified_base (525)..(525): a, c, t, g, unknown or other
  misc_feature (525)..(525): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtcccctgagactctcctgtacagcctctggcttcaccttcattacctatggcatgcactgggtccgccagactccgaggcgagggggctgggagtggggtggctaggttattcatatgataggaaatgtgtactttctattcagaccttccggtgaacgggccgtattccgaccgtctcccgagacgactaacttccaggccacgacgcttagtactctagacaaatcgaacagccctagagagctaggacgacgacggntgtagttattacgtgtacgacgtaaagtntttactagtaggaggtgacggtacgggg

SEQ ID NO: 244267 - DNA, 541 bp, Homo sapiens
  misc_feature: GYAE6OF02H2BWZ.11.71.G05.1.454.CMB.1.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccacctgtcttgtctccaggggaaangccaccctctcctgcagggccagtcagagtgttaacagctacttagcctggtaaccaacagaaacctggccagactccgagctctcatctangatgcactccaacgaggccacgtcggaccaccccgagcctaggttcagtggcaggtgggtctgggacagacttcactctcacatcagcagcctagacgcctagtagtatttgacttagtttattactgtacagcagcgttatcgacgtggactcaccgttcggaccaaggacacgactaggtaaacttaaacgaacgttcggtggaccttagacctaccacttaccgttcgtaccttccactttcccg

SEQ ID NO: 244268 - DNA, 650 bp, Homo sapiens
  misc_feature: GYAE6OF02ICLJ3.11.71.G05.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (258)..(258): a, c, t, g, unknown or other
  misc_feature (258)..(258): n is a, c, g, or t
  modified_base (307)..(307): a, c, t, g, unknown or other
  misc_feature (307)..(307): n is a, c, g, or t
  modified_base (386)..(386): a, c, t, g, unknown or other
  misc_feature (386)..(386): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaangcccaccctctcctgcagggccagtcagngtgtaacngtctacttagcctggtaccaanagaaacctggaccagactcccaggctcctcatctatgatgcatccaacngggccactggccaccccagccaggttcagtggcaggtggctgggacagtactcactctcaccatcagcagccctagacnccgtagaggttattttcggacttagttttacttacgttcgttacgaacgcaacgtccgttaagtccgtaacgttcgggtaactcccgttacccgtttaccggggaacccgaaacggggtaaccctaacggtaaccgttaagggttaaaaacttaaaacccggaacgtttcgggttacgggccctttaacggaccccgtaaccgttaccgttaccgtttaccggttacccttttaccgtaaccgtttcccccgttaaccccccgg

SEQ ID NO: 244269 - DNA, 549 bp, Homo sapiens
  misc_feature: GYAE6OF02FWD1G.11.71.G05.1.454.CMB.1.raw
  modified_base (410)..(410): a, c, t, g, unknown or other
  misc_feature (410)..(410): n is a, c, g, or t
  modified_base (481)..(481): a, c, t, g, unknown or other
  misc_feature (481)..(481): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggaggtccctgagactctcctgtacagcctctggcttcaccttcattacctatggcatgcactgggtcccgccagactccgaggcgagggggctgggagtgggtggctagttattcatatgataggaaatagtgacttctattcagtactcgtagaacgggccgattcaccgtctccaganacaattccaggcacacgctagtactctgacaaatcgaacagcctagagacgcgtaggaacggacaccggtntaggtagttaacttacgtggtagacgtaaagtactttacgtaagtaggaggtacggacggtacggggg

SEQ ID NO: 244270 - DNA, 575 bp, Homo sapiens
  misc_feature: GYAE6OF02FQ1NP.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttccaccttcattacctatggcatgcactgggtccgccagacctccgaggcgagggggctgggaggtgggtggctagttattcatatgatggaaatgtgacttctattcagtacctcgtgaacggccgtattccgacccgtctccaagacgaactaacttcccgaggaccacgacgctgtactcgtagaccaaatgaaacctagacctaggagacgtcaggaacggacgacggtcgtgtacggttacttacgtggtacgacgtaaagttactttacgtaagttaggagggttacgaccggttacggggg

SEQ ID NO: 244271 - DNA, 683 bp, Homo sapiens
  misc_feature: GYAE6OF02GCDEY.11.71.G05.1.454.CMB.1.raw
  modified_base (312)..(312): a, c, t, g, unknown or other
  misc_feature (312)..(312): n is a, c, g, or t
  modified_base (383)..(383): a, c, t, g, unknown or other
  misc_feature (383)..(383): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtgggacggtccctgacgactctcctgtaccagcctctggcttccaccttcattacctatggctatgcacgtcgggtcccnccagacctccgaggcgagggggctgggagtggggtgctagtttattcatatgagtaggaaatgtgtacttntattcgagtaccgtccggtagggaacgggccgtattccgtaccgtcctaccgagaacgtactaacttaccgacggaccaacgaccgtcgttacgtacttccgtagtactaaaagttacgaaacgtacgtacccgtaaggaacgacgtacgtacggaaccgggtaacgtaaccgggtagttacggttaacggtttaacgtttaacgttcgggtaacggtaaccggttaaaaggttactttttaaccggtaaaggttaacgggttacggggttacgggttaaccgggtttaacccggggggg

SEQ ID NO: 244272 - DNA, 652 bp, Homo sapiens
  misc_feature: GYAE6OF02I8NS9.11.71.G05.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagcccacctgtctttgcctcgaggggaancgcctacctntcctgcacgggccagtcagagtntaacngctacttagctggtaaccaanataactggccaagactccaggcctcncatctagtanatcgctactccaaacggnggccacgtcggacccaaccccgagccgtacggttcacggttgaccgtagggtcgggtccgtagggacctaaggtccttcgacttctacccgaactagtccaagtccgacgtacctaggaacgtcccgtaggtacggttacgttttacggacttaaggttttacttaacgtggtttaccgaacgttcgaacggttacgtacgtaggtaaccgttacgggtacctaccggttacccggttaccggaacgtaacggtacgtaccgagttaacgttaacgtaaacgacgtcggtacggacgtacgaccgtatacgttcttacggtcttactacgtccccgtacg

SEQ ID NO: 244273 - DNA, 619 bp, Homo sapiens
  misc_feature: GYAE6OF02J1JLC.11.71.G05.1.454.CMB.1.raw
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtgggtccaggcctggggacggtcccngagactctcctgtacagcctctggcttcaccttcattacctatggcatgcacgtcgggtccnccagcctccgaggcgagggggctgggaggtgggtcgctagttacttcaatagtgagtaggaaattggtacgtacttctattcgaagtacctcggtaggaacgggtccgtacttcgaccgttcctacacgagactaacttccgaacggcacgacgtctacgtactcgtacgactaaagtacgaacgacgacctagaacgtacgcgtacggaacggaccgacggtcgttagtagttaacgttgtacggtacggtaacgtaaagttactttacgttaagttaacggtagggttaccggtaacgggttaaccggggg

SEQ ID NO: 244274 - DNA, 665 bp, Homo sapiens
  misc_feature: GYAE6OF02IPASV.11.71.G05.1.454.CMB.1.raw
  modified_base (307)..(307): a, c, t, g, unknown or other
  misc_feature (307)..(307): n is a, c, g, or t
  modified_base (598)..(598): a, c, t, g, unknown or other
  misc_feature (598)..(598): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtggggacgtccctgagacctctcctgtacagcctcgtggtcttcaccttcattacctatggcatgcactgggtccnccagactccaggcgagggggctgggagtgggtcggctaggttatttcattagtgataggaaattagtgtactttactattacaagtaccgtccgtagggaacggtcccgtagttaccgtaaccgttccaccgtaaggaacgtaacctaaacgtttccgaacgggacctaacaaccggtacctaggttaactccgttacggaacctaaaagtaccgaaactacgtccgtaaggacgtaacgtcggtagaaccgggaacgtaccgggtcgttagtacggttaacgtttaccgnggttaagaccggtaaattacgtttaccgtaagttaacgggtaaggttcggtaacggtaaccgggggg

SEQ ID NO: 244275 - DNA, 622 bp, Homo sapiens
  misc_feature: GYAE6OF02IECBA.11.71.G05.1.454.CMB.1.raw
  modified_base (175)..(175): a, c, t, g, unknown or other
  misc_feature (175)..(175): n is a, c, g, or t
  modified_base (262)..(262): a, c, t, g, unknown or other
  misc_feature (262)..(262): n is a, c, g, or t
  modified_base (354)..(354): a, c, t, g, unknown or other
  misc_feature (354)..(354): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagnggtgtccagtgtcaggtgcaactggaggagtcgtgggggaggcgtggtccagcctggggacggtcccctgagacctctccgtgtacncgcctcgtggtccttcacccttcactttacctagtcggctatgcacgttgggtccccgcagcctccgaggcggagggggctgggaggtgggngctagtttacttcattagtgagtaggaaatagtgtacttcgttattcgagtccgtcggtaggaacgggtccgtacttccacccgtctaccgaagacgaactacgttacccgaggaccacaccgtcttagtactcgtacactaaagtcgaaaccacgtcctaggacggtacgcgttaggaacggaccgacggtcgtaggttagtacttacggtgtacgaacgtaagttctttacgtaagtagggacggttacgtacgggtacccggggg

SEQ ID NO: 244276 - DNA, 661 bp, Homo sapiens
  misc_feature: GYAE6OF02HJJJ6.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtggggggaggcgtggtccagcctggggaggtccctgagctctcctgtacagcctctggcttcacctttcatttaccctatcggcatgcacgtgggtcccgccagcctccgaggcgagggggctgggagtggggtggctaggtttacttcgattagtggtataggaaattggtagtaactttcttattcagtacctaccggtaggaacgggtccgtacttccgtaacccgtcttacccgaaggtaacgaacctaacttaccgaaggaccaacaccgtctaggttactctcgacctaaatacggaaaccacgcctaggacgacgtcgttacggaacggtaccgacggacgttggtttacggttaactttaccggttaggtacggtaacggtaaaggttacttttaaccgtaagttaacggggtaagggttacggtaccgggttaaccggggggg

SEQ ID NO: 244277 - DNA, 705 bp, Homo sapiens
  misc_feature: GYAE6OF02I9BKV.11.71.G05.1.454.CMB.1.raw
  modified_base (147)..(147): a, c, t, g, unknown or other
  misc_feature (147)..(147): n is a, c, g, or t
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
  modified_base (286)..(286): a, c, t, g, unknown or other
  misc_feature (286)..(286): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctccagatagcaccgganaaattgtgttgacacagtctccagccaccctgtctttgtctccaggggaaangccaccctctcctgcagggccagtcagagtgttaacngctacttagcctggtaaccaacagaaactggaccagactcccagctcctnatctatgatgcataccaaacgagggccaacgtggaccaaccccgagcccgtaagggttccaaggttggacgtagggttcggggtctaggggaacaaggtacctttacacttaccttaccaaaccctagttacccaaggcccaagtacccttaggaacgtcccgtaggtaagggttactttttcggaacttaaggtttttaacttacgttacggttacaacgtacgaaggttccgttaacttacgggtaccttagggtacttaacccgtaccggttttaccgggaccgtaaaggggaaccctaacggtaaccgttaaggggtaaaactttaaacggtaaccgttggtacggtaccgttaagaccgtaaaccctagtttaccttacggttacctttactaaccgttttcccgttaaccccg

SEQ ID NO: 244278 - DNA, 567 bp, Homo sapiens
  misc_feature: GYAE6OF02IZBVD.11.71.G05.1.454.CMB.1.raw
  modified_base (353)..(353): a, c, t, g, unknown or other
  misc_feature (353)..(353): n is a, c, g, or t
  modified_base (435)..(435): a, c, t, g, unknown or other
  misc_feature (435)..(435): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcttgggtttcctcgttgctcttttaagaggtgtccagtgtcaggtgcaactggaggagtcgtgggggagcgtggtccagcctgggagtccctgagactctcctgtacagcctctggcttcaccttcattacctatggcatgcacgtgggtccgccagacctccgaggcgagggggctgggagtgggtgctagttactttcatntgataggaaatgtgtacttctatcagacttcgagaacgggtcctattacaccgttctaccagacgactaactccgaggcacncgctagtactcagacaaagtcgaacacggtacctaggaagacgtacgtaggacggtacgacgggtactggttaacgttaacttacgtagtaggaaccgtaagttactttacgtaagttacggagggtaacgg

SEQ ID NO: 244279 - DNA, 544 bp, Homo sapiens
  misc_feature: GYAE6OF02HTZEJ.11.71.G05.1.454.CMB.1.raw
  modified_base (203)..(203): a, c, t, g, unknown or other
  misc_feature (203)..(203): n is a, c, g, or t
  modified_base (241)..(241): a, c, t, g, unknown or other
  misc_feature (241)..(241): n is a, c, g, or t
  modified_base (290)..(290): a, c, t, g, unknown or other
  misc_feature (290)..(290): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacngctacttagcctggtaccaacagaaacctggccagactcccaggctccncatctatgatgcatcccaacacgggcccacgtcggccaccccgagccgtaggttcagtggcgtaggtggggtctggggacacggtaccttcaccttctaccacctatcgaacgcacgcctaaggacgtccgtaggaacggttattttcgacgttaagtttattacgtgtcagctagtcgtatcgactggactcctaccgttcgacgaaggacacgatagaaataacggatgngctgcacntgtntcttcntccg

SEQ ID NO: 244280 - DNA, 611 bp, Homo sapiens
  misc_feature: GYAE6OF02GPPSL.11.71.G05.1.454.CMB.1.raw
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaaagcgccaccctctcctgcagggccagtcagagtgttaacagctacttagcctggtaccaacagaaacctggccagactcccaggctcctcatctatgatgcatccaacgacgggccaacgtcggaccaaccccagcccgtaggttccaggttcggacgtaggttcggggtcgtacggggacacggtacttcgactctaccaccatccgagctacgacctagacgtccgtaggtagttattttcgacgttagttttacttacgttgtactagtcgagtacgtactacgacgtaggtactacctaccgttacggaccgaacgggaccacggtaacgtaggtaaacttaacggacgttggtacggctacgacctaccgtacttcgttcgttaccttacgtacctccgttaccccg

SEQ ID NO: 244281 - DNA, 635 bp, Homo sapiens
  misc_feature: GYAE6OF02GHLZE.11.71.G05.1.454.CMB.1.raw
  modified_base (303)..(303): a, c, t, g, unknown or other
  misc_feature (303)..(303): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggaggtccctgagactctcctgtacagcctctggcttcaccttcattacctatggcatgccacgtgggtcccnccagacctccgaggcgagggggctgggagtgggtgctagtttattcatatgatggaaactgtgacttctattcagtacctccggtagaacgggcctattccgaccgttcctccgaagacgaactaacgttccgacggccaacgaccgtcttaggtactctgacaaagtcgaaacacgacccgtaggaagacgtacgtacggtaacgggaaccgaccgggtcgttaggttacgttaacgtttacgttacgggtacggtaaccgtaaaaggtttaacttttacggttaaacgttaaagggtacgggtttaccggaaccgggttaacccgggggg

SEQ ID NO: 244282 - DNA, 538 bp, Homo sapiens
  misc_feature: GYAE6OF02G0N2J.11.71.G05.1.454.CMB.1.raw
  modified_base (394)..(394): a, c, t, g, unknown or other
  misc_feature (394)..(394): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaaccctggccagacctcccaggcctcctcatctatgatgcatccaacagggccactggccaccccagccaggttcaggtggcaggtgggtctgggacagacttcactctcaccatcagcagcctagacncctgaggtatttgctagtttattactgtcagcagcgttatcgtactggtacttcaccgttccggccgaaacgggaccacgacgtaggaaacttaaaccggactaggtacgctacgaccacctactcgttcgtcttcacttcccg

SEQ ID NO: 244283 - DNA, 585 bp, Homo sapiens
  misc_feature: GYAE6OF02GD51M.11.71.G05.1.454.CMB.1.raw
  modified_base (312)..(312): a, c, t, g, unknown or other
  misc_feature (312)..(312): n is a, c, g, or t
  modified_base (386)..(386): a, c, t, g, unknown or other
  misc_feature (386)..(386): n is a, c, g, or t
  modified_base (480)..(480): a, c, t, g, unknown or other
  misc_feature (480)..(480): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactggaggagtcgtgggggaggcgtggtccagccgtgggacggtccctgagactctcctgtacagcctctggtcttccaccttcatttaccctatggcatcgcacgtcgggtcccnccagtcctccgaggccgagggggtctgggagtggggtggctagttattcatatgagtaggaaatgtagtacttntattcagacctcgtagaacgggtcctattccaccgtctccgagacgactacttccaggccacgacgcttagtactcgtacgactaaatcgaacncgaccgtagacgagcgtaggacgacgacggtcgtgtagttacttagtcggtagtaacgtaagtacttttactaagttaggtagggttacggtacggtaacggggg

SEQ ID NO: 244284 - DNA, 654 bp, Homo sapiens
  misc_feature: GYAE6OF02JCKFK.11.71.G05.1.454.CMB.1.raw
  modified_base (388)..(388): a, c, t, g, unknown or other
  misc_feature (388)..(388): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcaacgtggaggagtcgtgggggagcgtggtccagccgtgggacggtccctgacgactctcctgtacagcctctggcttcaccttcatttaccctatggcatgcacgtgggtcccgccagacctccagggcgagggggctgggacgtggggtgcgtagtttatttcattatgataggaaattagtgtactttntattcgagtacctcggtaggaacgggccgtattccgtacccgttctaccgaggacgtacctaaacttccgaacggaccaccgtaacggccttacggttaactcgtacaccgtaaaagtacgaaccgtacgaccgttaggacgacgtacgtacggaacggaccgtacgggtcgttaggttagttaacgttacgtaggtacggtaacggtaaagttacgtttaacgttaggttaacggtacgggttacggacgggtttaacccggggg

SEQ ID NO: 244285 - DNA, 568 bp, Homo sapiens
  misc_feature: GYAE6OF02IWK72.11.71.G05.1.454.CMB.1.raw
  modified_base (258)..(258): a, c, t, g, unknown or other
  misc_feature (258)..(258): n is a, c, g, or t
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (440)..(440): a, c, t, g, unknown or other
  misc_feature (440)..(440): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggtttcctcgttgctcttttaagaggtgtccagtgtcaggtgcaactggaggagtcgtgggggagcgtggtccaggcctgggagtccctgagactctcctgtacngcctctggcttcaccttcattaccctatggcatgcacgtgggtcccncagacctccgaggccgagggggctgggagtgggtgctagttnttcatatgatgaaatgtgacttctatcagctcggagaacgggctatcgaccgtctccagagactaactccaggcacacgcttagtactcgtanactaaatcgaaacaacgtccgagtacgagcggtaggaacggaccgacggtacgtaggttaacgttaacgttacgtacggtacgtaacggtaaactttacgtttactaacggtaggtacgggttacggg

SEQ ID NO: 244286 - DNA, 589 bp, Homo sapiens
  misc_feature: GYAE6OF02IOV8Y.11.71.G05.1.454.CMB.1.raw
  modified_base (202)..(202): a, c, t, g, unknown or other
  misc_feature (202)..(202): n is a, c, g, or t
  modified_base (239)..(239): a, c, t, g, unknown or other
  misc_feature (239)..(239): n is a, c, g, or t
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctcctaggggaaagngccaccctctcctgcagggccagtcagagtgttaacngctacttagcctggtaccaacagaaacctggccagacctcccaggcctcctcatctatgatgcatccaacngggccacgtggccaccccagccaggttcagtggcagtgggtctggggacagtacttcgacttcctacaccatcagcagacctagacnccgtagaggttatttgcttagtttattacgttgtacagtcacgtcgtatcgacttggactccgtaccgttccggaccgtaaacgggacctaacgaccgttaaggtaaacttaaacggtaacgtcggttaggtaccgttacgaccgtaacctacgttccgttcgttacgtttacctacgttcccgttaccccg

SEQ ID NO: 244287 - DNA, 577 bp, Homo sapiens
  misc_feature: GYAE6OF02GUTHA.11.71.G05.1.454.CMB.1.raw
  modified_base (203)..(203): a, c, t, g, unknown or other
  misc_feature (203)..(203): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaaacctggccagactccaggctcctcatctatgatgcactcccaaacgacgggcccaacgtggcccaccccagcccaggttcagtggcaggtgggtctggggacagacttcactctcaccatcagcacgcctagagcctaggaggtattttcgacttagttttaattacttgtacagctagcgtataccggtactggactcgaccgttcggaccgaacgggaccacgacgtacggtaaacttaaacggaaccgttaggttacggaccttacggacctaacctacgttaccttagtacctttaccacttccccg

SEQ ID NO: 244288 - DNA, 703 bp, Homo sapiens
  misc_feature: GYAE6OF02GG1A4.11.71.G05.1.454.CMB.1.raw
  modified_base (201)..(201): a, c, t, g, unknown or other
  misc_feature (201)..(201): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctccagatagcaccggagaaattgtgttgacacagtctccagccaccctgtctttgtcctccgaggggaaanagccaccctctcctgcgagggccagtcagagtgtaacagctacttagcctggtaaccaacagaaacctggacagacctccaggctcctcatctatgatgacatccaacgacgggccacgtcggaccaccccgagccctagggttccaggtcggcctaggtcggggtcgtggggaactaggacctttcaccgttcctaccaacctactaccgaacggtaccaaccggtcccgtaaaggaccgtacggttacgggtaacgggtttacgtttttacggacgtttaacggttttacgttacgttacgtaccgagtaccgtaggtaccgtagttaccggtacgtcgggtacttaccgtaccggttaccgggaccgtaacggggtacctaccgggtaaacgtacgggtaaaacgttaaaccggacggttacggtacggttaccgtaccggacctaacccgttagttccgtttacgttaccgtttactaccgtttcccgttaaccccgg

SEQ ID NO: 244289 - DNA, 516 bp, Homo sapiens
  misc_feature: GYAE6OF02FV86M.11.71.G05.1.454.CMB.1.raw
  modified_base (200)..(200): a, c, t, g, unknown or other
  misc_feature (200)..(200): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
  modified_base (392)..(392): a, c, t, g, unknown or other
  misc_feature (392)..(392): n is a, c, g, or t
  modified_base (398)..(398): a, c, t, g, unknown or other
  misc_feature (398)..(398): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcaggccagtcagagtgttaacngctacttagcctggtaccaanagaaacctggccagacctcccaggctcctcatctatgatgcatccaacnggccactggcacccagccaggttcagtgcaggtggtctgggacagacttcgactcncaccatcagcagcctagacgctaggagtntttcgntagtttattactgtacagcagcgtatcgacgtgactctaccgttcggaccgaaggacacgactaggaacttaacgaacgtgtaggctagaccacactctagtcttctactttcccgac

SEQ ID NO: 244290 - DNA, 528 bp, Homo sapiens
  misc_feature: GYAE6OF02IMO5W.11.71.G05.1.454.CMB.1.raw
  modified_base (304)..(304): a, c, t, g, unknown or other
  misc_feature (304)..(304): n is a, c, g, or t
  modified_base (369)..(369): a, c, t, g, unknown or other
  misc_feature (369)..(369): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagagtgtccagtgtcaggtgcaactggagagtctgggggagcgtggtccagcctgggagtccctgagactctcctgtacagcctctggcttcacctttcaatttaccctatggcatgcactggggtccnccagactccaggcagggggctggagtgggtcgctagttatttcatatgatggaaatgtgtacttntattcagtactcgtagaggccgattcacgtctaccagacgactaattccaggtcacgacgtctagtatcgtagctaaactgaacacgactaganacgngtagacggacacgcgtgtagtattacgtgtagacgtaagtacttagtagtagtaggtacgg

SEQ ID NO: 244291 - DNA, 682 bp, Homo sapiens
  misc_feature: GYAE6OF02JZQVX.11.71.G05.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (290)..(290): a, c, t, g, unknown or other
  misc_feature (290)..(290): n is a, c, g, or t
tcagcgagagataccacgaccggtgctcgatttagtgtcgtcgcaagagagagggggaggaacgtgctcagttaggacccagaggaaccatggaagccccagctcagcttctcttcctcctgctactctggctcccagatagcaccggagaaattgtgttgacacagtctccagccaccctgtctttgctccgaggggaaanagccaccctntcctgcagggccagtcagacgtnttaacngctacttagcctggtaaccaacagaacctggccagactccgagctcctnatctatgatcgacatacccaacgacgggcccactgggacccacccccaggaccccgaggtttaccaggtccggaccgtaaggttaccggggtccgttaggggaaccgtaacgtacccgtttaccgtaaccgtccctaaccgaacccgtaattacccgacgcctaggacctaaggacgtcccgtagtaaacggtattttcgacttagtttaacttacgtgtaccaagtccgtaaggtccgtttaagtcccggtacgtacgggtactaccggtaccgtttaccggaacggtaaacggcttaaccggaacgttacggtaaacgttaaaccgacgttaggtaccgccgttaacgccttaacgtacttaccgtcgttacccttacgtaccttacccg

SEQ ID NO: 244292 - DNA, 604 bp, Homo sapiens
  misc_feature: GYAE6OF02I7RH2.11.71.G05.1.454.CMB.1.raw
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttactttttaaggaggtgtccagtgtcaggtgcaactggaggagtcgtgggggagcgtggtccagcctggggacgtccctgagctctcctgtacngcctctgcttcacttcattacctntgcatgctacgtggtcccncagacctccgaggcgagggggctgggagtgggtgctagtttattcattagtgataggaaattgtgtactttctattcaagtacctccggtaggaacggccgtattccacccgtctaccgagacgtacaacttccgaggccacacgctgtactctagactaagtacgaacacgaccgtagaacgacgtacgtaggaacggaccgaccggtcttaggtacgttaacgttaccgttaggtaacgtaacgtaaagttactttacgttaagtaggtaacggttacggtaccgggttaaccggggg

SEQ ID NO: 244293 - DNA, 714 bp, Homo sapiens
  misc_feature: GYAE6OF02GCJ8H.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaacgtggaggagtcgtgggggaggcgtggtccagcctggggacggtccctgacgactctcctgtacagcctctggcttcaccttcattacctatggcatgcacgtcgggtccgccagactccgaggcgaggggctgggagtgggtgctagtttattcatagtgaataggaaattggtagtactttctaattcgaagtaccgttccggtagggaaacggggtcccgtaagtttcccgaacccggttccttacccgaaacggtaacggtaaacctaaaccgtttacccgaacgggacccaaaccgtaaccggtcgttaacggttaaccttccgtacgtaaccgtaaaacgttacggaaaacccgtacggtacccgttagggaacggtaacgtacgtacgggaacgggtacccgacgggtactttgggtacgtttaacgttacgtacgggtaggaaccgttaaaggttacttttacgttaaaggttaggtaacgggttaccgggacggtttaaccgggggg

SEQ ID NO: 244294 - DNA, 805 bp, Homo sapiens
  misc_feature: GYAE6OF02F0WU5.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgccttactttaaggaggtcgtctagtgtcgtaggtgacaacgtgggaggtagtcgggtgggggaggtcggtcggtccgacgtccggtaggggtaccggttccctaggaacgtccttcctccgttagtaaccgacgtcccgttcgtcggtccttaccctacctttacgtaactttaaccttagtcggactagtcgacctacggttccgggtccccgaccgaacgtcccgtaccggacgggaccggggacggggggtccgtaggggtaggggttgggggtggtaccgttaaggttttacgtttacaagttaaggtagtaggttaaaggtaaagttaggtacgttacctttattacgttacgaacggttacccgtacggtaacgggtaaccgggtccttaacgttacccgaccgttcccgtaaccggaaggtaaccgtaaacttaaccgttccggacgaacccaaccggtacgtccgttaggttacctcgtacgaaacctaagtaccgaaacgccgtaccgtaggtaacgacgtcgtaaagggacgtaaccgtcggttgtagttacggtttaactacggttaggaacgtaaccgttaaattccgtttagtaagtagggtacggttacggtacggggttaccgggg

SEQ ID NO: 244295 - DNA, 672 bp, Homo sapiens
  misc_feature: GYAE6OF02G7BNW.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtggggggaggcgtggtccaggcctggggacggtccctgagacctctcctgtacagcctctggcttcaccttcattacctatcggcatgcacgtcgggtcccgccagacctccgaggcgagggggctgggaggtgggtggctaggtttattcatagtgataggaatagtgtacttctattcagtactccgtaggaacgggtccgattccgaccgtctacccagacgtaactaacttccgaacggccaccgaccgtcttacgtactcgttacgacctaaagttcgaaaccgtacgccgtacggaagtaccgacggtaggaaccgggtaaccgaccggggtacctttagggttacgttaacggttttaaccggtagggttacggtaaccggttaaaaggtttacgttttaaccgtaaggtttaaggggtaacggggttacggtaaccgggtttaacccgggggggg

SEQ ID NO: 244296 - DNA, 552 bp, Homo sapiens
  misc_feature: GYAE6OF02FYW3Q.11.71.G05.1.454.CMB.1.raw
  modified_base (304)..(304): a, c, t, g, unknown or other
  misc_feature (304)..(304): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgtgggttttcctcgttgctctttaagaggtgtccagtgtcaggtgcaactggaggagtctgggggagcgtggtccagcctgggaggtccctgagactctcctgtacagtcctctggcttcaccttcattacctatggcatgcacgtgggtccnccagactccgaggcgagggggctgggagtggggtggctaggttattcatatgatggaaatgtnacttctattcagctcgaggaggctatcnccgtctccagacgactaacgtccaggaccacacgctagtactcgtgactaaactcgaaacacgcctagaacaggtactaggacggacgacggcgtagtacgttaacgttacgtgttacggacgtaaaggttattttacgtaagttaggtaggtacgg

SEQ ID NO: 244297 - DNA, 753 bp, Homo sapiens
  misc_feature: GYAE6OF02JZUGF.11.71.G05.1.454.CMB.1.raw
  modified_base (244)..(244): a, c, t, g, unknown or other
  misc_feature (244)..(244): n is a, c, g, or t
  modified_base (291)..(291): a, c, t, g, unknown or other
  misc_feature (291)..(291): n is a, c, g, or t
  modified_base (349)..(349): a, c, t, g, unknown or other
  misc_feature (349)..(349): n is a, c, g, or t
tcagcgagagataccacgaccggtgctcgattagtgtcgtcgcaagagagaggggggaggaggagccagcactagaagtcggcggtgttccattcggtgatcagcactgaacacagaggactcaccatggagtttggctgagcgtgggttttcctcgttgcttcttttaagaggtgtccagtgtcaggtgcaacgtggaggagtcgtgggggaggccgtggtccaggcccgtgggacggtcccngaacgcgtctcctgtacagcctctggcttcaccttcattacccgtanggtccagtcgcacgtcggtcccgccagtacctccgaaggccgagggggtcctaggggnggtaggggtcggaccgtaggttttattccgtaattaagtggtaaacgtagggtaaaagttcggttacggtaacttttcgttagtttacgacgggtaaccctttaccgggttaggaacgggtaccgttaccgttccgggtaaccctttcgtaccccgtaacgggaaaccgtaccgtaaaccgtttacccggacgggtaaccaaccgtacccgtaccgttacggttaccttacgtaccgtaaacttaaacggtaacgaaccgtaaccgtaccgacgtaacgacgtacccgttggaaacccgtaaccggccggacttaccggttagtccgtttaacgtcgtaggttaccgtaaaggttcttttacggtaagttacgggtaacggttacggtaacccggtaccggggg

SEQ ID NO: 244298 - DNA, 616 bp, Homo sapiens
  misc_feature: GYAE6OF02JBZ8Y.11.71.G05.1.454.CMB.1.raw
  modified_base (505)..(505): a, c, t, g, unknown or other
  misc_feature (505)..(505): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctggagactctcctgtacagtcctctggcttcaccttcattacctatcggacatgcacgtcggggtcccgccaggtcctaccgaggccgagggggtctgggaggtggggtggcgtaggtttattcatagtagagtggaaatgtgacttcgtattcgagtaccttccggtaggaacggtccgtacttaccgtacccgttctacccgagaacgtactaaacgttcgacggactaccgaccgtctacgtgtactgacaaacgtgaacncgtccgtagacgagccgtaggaccgaacgtaggtcgtagtacggtactttacgtggtacgaaggttaacgtacttttacgaacgttaggagggttacgacgggttacgggg

SEQ ID NO: 244299 - DNA, 595 bp, Homo sapiens
  misc_feature: GYAE6OF02IHRQ9.11.71.G05.1.454.CMB.1.raw
  modified_base (460)..(460): a, c, t, g, unknown or other
  misc_feature (460)..(460): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggacggtccctgagactctcctgtacagcctctggcttccaccttcacttacctatggcatgcacgtcgggtcccgccaggacctccgagggcgagggggctgggaggtggggtggctaggttatttcgatatgataggaaatgtcgtacttctagttacagtacgtccgtagggaacgggtccgtaattccgacccgtctaccgagacgtactaacgtccaggtacacncgtctgtatctgactaagtcgaagcgccgtagagacgtcgtaggacggaccgtacgggcttaggtattacgttacgtcggtaagacgtaaagttctttacgtaagttagggaaggttcggaacggttaccggggg

SEQ ID NO: 244300 - DNA, 565 bp, Homo sapiens
  misc_feature: GYAE6OF02HRCC6.11.71.G05.1.454.CMB.1.raw
  modified_base (335)..(335): a, c, t, g, unknown or other
  misc_feature (335)..(335): n is a, c, g, or t
  modified_base (409)..(409): a, c, t, g, unknown or other
  misc_feature (409)..(409): n is a, c, g, or t
tcagcgagagataccacgaccggtgctcgatttagtgtcgtcgcaagagagagggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactgggaggagtcgtgggggagcgtggtccaggcctgggaggtccctgagactctcctgtacagcctctggcttcaccttcattacctatggcatgcactgggtcccgccagcctccaggcagggggctgggagtgggngcagttattcatatgataggaaatgtgacttctatcagctccgtagacgggcctatccgtaccgtctccagganacaattccgaggcacgacgtctacgttatcgtgacaaacgtgaacgtacgtctaggagacgcgtaggaacggaacacgggcttagtacggttaattaccgttggtagaacgtaagttacttactaagttacggtaaggtaggtacggttacggggg

SEQ ID NO: 244301 - DNA, 562 bp, Homo sapiens
  misc_feature: GYAE6OF02HNZPQ.11.71.G05.1.454.CMB.1.raw
  modified_base (303)..(303): a, c, t, g, unknown or other
  misc_feature (303)..(303): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagactctcctgtacagcctcgtggcttcaccttcattacctatggcatgcacgtgggtccnccagactcgaggcgaggggctggagtgggtggctgttattcatatgataggaatcgtgtacttctatcagtactccggtagacgggacgtattcgaccgtctaccgtagacgaactaacgttcacggtacacacgtctgtactctgacaagtacgaacagtacctagacggacgaccgtaggacggtacgacggtcgtagttgtacgttacgtagtacgtaacgtaaacgtacgtttacgtaagttacggtaggtacgg

SEQ ID NO: 244302 - DNA, 699 bp, Homo sapiens
  misc_feature: GYAE6OF02JZ9BM.11.71.G05.1.454.CMB.1.raw
  modified_base (380)..(380): a, c, t, g, unknown or other
  misc_feature (380)..(380): n is a, c, g, or t
tcagcgagagataccacgaccggtgctcgatttagtgtcgtcgcaagagagagggggggaggaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggccggtggtccaggcccgttggggaggttccctggagacctctccgtgtacagtccctcgtggtccttaccacctttacaactttaccctagtcggtcagtggaccacgttggggtccccgaccaggtacctccgaggcgtaggggggctagggaggttcgggngcctagtttcttacagtacttggatagggtaaattgtagtacctttagtacgttaccgaggtaccgttaccggttagaacggggtccgtacgtttacgaacccgttctaccgagtaacgactaacgtaccgaggaccacggaccgtactaggtacctgtacgaacctaagtacgaacctacgaccggttagaaccgtagtccgaggtacggaacgtaccgggtctaacggtttagaacgttttacgcgtaacggaacgttaacgtacgttttaccgtaaggtaacggtaacgggttacgaaccggggtttaacccgggg

SEQ ID NO: 244303 - DNA, 593 bp, Homo sapiens
  misc_feature: GYAE6OF02GU1ZQ.11.71.G05.1.454.CMB.1.raw
  modified_base (263)..(263): a, c, t, g, unknown or other
  misc_feature (263)..(263): n is a, c, g, or t
  modified_base (304)..(304): a, c, t, g, unknown or other
  misc_feature (304)..(304): n is a, c, g, or t
  modified_base (375)..(375): a, c, t, g, unknown or other
  misc_feature (375)..(375): n is a, c, g, or t
  modified_base (426)..(426): a, c, t, g, unknown or other
  misc_feature (426)..(426): n is a, c, g, or t
  modified_base (465)..(465): a, c, t, g, unknown or other
  misc_feature (465)..(465): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgcttcttttaagaggttgtccagtgtcaggtgcaactggagagtcgtggggggagcgtggtccagccgtgggacgtccctgagctctcctgtacagcctntggcttcaccttcattacctatggcatgcacgtgggtcccnccagacctccaggcgagggggctggaggtggggtcggctagtttattcgattagtgaagtaggaaattgtntacctttctaattcacgtacctcggtaggaacgggcctattccgaccgtcnccaagagacctaagttccaggccacacgctgtactcgtnacaatgaacgacgccgtaggagagcgtaggacggactaccgggcttaggtacgttacttacggtgtacggaacgttaaacggtactttacgaagttaaggtacggtaggtaacccgggttaacggggg

SEQ ID NO: 244304 - DNA, 543 bp, Homo sapiens
  misc_feature: GYAE6OF02HPTKY.11.71.G05.1.454.CMB.1.raw
  modified_base (255)..(255): a, c, t, g, unknown or other
  misc_feature (255)..(255): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagcctgggacgtccctgagactctcctgtacngcctctggcttcaccttcattacctatggcatgcactgggtccgcagactccgaggcagggggctggagtgggtggctagttattcatatgatggaaatgtagacttctattcagtactccgtagaacgggccgattccaccgtctccagagacaattccagcacgacgctagtatctgacaaatgaacagacctaggagacgcgtagaacggacgaccggacttggtagtattacgtgtacgacgtaaagtctttactagtacggtaaggtcgtacggttacggggg

SEQ ID NO: 244305 - DNA, 611 bp, Homo sapiens
  misc_feature: GYAE6OF02GQNYJ.11.71.G05.1.454.CMB.1.raw
  modified_base (198)..(198): a, c, t, g, unknown or other
  misc_feature (198)..(198): n is a, c, g, or t
  modified_base (234)..(234): a, c, t, g, unknown or other
  misc_feature (234)..(234): n is a, c, g, or t
  modified_base (284)..(284): a, c, t, g, unknown or other
  misc_feature (284)..(284): n is a, c, g, or t
  modified_base (396)..(396): a, c, t, g, unknown or other
  misc_feature (396)..(396): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccacctgtctttgctccaggggaaangccacctctcctgcagggccagtcagagtgttaacngctacttagcctggtaccaacagaaacctggccagactcccaggctcctnattctatgatgcataccaacagggccaacgtcggcaccccagccaagggttcagtcggactaggtcgggtctgggaacagtaacttcactctcaccgatccgagcagctagngcctgagtatttcgactagtttattactgtacagacgagtcgtataccgtagtacgggtacttaccgtaccgtttacgggacccgtaaacggggacctaaacggtacgttaacgggtaaaactttaaaccggtaaccgttaggtaacgggtcctacggacccgttaacctagttcccgttacggttacctttacgtacgttcccgtttacccccg

SEQ ID NO: 244306 - DNA, 626 bp, Homo sapiens
  misc_feature: GYAE6OF02G908F.11.71.G05.1.454.CMB.1.raw
  modified_base (263)..(263): a, c, t, g, unknown or other
  misc_feature (263)..(263): n is a, c, g, or t
  modified_base (306)..(306): a, c, t, g, unknown or other
  misc_feature (306)..(306): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggacgtccctggagactctcctgtacagcctntggcttcaccttcattacctatggcatgcacgtcggggtcccnccagacctccgagggcgaggggggctgggaggtggggtgcgtaggtttactttcaatagtgagtaggaaaattggtagtactttactattcgagtacctccggtaggaacgggcctattccgaccgtctccagtaacgactaacttccgaaggcaacgacgcgttagttactcgttacggaacctaaagtcggaaacctcgtaccgtaggacgacggtacgtaggaacggacgaccggtcgttggtacgttaacttacgtaggtcgtaacggtaagtacgtttacgtaagttaggtacgggtacgtaacggttccggggg

SEQ ID NO: 244307 - DNA, 727 bp, Homo sapiens
  misc_feature: GYAE6OF02I3QVL.11.71.G05.1.454.CMB.1.raw
  modified_base (203)..(203): a, c, t, g, unknown or other
  misc_feature (203)..(203): n is a, c, g, or t
tcagcgagagataccacgaccggtgctcgatttagtgtcgtcgcaagagagagggggaggaactgctcagttaggacccagagggaaccatggaagccccagctcagcttctcttcctcctgctactctggctcccagatagcaccggagaaattgtgttgacacagtctccagccaccctgtctttgtactccaggggaaanacgccaccctcgtcctgcagggccagtccagagtgttaacagtctacgttagcctggtaacctaacagaaacctggaccaaggaccttcccgaaggccttaccctacacttccgtatgaacgttcgccaacttacccgaaacgacggggaccctacgtcggacccaccccgaagccgtaaggttcaacggtcggactaggtcggggtactacggggactaggtacctttccgaacttccgtaccgaccctaatcgacgacacgtctaacgacgtcctaggacggttactttcgacttaaggttttacttaacgtcggttactacgtacgtaacgtcgttacgtaccgtacgtagggttaacctccttaacccgtttccgggaaccgttaaacgggacccgtaacgggtaaccttaacgggttaaaacgtttaaaaccggacggtttacggaacggttcccgttaacggacccgttaactaccggtttaccgttcggtttacctttacccgacgttttacccccg

SEQ ID NO: 244308 - DNA, 687 bp, Homo sapiens
  misc_feature: GYAE6OF02JG0BV.11.71.G05.1.454.CMB.1.raw
  modified_base (206)..(206): a, c, t, g, unknown or other
  misc_feature (206)..(206): n is a, c, g, or t
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattggtgttgacacagtctccagcccaccctgtctttgtcctccgaggggaanacgcccaccctctcctgccagggccagtcagagtcgtaacagctacttagcctggtaccanagaacctgcagactccgagcctcctnatcctangatgcataccaagacggccacgtcggcccaccctagcccgtacggttcagtacggccagggttcggtctacggggaaccagggtacctttaccgaccgttcctacccgaacgtcttaccgagtccctaacgtacccgtaaggtacgtcccggtaggtacgggtttacgtttacgacccgttagttttaaaccttcggttacgttacgtaacgtcctaaggtacgttacgtacggtaccgttaggtactcccggttaccgtaccggtaccggtaacggtaaccgtacgaaacgttagtaaaaccgtttaacggacgtaggtacggtaccgtacggacctaacccgttacgttccgttaacggttaccctttacgaccgttttacccgg

SEQ ID NO: 244309 - DNA, 595 bp, Homo sapiens
  misc_feature: GYAE6OF02ICTAF.11.71.G05.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (293)..(293): a, c, t, g, unknown or other
  misc_feature (293)..(293): n is a, c, g, or t
tcagcgagagataccacgaccggtgctcgatttagtgtcgtcgcaagagagagggggaactgctcagttaggacccagagggaaccatggaagccccagctcagcttctcttcctcctgctactctggctcccagatagcaccggagaaattgtgttgacacagtctccagcccaccctgtctttgtctccaggggaaancgccaccctctcctgcagggccagtcagagtgttaacngctacttgcctggtaccaacagaaacctggaccagcctcccaggcctcctcactntatcgatgacagtaccaaacgcggccaacgtcggccaaccccgagccaaggttcaggtgccgtaggttcgggtctagggaccagtacctcactcgtacaccgtatcgagcacgctaggacgtcgtaggtagttactttgactttagttttatactgttcagacgtagtacgtactacgtactaggtacctacggtacccgttccgggaaaccgaacgggtaacacggtaataagggtaaacttaacgcgtacggttggctacgaactccgagttactgttacctactccttcccgttacccg

SEQ ID NO: 244310 - DNA, 714 bp, Homo sapiens
  misc_feature: GYAE6OF02I6J8W.11.71.G05.1.454.CMB.1.raw
  modified_base (204)..(204): a, c, t, g, unknown or other
  misc_feature (204)..(204): n is a, c, g, or t
  modified_base (244)..(244): a, c, t, g, unknown or other
  misc_feature (244)..(244): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaanacgccaccctctcctgcgagggccagtcagagtagtaacngctactagccgtggtaccaacagaaacctggccaagacctccgaggctcctcatctactgactcgacactaccaacgacggccactcggccaccctagccgtaggttcacggtcgcgtaggttcggtactcggggtacacggtaacttccgacgttcctaccgaacctagttaccgacgtacctacggtaccctaacgggaccgtaccgttagggacggtttacgttttcggaacgttaagtttttacgttaacgttcgtaccgaacggtccgaagttccgttaacgttaccggtaacgttacgggtaccttacccgtacccgggttacggtaacccgaaacgggtacctaaaccggtagtaaccggtaaaacggtttaaacccggtaacgttacgggtcggtaacccgtttacggaacccgtttaacgtacggttcctacggttttacccttacgtaccgttaccccgg

SEQ ID NO: 244311 - DNA, 612 bp, Homo sapiens
  misc_feature: GYAE6OF02H1CY8.11.71.G05.1.454.CMB.1.raw
  modified_base (263)..(263): a, c, t, g, unknown or other
  misc_feature (263)..(263): n is a, c, g, or t
  modified_base (316)..(316): a, c, t, g, unknown or other
  misc_feature (316)..(316): n is a, c, g, or t
  modified_base (354)..(354): a, c, t, g, unknown or other
  misc_feature (354)..(354): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttccctcgttgcttcttttaagaggtgtccagtgtcaggtgcaacgtggaggagtcgtgggggaggcgtggtccaggccgtgggaggtccctgagacctctcctgtacncgcctcgtggccttcaccttcattacctatggctatcgctacgtcgggtcccnccaagcctaccgagggcgagggggctgggaggtggggngctaggtttattcatagtgatggaaatggtcgtacttctacttcgagtaccgttcggaggtaacgggccgtagttacgtaccgtcctaccgagtagactaactccgacggccaaccgacgtcttagtactcgtcgaacaagttacgaacagtaccctagacgagtacgaggagaccgacggtcttcggtagtaacgttacgtggtaggacgtaagttacttacgttaatagggtaacggttcggtacggttacggggg

SEQ ID NO: 244312 - DNA, 657 bp, Homo sapiens
  misc_feature: GYAE6OF02IMLNQ.11.71.G05.1.454.CMB.1.raw
  modified_base (202)..(202): a, c, t, g, unknown or other
  misc_feature (202)..(202): n is a, c, g, or t
  modified_base (346)..(346): a, c, t, g, unknown or other
  misc_feature (346)..(346): n is a, c, g, or t
  modified_base (451)..(451): a, c, t, g, unknown or other
  misc_feature (451)..(451): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaaagngccaccctctcctgcagggccagtccaggagtagttaacagctacttagcctaggtaacccaacagaaacctggaccagacctaccaggtctcctcatctatgatgcactccaacgtacgggaccacgtcggaccaacccccgngacccgtaggttcaaggtcgacgtaggtacggtcgtgggacaggtacttactacgtctccaacctactacgagaccacgacccgtaagacgcccgtagaaggttnttttaggtacttaagttttaattacttggttaccaggtactacgtagttactacggtaccgttagggtacctaccgtaccgttaccgggaccggtaaacgggaacctaacggtacgttaacggtaaacttaaacgggtaactggtacgtacgtacgaccgtaactagtttccgttacgtttacctacttaccgttcccttaccccg

SEQ ID NO: 244313 - DNA, 615 bp, Homo sapiens
  misc_feature: GYAE6OF02J10BN.11.71.G05.1.454.CMB.1.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (317)..(317): a, c, t, g, unknown or other
  misc_feature (317)..(317): n is a, c, g, or t
  modified_base (365)..(365): a, c, t, g, unknown or other
  misc_feature (365)..(365): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (499)..(499): a, c, t, g, unknown or other
  misc_feature (499)..(499): n is a, c, g, or t
  modified_base (513)..(513): a, c, t, g, unknown or other
  misc_feature (513)..(513): n is a, c, g, or t
  modified_base (551)..(551): a, c, t, g, unknown or other
  misc_feature (551)..(551): n is a, c, g, or t
tcagcgagagataccacgaccggtgctcgatttagtgtcgtcgcaagagagagggggggaggaggagcccagcactagaagtcggcggtgtttccattcggtgatcagcactgaacacagaggactcaccatggagtttgggctgagcttgggttttcctcgttgcttcttttaagaggtgtccagtgtcaggtgcaactgaaggngtcgnggggagcgtggccagccgtgggacgtccctgacgactctcctggtacagcctcgtggtaccttcaccttcatttaccctagtcggctatcgcacgtcggggtcccnccagacctccgaggcggagggggctgggaggtgggtcgacttagtttnttcaagagtgataggtaaatgtatacttacttatacaacgtctcggtaggtaacggcctacttccgaccgtctaccgagtacgaactactccgaacggcaccgtacncgtatacncgtacactaaacgtgaacncgacgtagacgtanacgtaggacgacgacggtcgtaggttagtaattaccgnggtaaccgaagttaacgttactttacgtaaacggttaggacgggttacggaccgggttacgggg

SEQ ID NO: 244314 - DNA, 673 bp, Homo sapiens
  misc_feature: GYAE6OF02HP8QX.11.71.G05.1.454.CMB.1.raw
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggttgtccagtgtcaggtgcaactggaggagtcgtgggggaggcgtggtccagccgtgggacggtccctgagactctcctgtacncgcctntggccttcaccttcattacctatggcatgacacgttcgggtcccgccagaccgtccgaggcggacgggggctggggaggtggggtcggctagtttattcatagtgtaagtaggaaattggtagtacttacgttattacaacggtaccttccggtagggaacgggtacctagttacccgtaccgttcctaccgaacgtaacgtaacctaacgttacccggaacggtacctaaccgacgtaccgttagttacctacgtcgaaacctaaacgtacgaaacctacgaccgtaggaacggacgtacggtagggaacggtaccgacgggtacgttaggttacgttaacgttacgttaggacgtaacgtaaagttctttacgtaagtaaggtaggtacggtacggttacggggg

SEQ ID NO: 244315 - DNA, 618 bp, Homo sapiens
  misc_feature: GYAE6OF02HJTRW.11.71.G05.1.454.CMB.1.raw
  modified_base (312)..(312): a, c, t, g, unknown or other
  misc_feature (312)..(312): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtgggacgtccctgacgactctcctgtacacgcctcgtggccttcaccttcattacctagtggcatgcacgtcgggtcccncagcctccgaggcgaggggctgggagtggggtgctagtttattcagtagtgagtaggtaaattgtagtactttctattcaagtaccgtccggtaggacgggtcctacgttccgacccgtctaccgagacgaacctaacttccgaggccaacgacgtctagtactcgtagaacaacgtacgaaacctacgcctaggacgacgtcgtaggaacgacgacggtcgttggttacggttacttacggtgtacggaacgtaaacggtttctttacgtaagttacggtaggtacgggtaccggttaccggggg

SEQ ID NO: 244316 - DNA, 681 bp, Homo sapiens
  misc_feature: GYAE6OF02JAYS7.11.71.G05.1.454.CMB.1.raw
  modified_base (148)..(148): a, c, t, g, unknown or other
  misc_feature (148)..(148): n is a, c, g, or t
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (292)..(292): a, c, t, g, unknown or other
  misc_feature (292)..(292): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccgganaaattgtgttgacacagtctccagccaccctgtctttgtctccgaggggaaangccaccctctcctgcagggccagtcagagtgtaacngctactagcctggtaccaacagaaacctggccagacctccagcctcctcatctangatgcactccaacgcgggccacgtcggcccaccccgagcctaggttcaggtcggacgtaggtcggggtcgtgggacacgtacttcacttactcaaccataccgacgcacgcctagcgtcctagggtacgttagtttcgacgttagttttacttacgttgtccgtacgtacgtacgtaccgttacgtccggtaacgttcggttaactacccgttacccgggttaccggggaacccgtaaacggggtaacccaacggggtaaaccgttaagggttaaaaccgtttaaacggaaaccggtttgggtaacgggtacccgttaacggacccgttaaccgttacgttacccggtttcgttacccgtttaccttaccgttaccccctttaccccgg

SEQ ID NO: 244317 - DNA, 651 bp, Homo sapiens
  misc_feature: GYAE6OF02GYRI5.11.71.G05.1.454.CMB.1.raw
  modified_base (320)..(320): a, c, t, g, unknown or other
  misc_feature (320)..(320): n is a, c, g, or t
  modified_base (401)..(401): a, c, t, g, unknown or other
  misc_feature (401)..(401): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagacctctcctgtacacgccttcgtggtccttcctaccttcaactttacctatcggcatgcacgtcgggtcccnccagacctccgaggcgaggggggctggggaggtggggtcggcgtagtttattcgattatgagtaggtaaatgtgtactttntattcgagtacctccggtaggaacgggtccgtacttaccgtacccgtctaccgaagacgtaacctaacgttacccgaacggtaccaaccgtaccgacttagttaccgtcgtacgaacctaaagttacgaaacctacggtacccgtaggaacgacggtaccgtagggaaccggaccgacggtcgtggttacgttaagttaccgtaggtacgtaacggtaagttacttaacgtagttacggaggttaacggg

SEQ ID NO: 244318 - DNA, 548 bp, Homo sapiens
  misc_feature: GYAE6OF02GNSIA.11.71.G05.1.454.CMB.1.raw
  modified_base (201)..(201): a, c, t, g, unknown or other
  misc_feature (201)..(201): n is a, c, g, or t
tcagcgagagataccacgaccggtgctcgatttagtgtcgtcgcaagagagagggggggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctctcctgcagggccagtcagagtgttaacagctacttagcctggtaccaacagaacctggccagactcccaggctcctcatctatgatgcatccaacgacgggccacgtcggccaccccagccaggttcagtggcaggtgggtctgggacagtacttcactctcaccatcagcacgcctagcgcgtggagttatttcgacttagttttattacgtgtacagcagtcgtatcgacgtggtactcctaccgttcgaccgaaggaccacgtacgtaggtaaacttaacgaacgtggtacgacgtcgactactactcgtacgttcttacgtactcccgtcccg

SEQ ID NO: 244319 - DNA, 637 bp, Homo sapiens
  misc_feature: GYAE6OF02F89GQ.11.71.G05.1.454.CMB.1.raw
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
  modified_base (342)..(342): a, c, t, g, unknown or other
  misc_feature (342)..(342): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagctgggttttcctcgttgcttcttttaagaggttgtccagtgtcaggtgcaactggaggagtcgtgggggagcgtggtccaggcctggggacggtccctgagactctcctgtacagcctntggcttcaccttcattacctatggcatgctacgtcgggtcccnccagacctccgaggcgagggggctgggagtgggngctagttattcatagtgataggaaatagtcgtactttctattcagtacctccggtaggaacgggtcccgtatttcccgaccgttccgtacccgaacggacgaactaacgttaccaggaccaacgacgtcttagtactcgtacgacaaatcgaacgtacgccgttaggacgacgtacgtaggaacggtaccgacgggtcgttaggttacggttaacgtttaccggttaggtacggtaacgtaaagttacgtttacgtaagttacgggtacgggttacggtaccgggttaccggggg

SEQ ID NO: 244320 - DNA, 688 bp, Homo sapiens
  misc_feature: GYAE6OF02GKF95.11.71.G05.1.454.CMB.1.raw
  modified_base (314)..(314): a, c, t, g, unknown or other
  misc_feature (314)..(314): n is a, c, g, or t
  modified_base (396)..(396): a, c, t, g, unknown or other
  misc_feature (396)..(396): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgacaactggaggagtcgtgggggaggcgtggtccagccgtgggacgtccctggagacctctcctgtacagcctctggccttccaccttcattaccctatggcatgctacgtcgggtcccncagcctccgaggcgagggggctgggaggtggggtgctagtttacttcgaattagtgaagttagggtaaattggtagtacttnttacttcagtacctcggtaggaacgggtcctacttaccgaccgtcctaccgagtacgtaactaacgttccgaacggaccacgacgtcgttacgtaacttccgtagaacctaaacgtacggaaacctacgtaccgttaggaacgacgtcgtaacggaacgggaacccgtacgggttcgtagggtttacgtttaacgtttacgttacgggtacggtaaaccgttaaaggttacgtttttacggtaaaggtaacgggttaacgggttaccgggtaacccgggtttacccgggggg

SEQ ID NO: 244321 - DNA, 671 bp, Homo sapiens
  misc_feature: GYAE6OF02FVC7C.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactggaggagtcgtgggggaggcgtggtccagccgtggggacggtccctgagactctcctgtacagcctctggcttcaccttcattacctatggcatgctacgtcgggtcccgccagacctccgaggcgagggggctgggagtggggtggctaggttcttcatagtgataggaaatagtgtactttctatttcaagtacctccggtaggaacgggccgtattccgacccggttctaccgaaggacgtaactaacttccgaaggccaacgaccgcttcgtactcgtagacctaaagtcgaaacacgtaccgtaggacgtacggtactacgggaacggaaccgtaccggtcgttaggttacggtttaaccgtttaccggttacgggttaacggtaaccggttaaaaggtttacgttttaccgttaaaggtaacggggttaacgggttacggggtaacccgggtttaacccggggggg

SEQ ID NO: 244322 - DNA, 533 bp, Homo sapiens
  misc_feature: GYAE6OF02F50SC.11.71.G05.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaaangccaccctctcctgcagggccagtcagagtgttaacngctacttagcctggtaaccaanagaaacctggccagactcccaggctccncatctatgatgcatccaacngggccacgtggccacccngccaggttccaggtgcaggtggtctgggacagacttcactctcacatcagcacgctagagctgaggtatttgctagtttattactgtcagcagcgtagtcgacgtggactactaccgttcgaccgtaacggacacgtactaggtaaacttaacggacgtggtacgtgtacgacacctacgtcgtcttacctctacttccttaccccg

SEQ ID NO: 244323 - DNA, 544 bp, Homo sapiens
  misc_feature: GYAE6OF02GNE0B.11.71.G05.1.454.CMB.1.raw
  modified_base (367)..(367): a, c, t, g, unknown or other
  misc_feature (367)..(367): n is a, c, g, or t
  modified_base (403)..(403): a, c, t, g, unknown or other
  misc_feature (403)..(403): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggacggtccctgagactctcctgtacagcctctggcttcaccttcattacctatggcatgcactcgggtccgccagacctccaggcgagggggctggagtgggtgcagttattcatatgagtagaatagtgacttntattcagtactcgtagaagggccgtattcaccgtcncagagacaattccgagcacacgctgtactctgacaaatgaaccacgtcgtaggagacgactaggaacgacgacggctgtacgttattacgtggtcgagtaaagtatttacgtaagtaggtaggtaggacggttaccggggg

SEQ ID NO: 244324 - DNA, 879 bp, Homo sapiens
  misc_feature: GYAE6OF02HD76N.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctgttgcttcttttaagaggtgtccagtgtcaggtgacaacgtgggaggtagtcggtggggggaggcggtcggtccaggtccgtggggacggtccctggacgtacctctccgtgtacacgtcctcgtggtccttacctaccctttctaactttaaccctagttcggactacgttcggcctaaccggttcggggtacccccgaccgtaacggtacccgtacccggaaggggtaccggggaacgggggggtccgttgggggtaacggggttggggggttacgggtaccgtttaaggttttaacgttttaccgaagtttaacgttagggtaaaggttaacgggtaaaatttaggttacggttaaccttttacgttaagttaccgtaacggtaacccgttaccgggtaagggtaaaccgggtccgttaccgttacccgtacccgttaccgtaacccgaaggtaacgtaaaccgtaacgttacccggaacgggacccaaccggttaccggtactttacggttaaccttaccgtacgtaaacctaacggttaacaaaccggtacgtaccggtaaggtaaccgtacggtacgtacggaaacggtaccgtacgggttcgttacggtttaacggttaactttacgggtaaggtaccgtaaacggttaagtttaacttttacggtaaagttacgggtaagggttaccgggtaaccggggtttaaccggggg

SEQ ID NO: 244325 - DNA, 747 bp, Homo sapiens
  misc_feature: GYAE6OF02GQY8B.11.71.G05.1.454.CMB.1.raw
  modified_base (203)..(203): a, c, t, g, unknown or other
  misc_feature (203)..(203): n is a, c, g, or t
tcagcgagagataccacgaccggtgctcgatttagtgtcgtcgcaagagagaggggagaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacagctacttagcctggtaccaacagaaacctggaccagacctcccgaggctcctcatctatgatgccatccaacgacgggccacgtcggccaccccaggcccaggttccaggtcggactagggttcgggtcgtaggggactaggtacctttcaaccttccgtaccgaccctaattccgaacgacctacggtacccgttaacggacggtacccgttaggtaacgggttatttttcggaccgttaaggtttttaactttaaccgtttacggtaccgtaacgtaccgtaagggtaccgttaacgtaccgggtaacgttacgggtaaccgttacccgttaaccccggtttaccgggaaccccggtaaacggggtaacccgtaaccgggtaaccggtttaacgggtaaaaaccgtttaaaaccgggtaaaccgtttacgggtaccgggtaccgttacggtacccgttaacccgttaaccgtttccgtttacggtttacccttacgttaaccccg

SEQ ID NO: 244326 - DNA, 584 bp, Homo sapiens
  misc_feature: GYAE6OF02FVN7F.11.71.G05.1.454.CMB.1.raw
  modified_base (305)..(305): a, c, t, g, unknown or other
  misc_feature (305)..(305): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctgggggagcgtggtccagcctgggagtccctgagacttctcctgtacagcctctggcttcaccttcattacctatggcatgctacgtgggtcccncagacctccgaggcgagggggtctgggagtgggtggctagttattcatatgataggaaattagtgtacttctattcgagtacctccgagaacggccgtattccaccgtctacagacgaacaacgttccaggtccaacgacgtctagtactcctagacaaagtcgaaacgtacgaccgtagaacgcggcgtacggacggaccgtacgggtcttaggtacgttaacttaaccgtaggtacgtacgtaaacgttatttacgtaagttaggtaaggttacggg

SEQ ID NO: 244327 - DNA, 681 bp, Homo sapiens
  misc_feature: GYAE6OF02HBVNK.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcgttgggttttcctcgttgcttcttttaagaggtgtccagtgtcaggtgcaacgtggaggagtcgtgggggaggcgtggtccaggccgtgggacggtccctgacgacctctcctgtacagccctctggccttccaccttcaatttaccctatcggacagtcgcctacgttcggggtcccaccacgacctccgaagggccggacgggggtctggggaggtggggtgctagtttattcatagtagataggaaattgtagtactttgtattcgaacgtaccgtccggtaggaacgggtcctacgttcccgacccggttctacccgaaggaaccgtaactaaacgttcccgacggacccacgaaccgtcgttagtactcgtacgaacaatacgaaccgcgacgtagacgacgtcgtaggaacggaccgtacggtcgttaggtacgtttacgttaccggttggtaacggtaacgtaaaagtttccgtttaacgtaaggttaacgggtaacgggtttaccggaccggggttaaccggggg

SEQ ID NO: 244328 - DNA, 646 bp, Homo sapiens
  misc_feature: GYAE6OF02IOH66.11.71.G05.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
tcagcgagagataccacgaccggtgctcgatttagtgtcgtcgcaagagagagggggggggagaggagcccagcactagaagtcggcggtgtttccattcggtgatcagcactgaaacacagaggactcaccatggagtttgggctgagctgggttttcctcgttgcttcttttaagaggtgtccagtgtcaggtncaactggaggagtcgtgggggaggcgtggtccagccgtggggacggtccctggagacctctcctgtacagtcctcgtggcttcaccttcactttaccatggcatcgcacgtcgggtcccnccagacctccgaggcgagggggctgggagtggggtgcgtagttattcatatgaataggaaatgtatactttctatcagtacctccggtaggacggcgtattccgaccgtctacgagacgtaactaacttccgaggaccacgtacgtctcgttactcgtacgaactaaagtacgaaactcgaccgtagaacgcgtacggtacggaacggaaccgtacgggtacgttaggtacggtttagtttaaccgtgggtaacggtaaccggtaaaagtttacgttttaacgtaaggttaacgggtaagggttaccggtaaccgggttaaccggggggg

SEQ ID NO: 244329 - DNA, 653 bp, Homo sapiens
  misc_feature: GYAE6OF02HKK6X.11.71.G05.1.454.CMB.1.raw
  modified_base (265)..(265): a, c, t, g, unknown or other
  misc_feature (265)..(265): n is a, c, g, or t
  modified_base (337)..(337): a, c, t, g, unknown or other
  misc_feature (337)..(337): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaactggaggagtcgtggggggaggcgtggtccagccgtgggacggtccctgagctctcctgtacagcctntggcttcaccttcattacctatggcatgccacgtcgggtcccgccagacctccgaggcgaggggggctgggnggtggggtgcgtagtttattacatagtgtagtaggaaattaggtagtactttctattacgacgtaccgtccggtaagggaacgggtccgtacttcccgaccgttcctacccgaaggtaacgaacctaaacgttcccgaaggcccaacgtaccgtcttagtactcgtacgaactaaatacgaactacgtcctaggaacgcgtacgtaggaacggacgacggtcgttaggtcgttaagttaccgttggtacgtaacggtaaagtttactttacgtaagttaacgggtaacgggttacgggtaccgggttaccgggggg

SEQ ID NO: 244330 - DNA, 658 bp, Homo sapiens
  misc_feature: GYAE6OF02HA2Z7.11.71.G05.1.454.CMB.1.raw
  modified_base (313)..(313): a, c, t, g, unknown or other
  misc_feature (313)..(313): n is a, c, g, or t
  modified_base (350)..(350): a, c, t, g, unknown or other
  misc_feature (350)..(350): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtgggacggtccctgacgactctcctgtacagtcctctggtcttcaccttcattacctagtggcatgacacgtcgggtcccnccgagacctcgaggccggagggggctgggaggtgggnggcgtagtttattcatagtgagtaggtaaatgtagtacttctatcagtacctcggtaggaacgggtccgtattccaccgtcctaccgagacgtactaattcccgaagccactacggcttagtacttcgtacgactaaagtcgaaacgtaccgccgtagaacggtacgtacggcggtaaacgggaccgaaccggtcgttaggtttacggttaactttaaccggtggttaacggtaaaccggttaaagtttacgtttaacggtaaaggtttagggtaacgggttacggttaaccggggttaacccggggg

SEQ ID NO: 244331 - DNA, 677 bp, Homo sapiens
  misc_feature: GYAE6OF02H2WRQ.11.71.G05.1.454.CMB.1.raw
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgctcgaggggaaancgccaccctctcctgcagggccagtcagtgtgttaacngtctactagcctaggtaccaacagaaaccgtggaccagacctcccgaggcctcctcatcctatgatgcactcccaaacgacgggccctaacgtcggaccccaccccgagccccgtaggttccgaaggtcggctaggggttcgggtctacggggacacggtaccttcgaacttccgtaaccaccgtacttccgaacgtccacgtacccgtaggaccgtccgtaggttacgggttatttcggaacgtttaggtttttaacttaccgttcggttaacgacgttaccgaagtccgttacgtaccggtacgttacggtaccttaccgttacccggtacggaaccggtaaacggaccaacggtaacgtaggtaaaacttacggtagttacggtcgtacgtacgacctacgttagttccttcggtcttaccgacctttccccgg

SEQ ID NO: 244332 - DNA, 670 bp, Homo sapiens
  misc_feature: GYAE6OF02GCH9J.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggagcgtggtccagccgtgggacggtccctgacgacctctcctgtacacgcctctggcttccaccttcattacctatggctagtcgctacggtcgggtcccacacggtaacctccggagggcggacgggggctgggaggttggggtcgacgtagtttattcgatagtgaagttaggaaattgtgtactttctagtcacgtaccgtcggtaggaacggtccgtattcccgaccgtacctaccgaacggtacgtaacctaacgttacccgaggtaccaccgtaccgtcgttacgtactcgtacgactaaagtcgaaaccgtcggtacgtagaacggtacgtacgtacggacggtaccgccggtacgttcggttaacgtttaccgttaacggtacggttaacggtaaccgttaaaggttaccttttacggtaacggttagggtaggttaaccgggg

SEQ ID NO: 244333 - DNA, 884 bp, Homo sapiens
  misc_feature: GYAE6OF02FKDCC.11.71.G05.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtntccagtgtcaggtncaacgtggaggagtcgtgggggagcgtggtccagccgtgggacgtccctgacgctctccgtgtacacgcctcgtggtccttcctacctttcaactttaccgttagtcggcattcgacctacgtccggggtccccgaccgaacggacccgttccggagggccggaacgggggggtctagggggacgggttcgggggtcggaccgttaaggttttaacttacgtaagttacgtggtaaggtttaagggtaaaattacgggttaacgttaaccgttttaccgttaattttacccggaaacgttacccggttacccggggttaaacggggaaaccgggggttcccggttaacgtttaccccggtaacccggttaccccgtaaacccggtaaacgggtaaaccggtaaacccgttaaaaccgttcccgggaaaccgggtacccgaaccggttaacccggttaccggtttacggttaaccgtttaccgtacggtaaaaccgtaacgttaacggaaacccgtaccggtaccgtaagggtaacgaacgtcggtacggaaacgggtaaccgtaccgggtcggttaacggttacgtttacgttaaccggttaacggtacggttaaccggttaaaagtttaccgttttaacggtacggttaagggtacgggtttaccggtaacgggggtttacccggggg

SEQ ID NO: 244334 - DNA, 575 bp, Homo sapiens
  misc_feature: GYAE6OF02JGRJ9.11.71.G05.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (241)..(241): a, c, t, g, unknown or other
  misc_feature (241)..(241): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaanagccaccctcncctgcagggccagtcagagtgttaacngtctacttagcctaggtaccaacagaaacctggccagactcccaggcctcctcatctatgatgcactccaagacgggccacgtcggccaccccgagccgtaggttcaggtcggctagggtcgggtcgaggggtaccaggcttacacgttcaccgaccatccacgcgacgcctagacgctgaggtagtttcgacgttagtttacttacttagtcacgctagtcgtatcgacttacggactccgtacgttcgaccgaacggacacgtaacgtagtaaataaccggaacttcgtacggtctacgcgtacctagtccttagtcttacgtacttacccg

SEQ ID NO: 244335 - DNA, 796 bp, Homo sapiens
  misc_feature: GYAE6OF02JBCJE.11.71.G05.1.454.CMB.1.raw
tcagcgagagataccacgaccggtgctcgatttagtgtcgtcgcaagagagagggggggggagaggacgcccagcactagaagtcggcgtgtttccattcggtgatcagcactgaacacagaggactcaccatggagtttgggctgagcttgggttttcctcgttgcttacgttttaaagaggtgtccagtgtcaggtgcaacgtggaggagtcgtgggggaggcgtggtccagccgtggggacgtccctagacgacctcttacccgtgtacacggccctcgtcgggtcttaccacctttcaactttaacccttaattgggcccaagtgtaccgaaccgttcggggtacccgacccagacctcccgaagggccggaaggggggtccgtaggggtaggtcggggtgggtcctaaggtttaattttccaattacgtgtaagtaggtaaataggtataccttttatatttacgaacgtaaccgccggttagggaaaccggggtccgtacgtttaccgaacccgttaccgttacccgaaacggtaacggtaacctaaactttaccggaacgtccgtaaaccgtaaccgcgtttaacggttaacttaccgttacggacctaaaagtacgtaaaccgacgtacccttaggaacggacgaacgttacgaaacgggtaacccggtacggtaccgttagggttacgttaacgtttaaccgttagggtaacgtaaccggttaaacgggttaacttttaaccggttaaagtacgggtaagggttacggaccgggttaacccgggggg

SEQ ID NO: 244336 - DNA, 665 bp, Homo sapiens
  misc_feature: GYAE6OF02HT9WX.11.71.G05.1.454.CMB.1.raw
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
  modified_base (538)..(538): a, c, t, g, unknown or other
  misc_feature (538)..(538): n is a, c, g, or t
  modified_base (547)..(547): a, c, t, g, unknown or other
  misc_feature (547)..(547): n is a, c, g, or t
  modified_base (556)..(556): a, c, t, g, unknown or other
  misc_feature (556)..(556): n is a, c, g, or t
  modified_base (583)..(583): a, c, t, g, unknown or other
  misc_feature (583)..(583): n is a, c, g, or t
tcagcgagagataccacgaccggtgctcgatttagtgtcgtcgcaagagagagggggggagaggagcccagcactagaagtcggcggtgtttccattcggtgatcagcactgaacacagaggactcaccatggagtttgggctgagcgtggttttcctcgttgctctttaagnggtntccagtgtcaggtgcaactggaggtagtcgtgggggagcgtggtccagccgtggggacgtcctgacgtactcctctgtacngcctntaggcttcaccttnacttacctagtggcatcgccacgtcggggtcccncagaccctcgaggcgagggcgtaggaggtggggcgcgtagtttacgttcatatgatagggaaacttggtacgtacctttacttatttacgaacgtccgttcggtagggtaaacgggtccctactttacccgaaccggttccttaacccgaaggaacgtaaccgttaaacgttcccgaaggacctaaccaacggtccttagtcttagtcgactaaagtcgaaaccgtnacccgttanaacgggtanaccggttaggaaccgggactaccggtnttacggtaggtaacttaggtacggctaaagggtaatacttttacggtaagtaggtaacggtttccgaacggttaccgggggg

SEQ ID NO: 244337 - DNA, 855 bp, Homo sapiens
  misc_feature: GYAE6OF02HG1T8.11.71.G05.1.454.CMB.1.raw
  modified_base (199)..(199): a, c, t, g, unknown or other
  misc_feature (199)..(199): n is a, c, g, or t
tcagcgagagataccacgaccggtgctcgatttagtgtcgtcgcaagagagagggggaactgctcagttaggacccagagggaaccatggaagccccagctcagcttctcttcctcctgctactctggctcccagatagcaccggagaaattgtgttgacacagtctccagccacctgtctttgtctccgaggggaaanagccaccctctcctgcaggccagtcagagtgttaacagctacttagcctggtaccaacagaaacctggaccagacctcccaggcctcctcatctatgatgcatccaacgcgggcccacgtcggaccacccccgagtccgtacgggtttccaaggttcggaccgtagggttcgggggttctagggggaacctaaggtacctttccaaccgttccttaccgaacccaattccgaacggtccaacggtaccccgttaagggaccggtaccccgttagggtaacgggtttaattttttcgggaaccgttttaaaggtttttttaacgttaaccgtttcggttaacccggtaacgtaccgtaaacggttccggtttaaaccgtttccgggtaaaccgttttacggggtaaacctttcccccggtttaaaccccggtttttacccgggggtaaaccccgggaaaaaccggggggttaacccctaaaaccgggttaaacccgtttaaaacgggggtaaaaaaccctttttaaaaaaccggggtaacccgttttacggggttaacgggtaccgtttaaccggaacccgttaaaccccgtacgttttaccggtttaccggtttaacccttttacccggttacctttacccccgtttaacccccgg

SEQ ID NO: 244338 - DNA, 783 bp, Homo sapiens
  misc_feature: GYAE6OF02GP7HR.11.71.G05.1.454.CMB.1.raw
  modified_base (250)..(250): a, c, t, g, unknown or other
  misc_feature (250)..(250): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttacttttaagaggtgtccagtgtcgaggtgacaacgtgggaggagtcgtgggggaggcgtggtccgagccgtgggacggtccngacgactcctcctgtacacgtcctcgtcggtcttcctacctttactacttaccttagtggacctatcgacctacgttcgggtcccgaccacggacctaccgagggcggacgggggcgtaggggtaggtcggggtaggtacgttaaggtttacttttacgaattagtaggtaagttaacgggtaaagttagttacggttaaccttttacgttaactttaccgtaacggttaaccggttcccgggtaagggtaaaccggggttcccgtaacgtttacccgtacccgttccgttaccgaacggtaccgaacgtaaccgttacccggaacggaccgaaccgtaccgtccgttagttaccgtacgtacgaacgtaaacgtacgaaaccgtacgtaccgtaggacggtaacgtcggtacggaaccgtaccggtaccggtagttacgtacgtttaacgtaccggttaggtaaccggtaacgttaagttacgtttaacgttcggtaaggtacggggttaccggtacggggtttaaccgggg

SEQ ID NO: 244339 - DNA, 557 bp, Homo sapiens
  misc_feature: GYAE6OF02GDEIY.11.71.G05.1.454.CMB.1.raw
  modified_base (261)..(261): a, c, t, g, unknown or other
  misc_feature (261)..(261): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggaggtccctgagactctcctgtacngcctctggcttcaccttcattacctatcggctatgctacgtcgggtccgccagcctccgaggcgagggggctgggagtggggtggctagttattcatatgataggaaatgtagacttctattcagtactccgtagaacgggccgtattccgaccgtctaccagacgacaacttccgaggtcacacgctgtatctgacaaagtcgaacacgtcgtagacgacgcgtaggaacgacgacggtcgtggtagttacttacgtgtagacgtaaagttatttacgtaagtaggtaggtacgg

SEQ ID NO: 244340 - DNA, 617 bp, Homo sapiens
  misc_feature: GYAE6OF02H90M5.11.71.G05.1.454.CMB.1.raw
  modified_base (179)..(179): a, c, t, g, unknown or other
  misc_feature (179)..(179): n is a, c, g, or t
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (477)..(477): a, c, t, g, unknown or other
  misc_feature (477)..(477): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttcttttaagnggtgtccagtgtcaggtgcaacgtggaggagtcgtgggggagcgtggtccagcctgggacgtcctgacgactctcctgtacngcctctggcttcaccttcattacctatgcatcgcactgggtccncagacctccaggcgagggggctgggaggtggggtgctagttattcgattagtgatggaaacttggtacgtactttactagttccgaagtaccgttccggtaggaacgggcctactttaccgacccggttctaccgagacgaactagttaccgacggcaacacgtctgtactntacgacctaaagtcgaaacgtcgaccgttagacggagcgtaaggacggtaaccgacggtccgtggttacgtttaacgttacggtacgttaacggaacggtaaagttacgttttaacgaaggttacgggaggttaaccggg

SEQ ID NO: 244341 - DNA, 667 bp, Homo sapiens
  misc_feature: GYAE6OF02GKBCL.11.71.G05.1.454.CMB.1.raw
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
  modified_base (483)..(483): a, c, t, g, unknown or other
  misc_feature (483)..(483): n is a, c, g, or t
  modified_base (490)..(490): a, c, t, g, unknown or other
  misc_feature (490)..(490): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttccctgtttgcttcttttaagaggtgtccagtgtcaggtgcaagtggaggngtcgtgggggagcgtgtccagcctgggacgtcctgagactctcctgacngcctctggtcttccaccttcacttacctagtggcaataccacgtgggtcccgcgacgtacctccgacggcgagggggctggacggtgggtcgacgtagtttacttcagtatggagtaggtaaatgtacgtacttcgttaacttcgaacgttaccgtcccggtaaggtaaccgggacctacttacgtacccgtacctcgaacgtacgaacctacgttcccgaggaccncaccgtntacgttcgtctacgtactaaagtacgaacagtacccgtagaacggtacgtcggtaacgcggtaaccgtcgggtacttaggttacggttaacgtttcggttaggtacgtaaacgggttaaattacgtttacgttacgtaacggggtacgtaccgggtaacggggttccggggttaccg

SEQ ID NO: 244342 - DNA, 657 bp, Homo sapiens
  misc_feature: GYAE6OF02IQWL9.11.71.G05.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (496)..(496): a, c, t, g, unknown or other
  misc_feature (496)..(496): n is a, c, g, or t
tcagcgagagataccacgaccggtgctcgatttagtgtcgtcgcaagagagagggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaangccaccctctcctgcagggccagtcagagtgttaacngctacttagcctggtaccaacagaaacctggccagacctccaggctcctcatctatgatgcatccaacgacggggccactcggacccaccccgagccctagggttcaggtcggcagggtcgggtcgtgggactaggtaccttcgacctctcccaacctactccgaacgccaccggtaccgtacggacgtcccttagggtacggttatttggacctttaagttttacttcgttagtaccgagtccgtgtaccgtnttaccgacgtggtaccttaccgtacccgttccgggtaaccgaaacgggtacccgtaacgggtaaccgtaggtaaaaacgttaaaccggaacgttacggtacggtacctaggtaacccacgttacgttcccgtttgttaccctttaccgtacccgttccccg

SEQ ID NO: 244343 - DNA, 844 bp, Homo sapiens
  misc_feature: GYAE6OF02H4CAY.11.71.G05.1.454.CMB.1.raw
  modified_base (159)..(159): a, c, t, g, unknown or other
  misc_feature (159)..(159): n is a, c, g, or t
tcagcgagagataccacgaccggtgctcgatttagtgtcgtcgcaagagagaggggggggagaggacgcccagcactagaagtcggcggtgtttccattcggtgatcagcactgaacacagaggactcaccatggagtttgggctgagctgggtttccncgttgctctttaagtaggtgtccagtgtcaggtgcaacgtggaggacgtgtgggggagcgtggtccagcgtcgggacggtcctagaggtacctctccgtagtacgagcctcgtcggacttacacccttcgaatttaacccgaattcggcctaatggtacaaccggttggggtaccccaccgagtaccttccggaaggtcggaagggggtcctagggtaacggtggggtacggtacaagttttagttttacccgaattttaagcccgggtaaagtttaccgggtaaaaaagtaccggtttgtaaaaccggttttaccctttaaattaacgaacccgggtaccgtttaacccgggtacgggtaaaacggggggtttaccccacgtttaacccgtaacccgggtttaccctaaccggtaaaggaacctaacgtaaaccgtttacccgaacgtaccggaacctaaaccgggtacgttaacgttacgttacttaacggaccgttaaacgtaacgaaaccgaccgtacgttaacggacggtaacgtaccgggttagaaccgggtaaccgtacgggacctttaacggttacggttaattaacccggttaggttaaccgttaacggaaaacggtttacttaacggttaaaccgttaaggggtaacggttacggggtaaccggtacccgggggg

SEQ ID NO: 244344 - DNA, 765 bp, Homo sapiens
  misc_feature: GYAE6OF02H47RA.11.71.G05.1.454.CMB.1.raw
  modified_base (287)..(287): a, c, t, g, unknown or other
  misc_feature (287)..(287): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggtagtttgggctgagtcgttggggttttccctcgttgcttacgttttaagaggtgtaccgagtgtcaggtgcaaacgtgggaggtagtcggtgggggaggtcgtggtccgagccgtgggacggtccctgacgacctcctctagtcacgcctcgnggtccttcaccctttcacttaacctagtcggactatcggaccacggtcggtccccgacgacgacccgtccgagggtcggacggggtcgtggggtacggtggggtcgtacgtaagtttagttacgaattagtagtacgtaaaggtaaacttaggtctaacttttcgtaacgttccgtaaagtcccgttaaccgggtagggtaacccgggtaccgtttacgttaccccgacccgttacctacccggaagtaacgtaactaacgttacccggaaggtaccctaacggtaccgtacgttcgttactacggtagtaacctaaagttaaccgaaacgtaccggtacgtaggaaagtcggtacggaaggaaccggacccgtaacggtcgttaggttaacgttaacgttaccggttagaacggttaacgtaaagtttcgtttaacggaagttacggggttacgtaccgggttaggttaaccggggg

SEQ ID NO: 244345 - DNA, 631 bp, Homo sapiens
  misc_feature: GYAE6OF02GXY3J.11.71.G05.1.454.CMB.1.raw
  modified_base (202)..(202): a, c, t, g, unknown or other
  misc_feature (202)..(202): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccacctgtctttgtctccaggggaaanagccaccctctcctgcagggccagtcagagtgttaacagctacttagcctggtaccaacacgaaacctggaccagacctcccaggcctcctcatctatgatcgcatccaaacgagggcccacgtcggcccaaccccgacgccgtaaggttcaggtcggacaggtggtctgggacagtacttcactcacacattacgcacgctagacgtccgtgaaggttattttacgacttaacgttttacttacttcgttacgacgtacgacgtacgtaactcgtaacgtaggtactacccgtaccgttccggaacgaaacgggtaccaacggtacgtaacggtaaaacgttaaaccgtaacggtcggtaacggtacgtacgaacccgtaccgtaacttccgttacgttacccttaccgtaccttcccggttaccccg

SEQ ID NO: 244346 - DNA, 676 bp, Homo sapiens
  misc_feature: GYAE6OF02F6920.11.71.G05.1.454.CMB.1.raw
  modified_base (315)..(315): a, c, t, g, unknown or other
  misc_feature (315)..(315): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcgttgggttttcctcgttgctcttttaagaggtgtccagtgtcaggtgcaactggaggagtcgtgggggagcgtggtccagccgtggggacgtccctgagactctcctgtacagcctcgtggccttctaccttcaattacctagtcggcatgcctacgtcgggtcccnccagacctccgaggcggagggggctagggaggtgggtcggcgtagtttacttcagttagtgaagttagaaagttgtcgtactttatattacgacgtaccgttcggaaggaacgggtccgtagttacccgaccgttcctaccgaggacgtaacctacttaccgacgtccacgcgtactcgttaatcctagaactaaagtacgaaccacgtaccgtaaggacgaggaccgtaggaacggtaccgtaccgggtcgttaggttacggtttaaccgtttacgttacgggtacggtaaacggttaaaacgtttgttttaaaccgtagggttaaggtacgggtacggtaaccggggtttcccgggggg

SEQ ID NO: 244347 - DNA, 641 bp, Homo sapiens
  misc_feature: GYAE6OF02FOLAC.11.71.G05.1.454.CMB.1.raw
  modified_base (392)..(392): a, c, t, g, unknown or other
  misc_feature (392)..(392): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggagcgtggtccagccgtgggacggtccctgagactctcctgtacagcctctggcttccaccttcattacctagtcggctagtgcctacgtcggggtcccgccagacctccgaggcggagggggctggggaggtggggtggctaggtttattcaattagtgataggaaatgtgtactttntattcagtcctcggtagaacggctattccaccgtctaccagacactaacttccgagccaacgacgtcttagtactcgtgaactaaagtacgaaaccagtacccgtagaaggacgtacgtacggaaacggtaccgaccgggtacgtaggttacggttaacttaccgttaggtacggtaacggtaaaggtttacgtttacgttaaacggtagggtaacgggttacggtaaccggggtttaacccggggggg

SEQ ID NO: 244348 - DNA, 685 bp, Homo sapiens
  misc_feature: GYAE6OF02HKF32.11.71.G05.1.454.CMB.1.raw
  modified_base (202)..(202): a, c, t, g, unknown or other
  misc_feature (202)..(202): n is a, c, g, or t
  modified_base (243)..(243): a, c, t, g, unknown or other
  misc_feature (243)..(243): n is a, c, g, or t
  modified_base (652)..(652): a, c, t, g, unknown or other
  misc_feature (652)..(652): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggcctcccagatagcaccggagaaattgtgttgacacagtctccagccaccctgtctttgtctccgaggggaaanacgccaccctctcctgcgagggccagtcagagtagttaacngctacttagcctggtaaccaacaacgaaacctcggaccaacgacctccgagtcctcctcattctatgatcgcactaccgaacgcggccagtcgaccacccgagtccaggttcaggtcggacgtagggttgggtccgtaggggaccaggtacctttccgaactttccgacctacccgaacgtccgacgtccgaacgtccgtaaggccggtaccctaggggtaacggttagttttcgacgttttaagtttttaccgtttacgttcggtacctacgggtctacgggttactaacgtttccggaagttccggtaacttccccggttaacgtcccggtaaccgaaagggtacctaaccgggtaacgtaaggtaaaccgtttaacgaaggttcggtacgactccggactaccgtntaccgttgtacctttcgtacgttcccctaccgg

SEQ ID NO: 244349 - DNA, 571 bp, Homo sapiens
  misc_feature: GYAE6OF02GXNKS.11.71.G05.1.454.CMB.1.raw
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
  modified_base (462)..(462): a, c, t, g, unknown or other
  misc_feature (462)..(462): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaactgggaggagtcgtggggggagcgtggtccagccgtgggaggtccctgacgactctcctgtacagcctctggcttcaccttcattacctatggcatgcacgtcgggtccncacgctccgaggcgaggggctgggaggtggggtgctaggttattcatagtgataggaaatgtnacttctatcagctcgtagacggactatcaccgtctcagacgacaacgttccaggcacgacgtctacgtatcgtagacaaatacgaaacncgtacctagaacgcgtagacgacggacgaccggtactcggtaggtttacttacggttaggtacgtaacggtaagttacgtttacgtaagtttagggacggttaacgggg

SEQ ID NO: 244350 - DNA, 655 bp, Homo sapiens
  misc_feature: GYAE6OF02G4G5X.11.71.G05.1.454.CMB.1.raw
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
tcagcgagagataccacgaccggtgctcgatttagtgtcgtcgcaagagagaggggggggagaggagcccagcactagaagtcggcggtgtttccatcggtgatcagcactgaacacagaggactcaccatggagtttgggctgagctgggttttcctcgttgcttctttaagaggtgtccagtgtcaggtgcaacgtggaggtagtcgtggggggagcgtggtccagccgtggggacgtccctgagtactctcctgtacacgcctctggccttcaccttcattacctatggcatgcncgtgggccgccgagccnccgaggcgagggggctgggtagtggggnggtctagtttattcaattgtagaagtaggaaatggtactacttcgtaattcgagtaccgttccgtagggaacgggtccgtacgttccgacccgttacacccgtagaacgaacctaacgttacccgaacggtaccacgtacgtctacgtacgtcgtacgactaaagtagaaccgtacgtacctaggacgacggtaccgtaggaacggccgtaacggtcgttacggtaggttaacgttagttacggtaaggtaacgtaaacgttacgtttacgtaagttaacgggtagggttaccgggaccgggttaccggggg

SEQ ID NO: 244351 - DNA, 515 bp, Homo sapiens
  misc_feature: GYAE6OF02GL4QN.11.71.G05.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (496)..(496): a, c, t, g, unknown or other
  misc_feature (496)..(496): n is a, c, g, or t
tcagcgagagataccacgaccggtgctcgatttagtgtcgtcgcaagagagagggggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctntcctgcagggccagtcagagtgttaaacagctacttagcctggtaccaacagaaacctggccagactccagctcctcatctatgatgcatccaanaggccactggccacccagtccaggttcagtggcagtcgggtctggganacgactttcactcncaccatcagcacgacctagagcctgaggtatttgctagtttatactgtcagcagcgtagtcacgtgatcgaccttacgccaaggacacgactaggaacttaagaactggtacgtctacgacaccagtactnttactacgtactcttcccg

SEQ ID NO: 244352 - DNA, 705 bp, Homo sapiens
  misc_feature: GYAE6OF02H2P7C.11.71.G05.1.454.CMB.1.raw
  modified_base (203)..(203): a, c, t, g, unknown or other
  misc_feature (203)..(203): n is a, c, g, or t
  modified_base (243)..(243): a, c, t, g, unknown or other
  misc_feature (243)..(243): n is a, c, g, or t
tcagcgagagataccacgaccggtgctcgatttagtgtcgtcgcaagagagaggggggaactgctcagttaggacccagagggaaccatggaagccccagctcgagcttctcttcctcctgctactctggctcccagatagcaccggagaaattgtgttgacacagtctccagccacctgtctttgtctccgaagggggaaancgcccaccctctcctgcacgggccagtcagagtgttaacngctacttagcttaggaccaacagaaacctggaccaagcctcccaggcctactcatctaatgatgactacgtacaaacgtgggacctacgtacggacccaaccccgagtacccgtaggttccaagggttcggaccgtagggttcggggtactagggggactaacgtaccgtttacacccgtacttaccgaaacccgttatccgaacgccgaacgtacccgtaaagtaccggtaccgtaagggtaacggtttaacgttttacgtccgttaaagtttttaacgttaacgttacgtttaacgacgtaccgtacgtaccgtaacgtacggaccgtaggtaacttccgtaaccgttaccaacggggggtaacaaacgaccgaacgttacgtaaacgttaacgaaccgttggtacggtactacggactaccgtattaccgtagttaccgttctaccgttccgtaacccg

SEQ ID NO: 244353 - DNA, 829 bp, Homo sapiens
  misc_feature: GYAE6OF02JKF93.11.71.G05.1.454.CMB.1.raw
  modified_base (186)..(186): a, c, t, g, unknown or other
  misc_feature (186)..(186): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
tcagcgagagataccacgaccggtgctcgatttagtgtcgtcgcaagagagagggggggaggaggagcccagcactagaagtcggcggtgtttccattcggtgatcagcactgaacacagaggactcaccatggagtttgggctgagctgggttttcctgttgctctttaagaggtgtccagtgtnaggtgacaacgtggagaggtcgtgggggaggcggtggtccagccgtgggacggtccctgagactctcctgtacngcctntcggcttccaccttctacgttaccctatggacatgacgtaccgtggggtccccgaccacggtaacctcccgagggacggaggggggtcctagggggtacggtgggggtcggcgttaacggttttattttacgaagttacgttagggtaaccggttaagggtaaaagtttaccgggtagtaacctttttactacgtttaaccggtaaagtacccgtttcccgggggaaggtaaaccgggttcccggtacgttttacccgaaccggttcccgttaccccgaaaaggtacccggtaaactaacgttacccgaagacccgacgtacggtacttagtaccgtctacgaactaaacgtcgtaaactaccgaccgttaagaacgggacgtaacggtaaccggtaacgggtaacccgaaccgggttccgtttaggggttaaaccgttttaacggtttaccggttaaccgggttaggtaaaccgggttaaacgttttaaccgttttaaccggtttaacgttaacgggggtaacgggtttaacccggttacccgggggtttaaacccggggggg

SEQ ID NO: 244354 - DNA, 715 bp, Homo sapiens
  misc_feature: GYAE6OF02JDBHK.11.71.G05.1.454.CMB.1.raw
  modified_base (178)..(178): a, c, t, g, unknown or other
  misc_feature (178)..(178): n is a, c, g, or t
  modified_base (322)..(322): a, c, t, g, unknown or other
  misc_feature (322)..(322): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttctttaagnggtgtccagtgtcaggtgcaactggaggagtcgtgggggagcgtggtccagtccgtgggacgtccctgagtacttctccgtgtacacgcctcgtggcttccacctttcacgttacctagtcggcattcgcacgtcgggtacccnccaagacctccgaggcgagggggcctgggaggtggggtgaccgtagtttactttcgaagttagtaggacgttagggtaaaacttcggttacggtaacctttcgtaacttacgaacggtaacctttccgggtaagggtaacgggtacccgtaacgtttccgtacccggttaccgttacccgaagtaacggtaaaccgtaaacgttacccgaaggtaccgaacccgtacggtaccgttacgttactccgtaacgactaaaacgtacgtaaaccgacgtaccgtaggaacgtacgtaccgtaggacggtaccgaacgggtacgttaggtacgttaacgttacgttacggtacgtaacggtaaagttactttacgtaacgttacggtaggtaacggg

SEQ ID NO: 244355 - DNA, 630 bp, Homo sapiens
  misc_feature: GYAE6OF02HNA6X.11.71.G05.1.454.CMB.1.raw
  modified_base (404)..(404): a, c, t, g, unknown or other
  misc_feature (404)..(404): n is a, c, g, or t
  modified_base (475)..(475): a, c, t, g, unknown or other
  misc_feature (475)..(475): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtgggaggagtcgtggggggaggcggtggccagccgtggggacggtccctgagactctcctgtacacgtcctctggtccttccacctttcacttaacctagtcggcatcgcacgtgggtcccgccagacctccgaggcgaggggggctagggtaggtggggtcggcgtaagtttattcaatagtgagtaggtaaatagtagtacttntacttcgagtactccggtaggacggccgtattcccgaccgtcaccagacgaactaacgttcgacgtccacncgtctagtactcgtagtactaaagtcgaaactcgacctaggagtacgcgtaggaacgtaccgaggttctaggttaggttaacttacgttaggtaacgtaacgtaaagttctttaacgaagtagggtaacgggttacggtacgggttaaccggggg

SEQ ID NO: 244356 - DNA, 1025 bp, Homo sapiens
  misc_feature: GYAE6OF02F9G6H.11.71.G05.1.454.CMB.1.raw
  modified_base (195)..(195): a, c, t, g, unknown or other
  misc_feature (195)..(195): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtncaactggaggagtcgtgggggaggcgtggtccagccgtgggaggtccctgacgactctcctgtacagtccctcgtcggtccttacctacctttctaacgtttaaccctaagttcgggactaagttcgacccgtaaccggttcggggttacccccgacccggtaacgtaaccccgttcccggaacggggtaccggggtaaccggggggggcccgtttagggggtaacgggttttcggggggtcgggttaccgtttaaacggtttttaacgtttttacccgaaagttttaggttaacggtaaacggtttaaacggggtaaaaagtttacggggtttaacgttaaacccggtttttactttaaacgttttccggaaaacccgggtttacccgtttacccggggtaacgggtaaaacccgggggttccccggtttaaaccggtttaccccgtttaaaccccgggttaccccgttaaccccgggtaaacgggtaaaaccgtaaaacccggttaaaccgtttacccccggaaaggggtacccctaaacccggtaccgttacccggtttacggttaaccttacgggttaccgtaaaccgttaaaagttaccggaaaccgttaccggtaacccgtaggtaaccggtaacgtaaccggttacgggaaacccgggtaaccgtaaccgggttcgtttacgggttaaccggttaaacgttttaccgggtacgggttaacccggtaaacggtttaaaaaccggtttacgtttttaaccggttaaagggttaaggggttaacccgggttaaccggggttacccgggggttttaaacccgggggg

SEQ ID NO: 244357 - DNA, 629 bp, Homo sapiens
  misc_feature: GYAE6OF02HLOFG.11.71.G05.1.454.CMB.1.raw
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (309)..(309): a, c, t, g, unknown or other
  misc_feature (309)..(309): n is a, c, g, or t
  modified_base (481)..(481): a, c, t, g, unknown or other
  misc_feature (481)..(481): n is a, c, g, or t
  modified_base (518)..(518): a, c, t, g, unknown or other
  misc_feature (518)..(518): n is a, c, g, or t
  modified_base (538)..(538): a, c, t, g, unknown or other
  misc_feature (538)..(538): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccagtggagtttgggctgagctgggttttcctcgttgctcttttaagaggtgtccagtgtcgaggtgacaacgtggaggagtcgtgggggagcgtggtccagccgtggggagtccctgacactctctgacagcctnggtccttcaccttnattactatggacatcgctacgtgggtacccncacgtactcgaggcgaggggcctaggtgggtggtgacgtagttactcaatgtgacgtaggaaatgtctacttacgttactcgaacgacttcgtaggacggtaccgtagtaccgtaccgttctacgaggaacgacgtaactccggagtaccacgtaccgtctgtaactcgtanaccgtaaataccgaacgacgtaccctagaacgtacgngtaaccggtaagggaacccngggttacctggttacttacggttactggtaacgtaacggtaaagtttcttacggttaaaccgtagggtacggtaccgtaccggtaccgggg

SEQ ID NO: 244358 - DNA, 716 bp, Homo sapiens
  misc_feature: GYAE6OF02HUNSJ.11.71.G05.1.454.CMB.1.raw
  modified_base (367)..(367): a, c, t, g, unknown or other
  misc_feature (367)..(367): n is a, c, g, or t
tcagcgagagataccacgaccggtgctcgatttagtgtcgtcgcaagagagagggggggggagaggagcccagcactagaagtcggcggtgtttccattcggtgatcagcactgaacacagaggactcacatggagttgggctgagctgggttttcctcgttgcttacttttaagaggtgtccagtgtcaggtgacaacgtgggaggtagtcggtggggggagcggtggtccaggccgtggggacgtccctgacgtacctctcctgtacacgccctgtcggtcttctaccttcacttacctatcggcagtcgccgtacgtcgggtcccgaccgagtacctaccgagggcggacgggggtcgtagggngggttggggcggcgttaggtttacgttactattagtggtaacgtaagggtaattaggtacgtactttacgttacgttacgagtaccgtaccggtagggtacgggtaccgtacgttccgtaccgtccgttaccgaacggacgtaactaacgttaccacggtacaaccgaccgtacgtacgttacgtacgtacaaccgtaaagacgaaccgtacggtaccgtaggtacgacgtcgacggaccggtacggtaccgtacggttcgttacgtaacgtttaacggtcgtaacggtaacggtaagttacgtttaacgtaggttaacgggtacggttacgggtacgggttaccgggg

SEQ ID NO: 244359 - DNA, 870 bp, Homo sapiens
  misc_feature: GYAE6OF02IZZ13.11.71.G05.1.454.CMB.1.raw
  modified_base (209)..(209): a, c, t, g, unknown or other
  misc_feature (209)..(209): n is a, c, g, or t
tcagcgagagataccacgaccggtgctcgatttagtgtcgtcgcaagagagaggggggaggaactgcttcagttaggacccagagggaaccatggaagccccagctcagcttctcttcctcctgctactctggctcccagatagccaccggagaaattgtgttcgacacagtctacagccacctgtctttcgtcctaccgaggggaaancgccaccctctcctcgcacgggccagtccgagtacgttagttaacacgtcttaacttacgcctagtaaccaaacacgtaaaaccgtggtaccaacgtacctccgtaggcccttcctcactctagtagacttcgctactaccgtaacgacgggtcctacgtacggacccctaaaccccgacggtaccgtaacgggttacctacgggacggtaccgtagggttaccgggtacgtacggggaaacctacggtaaccttacgtacctaccgtacaacccgtacttaccgaagtacccgtaagtaccccgttaaacgaccggtacccgttaacgggttaacgggtttaacgtttttaccggtaaccgtttttaaacggttttttaaccggttaaccgttttaccgggaaccggttacggaacccggttaaacggtttaccggtttaacgtcccggttaaacggttcgggtaaaccctttacccgggtaacccgtttaaccgggtaaacccgggaaacggggtaaccctaaccggggtaacgttaaccgggttaaaaaacggtttaacccggtaaacggtttccgggtaacggtacccgtaacggtaacccgttaaccgtacgtttacggttacccgtttaccttacccgttaccctttacccccgg

SEQ ID NO: 244360 - DNA, 777 bp, Homo sapiens
  misc_feature: GYAE6OF02I1DQE.11.71.G05.1.454.CMB.1.raw
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
tcagcgagagataccacgaccggtgctcgatttagtgtcgtcgcaagagagagggggaacgtgctcagttaggaccagagggaaccatggaagcccagctcagcttctcttcctcctgctactctgctccagatagcaccggagaaattgtagttgacacagtctccagccaccctgtctttgtcctccgaggggaaacngcccaccctctcctgcacgggccaagtcaaggagttggttaaaccngtactacctttagcctagggttaacccaagaacgtaaaacccgttcggacccgaacggaaccttccccgaacggggtcccttcccgtacctaaccgttccttaattacgtaacgtcgaccgtaaccttaccaaaccggtaacgggtccccaaacgtttcgggaccccaaccccccgaggtacccccggttaaacggggttccgaaacgggtttaccggggccgttaaaggggtaccggggggtttaccgtacggggggttaaacaacccgggtccttttaaccgggacccctttacggttaccccaaaccggtacttccgaaacggtccgaaccggtaccgtacggtacgtacccgtggaacgttacgtttcgacgttagtttacgttacgttgttacgtacgcgaacgtcgtacgtacgtacgtacgtactactaccgttccggaccgtaacgggacctaacggactaacgtagttaaacgtacgtgtacggctacggactaccagtctacgtctactacgtcttacccg

SEQ ID NO: 244361 - DNA, 666 bp, Homo sapiens
  misc_feature: GYAE6OF02J1H95.11.71.G05.1.454.CMB.1.raw
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (628)..(628): a, c, t, g, unknown or other
  misc_feature (628)..(628): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggcctcccagatagcaccggagaaattgtgttgacacagtctccagcccaccctgtcctttgtcctccgaggggaaanacgccacccctntcctgcagggccagtcagagtgtaacngctacttagcctgaccaanagaacctgccaanacctcccaggtcctcctnactctangtacngccatcccaaagcggacccacggtcggacccaacccccgagtaccccgttaggttaccgaacggttcggaccgtacgggttcggggccgtacgggggtaaacctagttacccgttacgtacctccgttaacccaacctacgttaccgacgacccgtaacgcccgttaacggacgtacccggtaggtacggttatttacgtacttacgttttatacccgttgtaccgtacgtcgtacgtacgtacttccggtacgtacgaccttcgtaccgttacgaccgtaaggacacgtaacgtaagttaactagtacgtggtaccgtacncggtaactccagttctcttcgtaactcctccgtacccg

SEQ ID NO: 244362 - DNA, 656 bp, Homo sapiens
  misc_feature: GYAE6OF02FNMR2.11.71.G05.1.454.CMB.1.raw
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (317)..(317): a, c, t, g, unknown or other
  misc_feature (317)..(317): n is a, c, g, or t
  modified_base (361)..(361): a, c, t, g, unknown or other
  misc_feature (361)..(361): n is a, c, g, or t
tcagcgagagataccacgaccggtgctcgatttagtgtcgtcgcaagagagagggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaactgggaggagtcgtggggggagcgtggtccagccgtggggacgtccctggacgctctcctgtaccngcctntggccttcaccttcattacctagtggctatgccacgtcggggtcccnccagacctccgaggcggagggggctgggaggtgggcgctagttnttcattatgataggaaattgtgtactttctatcagtaccgtccggtaggaacgggtcctacttaccgacccgttctaccgacgaacgtaacctaacgttacccgacgaccaacgaccgcttacgttaactctgaacctaaacgacgaacgtacgtcgtaggaacgacgtcgtaggaacggaccgtacgggtcttacggtacgttaacgtttacgttacggtaacgtaaccggttaaagttacgttttaacgtaacggttaacggtacgggttacggtaaccgggttaccgggggg

SEQ ID NO: 244363 - DNA, 631 bp, Homo sapiens
  misc_feature: GYAE6OF02GA09R.11.71.G05.1.454.CMB.1.raw
  modified_base (203)..(203): a, c, t, g, unknown or other
  misc_feature (203)..(203): n is a, c, g, or t
  modified_base (381)..(381): a, c, t, g, unknown or other
  misc_feature (381)..(381): n is a, c, g, or t
  modified_base (413)..(413): a, c, t, g, unknown or other
  misc_feature (413)..(413): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaangccaccctctcctgcagggccagtcagagtgttaacagctacttagcctggtaccaacagaacctggccagacctcccaggcctcctcatctatgatgcatcccaacgacgggccacgtggacccaccccgagccctaggttcaggtggcaggtcgggtctgggacagtactcactcncaccatcagcacgcctagcgccgtggaggttntttcgacttagtttattactcgtacacgctagtcgttacgtacgtacgtagtactaccgtaccgttaccggaaccggtaaaggaccgtaaccgtaacggtaacggtaaaacgttaaaccggtaacggttacgggttacgggtaccgttacggtaaccccgtaccgttaaccgtttaccgtttaccggtttaccctttaccgttacccgtttacccccg

SEQ ID NO: 244364 - DNA, 636 bp, Homo sapiens
  misc_feature: GYAE6OF02IJ2TA.11.71.G05.1.454.CMB.1.raw
  modified_base (158)..(158): a, c, t, g, unknown or other
  misc_feature (158)..(158): n is a, c, g, or t
  modified_base (317)..(317): a, c, t, g, unknown or other
  misc_feature (317)..(317): n is a, c, g, or t
tcagcgagagataccacgaccggtgctcgatttagtgtcgtcgcaagagagaggggtctgggagaggagcccagcactagaagtcggcggtgtttccattcggtgatcagcactgaacacagaggactcaccatggagttggctgagctggttttccngttgctcttttaagaggtgtccagtgtcaggtgcaactggaggagtcgtgggggcgcgtggtccagccgtgggacgtccctgagtactcgtcctggtacagcctcgtggcttacaccttcaattaacctgtacggactagtgcctacgttgggtacccncgaagtacctcgacgggcacggggggtctagggaggttgggcggtctaacggtttattccgaatacctggaactagggtaaaatggtgaaccttgtatcgaacgacctttcgaggaaggccgtagtacctaaccggtctaccgtagtacgaacgtaacgttccgaacgtacgaacaacggtcctgtaactccgtaacgacgtaaatacgaaacacgtacccgagtacgacgacgtaggacgacgaacgtcgtcggtacgtaacgttacgtacgtaggaccgtaaaggtactttaacgtaacggtacgtagggtaaccgg

SEQ ID NO: 244365 - DNA, 704 bp, Homo sapiens
  misc_feature: GYAE6OF02GPZW6.11.71.G05.1.454.CMB.1.raw
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaacgtggaggagtcgtgggggaggcgtggtccagcctgggagtccctgagactctcctagtacagcctctggcttcaccttcattaccgtatggcatgccacgtcgggtcccncagtacctccgaggccgagggggctgggnggtggggtgcgtaggtttattcagttacgtgtaattagggtaaattaggtgtaactttactaagttaccaacggtacctttccgggtagggaacgggtcccgtaacttacccgtaccggttcctaccgaaggtaacgtaaccgtaacgttcccgaacggtaccaaccgtaccgtcgttagtacttaccgtagaaccgtaaagttacgaaacctacggacccgttaaggaacgtaacggacgtacggtaaccggaccgtacgggtacgttaagggttacgtttaaacgtttccgttaagggttaaccggtaacggttaaaacgttaccttttaacggtaaaggttaacggtaacgggttaaccggg

SEQ ID NO: 244366 - DNA, 1002 bp, Homo sapiens
  misc_feature: GYAE6OF02JFU68.11.71.G05.1.454.CMB.1.raw
  modified_base (368)..(368): a, c, t, g, unknown or other
  misc_feature (368)..(368): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccagtggtaggtttgggctgagcgttgggttttcctcgttgtcttcttttaagaggtgtccagtgtcgaggtgacaacgtgggaggtaggtcggtggggggaggcggtcggtccaggtccgtggggacggtcccctggacgtacctccgtccgtgtaccgtacgccctcgtcggtccttccctacctttactaacttttaccctagtcggtctagtcgaccgtccgttccggggtccccnccgacggtacccgtcccggacgggtacgggacggggggtctagggggtagggtcggggtcgggtacgttaacgggtttactttaccgtaattaggttaggaagtttaaacggggtaaatttacgggtacgtttaacccgtttacgtttaacgttacccgtaaaccggttacccgtttaacccggggtaaacggggtaaaccgggtccccggtttaaacgttacccccggtaacccgggtttaccccgttaaaccccggtaagggtaaaaccggttaaacccgttaaccgttaacccgggtaaccgggtacccctaacccggtaaccggttaccccgtttaacggttaaccgttccgttaacggaaaccgttaaaccgttaacggtaaacccgtcccggtaaccggtttaaacggacgggtaacccggttacggtaaaccgggtaacccggggtaacgtaaccgggtttaccggttaggtttaaaccggttaaccggttttaaccgggttacggttaacccggggttaaaaccggtttaaaagggttaaccgttttttacccgttaaaaggggttaagggttaaacccgggggtttaaccggggtttaacccggggggttttaacccccgggggg

SEQ ID NO: 244367 - DNA, 795 bp, Homo sapiens
  misc_feature: GYAE6OF02JW93H.11.71.G05.1.454.CMB.1.raw
  modified_base (178)..(178): a, c, t, g, unknown or other
  misc_feature (178)..(178): n is a, c, g, or t
  modified_base (210)..(210): a, c, t, g, unknown or other
  misc_feature (210)..(210): n is a, c, g, or t
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
  modified_base (316)..(316): a, c, t, g, unknown or other
  misc_feature (316)..(316): n is a, c, g, or t
tcagcgagagataccacgaccggtgctcgatttagtgtcgtcgcaagagagaggggggggaggaggagcccagcactagaagtcggcggtgtttccattcggtgatcagcactgaacacagaggactcaccatggagtttgggctgagcgtgggttttcctcgttgcttctttaacgngtgtccagtgtcaggtgcaactggagagtcgngggggaggcggtggtccagccgtggggacggtccctgagacctctccgtgtacncgcctctggccttcaccttnacttactatggctatgacacgtcgggtacccnccgagtacctccgaggccgacggggggtctagggtacgggttcggggtacggtacctagggttttaactttccgtaattacggttagtaacggggttaaggtaaaacgttacgggtttcgtaacccgttttacttaaagtttcccgaaagggttaaccccgttcccgggtaaggggtaacccgggccggtttaacccgttacccgtaccccggttaccgtacccctaaagggaaccggttaaacctaaccgttacccggtaacgggtaaccccgaccgttacccggtacctttacgggtaacttacccggttctaaaccgtaaaacgtaccgtaacgtaacggtcccgttaagggtacgaacggtacgtacggaacgggtaccgaccggttacgtaggttacgttacgttaccgttaggtacgaacgttaacgtacttttacgtaaagtcgggtaaaggttcggtaaccgggttacggg

SEQ ID NO: 244368 - DNA, 710 bp, Homo sapiens
  misc_feature: GYAE6OF02FL4QZ.11.71.G05.1.454.CMB.1.raw
  modified_base (205)..(205): a, c, t, g, unknown or other
  misc_feature (205)..(205): n is a, c, g, or t
  modified_base (245)..(245): a, c, t, g, unknown or other
  misc_feature (245)..(245): n is a, c, g, or t
  modified_base (668)..(668): a, c, t, g, unknown or other
  misc_feature (668)..(668): n is a, c, g, or t
tcagcgagagataccacgaccggtgctcgatttagtgtcgtcgcaagagagagggggggaggaactgctcagttaggacccagagggaaccatggaagccccagctcagcttctcttcctcctgctactctggctcccagatagcaccggagaaattgtgttgacacagtctccagccaccctgtctttgtctccgaggggaaanagccacccgtctcctggcagggccagtcagagtagtaacngcttacttagcctggtaccaacgagaaacctggccaagacctcccaggctcctcatctatgatcgcaactccgaaacggacggcccacgtcggacccaaccccgagacccgtaaggttccgaggtcggacgtagggttcgggtacgacgggaactaacggtacctttcaaccgttcctaccaccgtacttacgacgcgtaacgtacccgtaggaactccggttaggaaggtttacgttttcgaacgttacggtttttaattacgttacggttacgtacgtacgtaaggttactttaggtaacggtaaccggttccgttaacccgtcgtttaccttaacccgggtttcgggaccgggggtaacggtaccgggtccgggttagggacgtacgtaaccggtaacgtaaccggtaacggttacgggnggtacctacgggtacccacggtcgttacgtccggtttaaccg

SEQ ID NO: 244369 - DNA, 641 bp, Homo sapiens
  misc_feature: GYAE6OF02JUSC3.11.71.G05.1.454.CMB.1.raw
  modified_base (177)..(177): a, c, t, g, unknown or other
  misc_feature (177)..(177): n is a, c, g, or t
  modified_base (188)..(188): a, c, t, g, unknown or other
  misc_feature (188)..(188): n is a, c, g, or t
  modified_base (263)..(263): a, c, t, g, unknown or other
  misc_feature (263)..(263): n is a, c, g, or t
  modified_base (319)..(319): a, c, t, g, unknown or other
  misc_feature (319)..(319): n is a, c, g, or t
  modified_base (398)..(398): a, c, t, g, unknown or other
  misc_feature (398)..(398): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctctttaagnggtgtccagtntcaggtgcaactggaggagtcgtgggggagcgtggtccagcctgggagtccctgagactctcctgtacagtcctntcggcttcacctttcgactttacctagtcggctattcgacctacgtcggggtcccnccagcctccgaggccgtagggggctgggaggtgggtggcctaggtttattcagtagtgatagggaaattgtgtaccttntatcacggactccgtaggtacgggtacctacgttcgaccgttctaccgaagtacgtaacacgttccgaacggccacgtaacgccttagtactcgtaagacctaaagtacgaaccgtacggcgttacgaaggacgtacgtacggtacgaccgtacggtaccgttggttacgttacgttaacggtacggttacggtaacgttaaacggttacgtttaacggttaaggttaacggtagggtaacgg

SEQ ID NO: 244370 - DNA, 642 bp, Homo sapiens
  misc_feature: GYAE6OF02HUW0D.11.71.G05.1.454.CMB.1.raw
  modified_base (428)..(428): a, c, t, g, unknown or other
  misc_feature (428)..(428): n is a, c, g, or t
  modified_base (450)..(450): a, c, t, g, unknown or other
  misc_feature (450)..(450): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggcctcccagatagcaccggagtaaattgtgttgacacagtctccagccaccctgttctttgtcctaccgaaggggaaacgacgcccaacccctctcctgcgacgggcagtacgagtagtagttaaacagtacttacttacgccgtacggtaaccaaacgaacgaaaccgtcggacccacgtacctccccgaggcctcctcactactagtgatcgcactaccgaacggacggccacgtcgccaccgacgctagtcacggtgcgaggtggcgtggactacgacttcactcacacatacgacncagctagccgtctagtaggttntttcgacttaagttttactcgttcgtacgatcggtatcgttagctaggtactcctacgtccgtaccggaacgtacggacctaaacgttaacgtaacggtaacttaccggtacggttacggacctacgtaccgtaaccacgttaccgtttacgttacccgtttaccttacccttacccgttccccgtaaccgg

SEQ ID NO: 244371 - DNA, 881 bp, Homo sapiens
  misc_feature: GYAE6OF02H26M5.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagtctgggttttcctcgttgcttcttttaagaggtgtccagtgtcaggtgcaacgtggaggagtcgtgggggagcgtggtccaggccgtgggacggtccctggacgtctcctcctagtacagtcctcgtcggtctttaccacctttcactttacctagtcggtctagtcgaccacggttcgggtcccgcgaagacccgttccggacgggtccggtaacggggggtcttacgggggagggtttgggggcgtaccgttaagttttacgttttaccaagttagtagtaaaggttggggtaaaaactttgggttacgtaacctttttacgtaaacgttttacccgaaagttaaccccgtttcccgggggttaaagggtaaaccgggggtaccccgttaaacgttttacccccggtaaaccccggtttacccgttaacccggaaaggtaaaccggtaaacccgttaaaccggttttacccggaaaccgggtaccctaaacccgggttaacccgtacccgtttaagggttaacccttaccggttaacggtaaaacccgtaaaaaggttaacgtaaaacccgtaccgggtaacccggtttaacggaaccgggtaaacggtaccgttaagggggaccggtacccgtacgggtacgttagggtttaccgttaacgttacgtaccgggtaagtaacggtttaaagttaccgttttacggtaacgttacgggaggttaaccggg

SEQ ID NO: 244372 - DNA, 744 bp, Homo sapiens
  misc_feature: GYAE6OF02GNCXI.11.71.G05.1.454.CMB.1.raw
  modified_base (262)..(262): a, c, t, g, unknown or other
  misc_feature (262)..(262): n is a, c, g, or t
tcagcgagagataccacgaccggtgctcgatttagtgtcgtcgcaagagagaggggggggagaggagccagcactagaagtcggcggtgttccattcggtgatcagcactgaacacagaggactcaccatggagtttgggctgagcgtggtttcctcgttgctcttttaagaggtgtccagtgtcaggtgcaactggaggagtcgtgggggagcgtggtccagcctggggacgtccctggacgactcgtcctgtacagcctntggtcttccacctttcattacctagtcggacagtcgaccacggtcggggtcccgacccgtagaccctcccggaagggccgggtaggggggtcctggggagggttcgggggtaggccgttaagttttacgttcaagttagttacggtaagtacgggtaaaattacggtcggttaaaccttttacgtaacgtttacaacggttaccgtcccggttaagggaacggggttacccgtaactttacccggtaacccgtttcccgtaacccggtaaagtaaaccggtaaccttaaacgttaccccggaacggtacccgaaccgtaaccgggtaccttcggttacttaccgtacggaacctaaacgtacgaaaccgtacgtaccgtaggacgagtaccgtaggaacggacgtacggtatggtattacgttacgtgtaggaacgtaagttacttacgtaaggtaggtacggtacggtacggttaccgggg

SEQ ID NO: 244373 - DNA, 778 bp, Homo sapiens
  misc_feature: GYAE6OF02HLA5G.11.71.G05.1.454.CMB.1.raw
  modified_base (169)..(169): a, c, t, g, unknown or other
  misc_feature (169)..(169): n is a, c, g, or t
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaattgtgtgacacagtcncagccacctgtctttgtctaccgaaggggaaanacgcccaccctctcctgcgtacgggccagtcagtagtagttaacagtactacttagccgtggtaaccaacgagaaacctcggaccagacctccgaggtcctaccctanacttacgtatcgtaagtcgactacgtaccaaacggacggtaccacgtaggacccaaccccgtaggtccccgtaagggttccaacgggttcggacgtaaggggtccggggtacgttacggggaacacgggttaccttaccgtacctttcgaaccctacccgtaattaccgacggaaccgacggttacccgtaacggtaccggtacccgtagggtaacggttaggtttttacgaacccgttaagtttttaaccgtttaacccgttggtaaccgttacgggttaccacgggtaccgtaacgttaccggtaaccggtcgttaaccgtacccgttacccgttacggtaacccgggaaagtaaacccggtaaccgttaacggtaacggtaaaaccgttaaaccggtaacgttacggtacgtacggtcctaccgaacgttacttccgttaccgttacttaccgtaacttaccccg

SEQ ID NO: 244374 - DNA, 948 bp, Homo sapiens
  misc_feature: GYAE6OF02GDOVC.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgttgggttttcctcgttgcttcttttaaggaggtgtccagtgtcaggtgcaacgtggaggagtcggtgggggaggcgtcggtccaggccgtgggacgtccctgagcctctcctgtacacgtcctcgtcggtccttccaccgtttacactttaccctagtcggcctaagtcggacctaaccgggtttcgggggtccccgaccgtaaacggtacccgttacccggacggggtacccgggtaagggggggggtcccttagggggtaaccgggggtttgggggggtaccggggtacccgtttaaaagggttttttaaccgtttttacccgtaaagttaacggttttacgggtaaagtttaaacgggggtaaaaaactttgggttaccgtaaaccgtttttcgttaaaccgttttaccgaaacggtttacccgttaacccggggttaagggtaaaccgggggttaaccccttaacggttttaaccccgtaccccgggtttaccgtaccccggtaaaaggaaaccgttaaccgttaaaccgttacccggaaacggaccctaacgtaacccggttacgttaccgttaacgttaccgtaacggtaaacttaaaacggttaccgaaaccgttaccggaccgttaacggaaacgtacgggtaacgttaggggaaccggtacggtaaccgggttcgtttaacggttacggttttaaaccgtttaccgggttaggttaacccgggtaaacgttaacgggttttaaccgttttacggtaaacggttacggggtaacggtttaacccgggg

SEQ ID NO: 244375 - DNA, 736 bp, Homo sapiens
  misc_feature: GYAE6OF02ISOPZ.11.71.G05.1.454.CMB.1.raw
  modified_base (301)..(301): a, c, t, g, unknown or other
  misc_feature (301)..(301): n is a, c, g, or t
tcagcgagagataccacgaccggtgctcgatttagtgtcgtcgcaagagagaggggagaggaactgctcagttaggaccagagggaaccatggaagcccagctcagcttctcttcctcctgctactctggctcccagatagcaaccggagaaattcgtgttagactacagtctccacgccacctgtcttgtctccgagggaaagagtccacctctctgcgaggccagtcagacgttacgtaacagctacttagccttggtaaccaacacgaaacgtggacacgactaccaacgctaccctnaagtcccagttacgacgtgacctaactaccaacgtacgggaccctacgtacggaccaccccgtaagaccgacggtttacgaaggtcgaccgtagggtcggttccgaggtaccaaggtacttccgacttcccgaaccctaacgacgttaccacgacccgttacgaaccgtacgtaaccggtcgtaaggtacgggttactttacggtaccgtttaagtttaaccgtttacgttacggttacctaacgtaccgtaaacggtccggtttaacgtacgtaaccgggttacgtacttaccgtaccgttaccggtaaacggaaccggtaacctaaccgggtacgttaaaccggggtaaccttaaaacggtaaccgtttaggaaccggttacgtacccggtaaaccaccggttaccgttacgtacgttaccgttacgtacccg

SEQ ID NO: 244376 - DNA, 698 bp, Homo sapiens
  misc_feature: GYAE6OF02F2CXY.11.71.G05.1.454.CMB.1.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctccagatagcaccggagaaattgtgttgacacagtctccagccaccctgtctttgtctccgaggggaaagngccacctctcctgcaggccagtcagagtgttaacngctacttagcctggtaccaacacgaaacctggaccagacctcccaggcctcctcatctatgatgcactccaacgcgggaccacgtcggaccacccgacgtccgaggtttccaggttcggaccgtagggtcggggttcgtaggggaacctaacggtaccgtttaccaccgttcctacgaaccctagtaccgagtaccgtacggtaccctaaggacccgtccggtaaggttacggtttacgtttacggtaactttaagttttacttaacgttcgtacgacgtcgtagtaccgttacgaccgttagtacgtaccgttaccgtaccggttccgggaaccggaaacggtaccgtaacggtaaacgttaacggtaaaaccgttaaccgtagggtttcgaacgggttacctacgaacccgtaactacgttaccggtttactacctttaccgtaccgtttcccgtacccg

SEQ ID NO: 244377 - DNA, 613 bp, Homo sapiens
  misc_feature: GYAE6OF02GPIPO.11.71.G05.1.454.CMB.1.raw
  modified_base (157)..(157): a, c, t, g, unknown or other
  misc_feature (157)..(157): n is a, c, g, or t
  modified_base (203)..(203): a, c, t, g, unknown or other
  misc_feature (203)..(203): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (503)..(503): a, c, t, g, unknown or other
  misc_feature (503)..(503): n is a, c, g, or t
  modified_base (515)..(515): a, c, t, g, unknown or other
  misc_feature (515)..(515): n is a, c, g, or t
  modified_base (541)..(541): a, c, t, g, unknown or other
  misc_feature (541)..(541): n is a, c, g, or t
  modified_base (551)..(551): a, c, t, g, unknown or other
  misc_feature (551)..(551): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcgtggtttcncgtagctctttaagaggtgtcagtgtcaggtgcaacgtgggaaggngttcgtagggggacggcggtggtccaggtccgtggggacggtcccctgagtactctcctagtacagtcctgtcggtctccaccttcacttaccgtatggcagtcgaccacggtcgggtacccnccgtanactccggagggcgagggggcttgggaggttggggtcggattaacgtttacgtttaccaattagtagagttaacgggtaaaactggtacgtactttatacttacaacgtactccgtagggaacggtcgtactccaccgtctacgagaacgactaacgtcaacggcaccacgntacactacgtanacactcgaactacgtctggaagtcgntacggagacngacgtgtagtcttactgactacgaagtttcttagtactaaggtggtaggtaccggttacggg

SEQ ID NO: 244378 - DNA, 936 bp, Homo sapiens
  misc_feature: GYAE6OF02HEK59.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcgttttaagaggtgtccagtgtcaggtgacaacgtggaggagtcgtgggggagcgtggtccaggccgtggggacgtccctggacgtcctcctccgtgtaccagtccctcgtcggtcctttaccgaccctttctaacgtttaaccctagttcggactagtcgacctaccggttcggggtccccgaccgaacggtccctaccggaacggggccggtacgggggggtccttaggggagggttcgggggttacggtaccgttaaggttttacttttaccgaagtttaagtaggtaaacggtttaagggtaaaactttcggttacgttaaccttttaccgttaacttttaccggaaacggttacccggttacccgggtagggtaaacccggggttcccgttaaccgttacccgtaaccccggttccttaacccggaaacggtaacgtaaaccgttaaacccgttacccggaacggtaacccgtaaacccggtaccggttaccgtttacggttaaccgttaccgttacggtaaaccttaaacgttaaccggtaaacccgacggtacccggttagggtaaaccgggtacggttccggtaagggtaaaccgggtaccggtaccgggtagtttacggttttaacggttaaccggttttaacggttacgggtaaaccgggttaaaccggttaaacggttttacggttttaaacccggtaagggtttaaacggggttaccggggttaaccgggttaacccgggggtttaacccgggggg

SEQ ID NO: 244379 - DNA, 733 bp, Homo sapiens
  misc_feature: GYAE6OF02GF20O.11.71.G05.1.454.CMB.1.raw
  modified_base (94)..(94): a, c, t, g, unknown or other
  misc_feature (94)..(94): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
  modified_base (365)..(365): a, c, t, g, unknown or other
  misc_feature (365)..(365): n is a, c, g, or t
tcagcgagagataccacgaccggtgctcgatttagtgtcgtcgcaagagagaggggggaactgctcagttaggacccagagggaaccatggaanccccagctcagcttctcttcctcctgctactctggctcccagatagcaccggagaaattgtgttgacacagtctccagcccacccgtgtctttgcctccgaggggaaagcgcccacccgtctcctgcgacgggccagtcagtntgtaacngcttattacgcctggtaccaagagtaaaccnggaccagacctcccgacggccttcccgtactagttccgtaatggtatcgcaactcccgaagacgggtccaacggtacgcccgaaccccgngaccgtacggtacacggtggtacgacgggttgggtcctaggggaccagttaccgttacaccgtcgttaaccaacccgttagtccgaaggtccgaaccggtacccttaaggccgggtaaccccgtagggtacggtttacgtttaccggtacgtttaaccggtttacctttacggttacacgtaacggtccgtaacgtacggttactccggggtaaccttggtacccgtttaccgacccggtttacgaccggaaacggtaaccgtaagttaaaccgggtaagttaacgtaaaccgtggtttacggacccggtagtcgtaacccgacgtttactcggtttaccgttcttacgttacctcccggtttacccg

SEQ ID NO: 244380 - DNA, 763 bp, Homo sapiens
  misc_feature: GYAE6OF02FNLWO.11.71.G05.1.454.CMB.1.raw
  modified_base (199)..(199): a, c, t, g, unknown or other
  misc_feature (199)..(199): n is a, c, g, or t
tcagcgagagataccacgaccggtgctcgatttagtgtcgtcgcaagagagagggggggaactgctcagttaggacccagagggaaccatggaagccccagctcagcttctcttcctcctgctactctgctccagatagcaccggagaaattgtgttgacacagtctccagccaccctgtctttgtctccgaggggaangcccacctctctgcagggccagtcagagttgtaacagcttacgttacgcctaggtaaccaacaacgaaaccgtggaccaacgaccgtacccgagggtaccttccctactaattccttaagtcggattcggacctaactacccgaaacggtacgggacctaccgtcggacccaccccgagcccgtaagggttccaggtcggacgtacggggtgggtacgtcggggaactacggtacttcgacctctacccaccgtatccgaacgcacgtacctaaggacgtccgtaggtacggttactttcgactttaagtttactttaacgttcgtacgtacgacgtagtacggttagttaccggtaacggttacggtaccttacccggttaacccggttaacgggtacccggtaaacggggtaaaccctaacggtaaaccggttaaacggttaaaaccgtttaaaaccggttaacggttacgggttacccggtaacggttaaccgtacccgtaaaccgttcgtttacctaccgggttttaccctacggtttacccttccccggttaacccccg

SEQ ID NO: 244381 - DNA, 554 bp, Homo sapiens
  misc_feature: GYAE6OF02GW7YK.11.71.G05.1.454.CMB.1.raw
  modified_base (263)..(263): a, c, t, g, unknown or other
  misc_feature (263)..(263): n is a, c, g, or t
  modified_base (434)..(434): a, c, t, g, unknown or other
  misc_feature (434)..(434): n is a, c, g, or t
  modified_base (460)..(460): a, c, t, g, unknown or other
  misc_feature (460)..(460): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctctttaagaggtgtccagtgtcaggtgcaactggaggagtcgtgggggaggcgtggtccagcctggggagtcccctgacgactctcctgtacagcctntggcttcaccttcattacctatggcatgcacgtcgggtccgccagactccaggcgaggggctggagtgggtgctagttattcatatgataggaaatagtgtacttcttattcagactcgtagaacgggccgtattccgccgtctccagagtacattccgagaccacgaccncttagtatctagacaaacgtgaaccngtacctagacgagctaggaacgacgacggtcgtgttagttaactacgtggtacgacgtaaagtctttagaagttagaggttcgaggtaccgggg

SEQ ID NO: 244382 - DNA, 631 bp, Homo sapiens
  misc_feature: GYAE6OF02G36NQ.11.71.G05.1.454.CMB.1.raw
  modified_base (264)..(264): a, c, t, g, unknown or other
  misc_feature (264)..(264): n is a, c, g, or t
  modified_base (316)..(316): a, c, t, g, unknown or other
  misc_feature (316)..(316): n is a, c, g, or t
tcagcgagagataccacgaccggtgctcgatttagtgtcgtcgcaagagagagggggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccagccgtggggacgtccctgagactcctccgtgtacngtccctgtcggtcttccaccttcattaccctatggcatcgcactcgggtccnccgagtacctccgaggcgagggggctggggtacggtggggtggcgtaggttacttcgatagtgaagtaggtaaatgtagtactttctatcgagtacctccggtaggaacgggtccgtattaccgaccgtcctaccgagtaacgacctaacttaccgacggacaccaccgtctagttactctagactaaagtcgaacgacgactaggagaacgtcgtaggacggaccgacggtgtagtagttaagttacgttggtacgtaacggtaagttacgtttacgttaagtaggacgggttacggtaccgggttaccggggg

SEQ ID NO: 244383 - DNA, 675 bp, Homo sapiens
  misc_feature: GYAE6OF02JFWVL.11.71.G05.1.454.CMB.1.raw
  modified_base (207)..(207): a, c, t, g, unknown or other
  misc_feature (207)..(207): n is a, c, g, or t
tcagcgagagataccacgaccggtgctcgatttagtgtcgtcgcaagagagagggggggaggaactgctcagttaggacccagagggaaccatggaagccccagctcagcttctcttcctcctgctactctggctcccagatagcaccgggagaaattgtgttgacacagtctccagccacccttgtcctttgtctccgaggggaancgcccaccctctcctgcgagggccagtcagaggtagttaacagtcctaacttacgccgtacggtaaccaacaacgaaacctggaccacgacctccccgaggccctacctcactctatgactcgactactaccgaacgacgggaccacgtcggacccacccgacggaccgtacggttacgacggtacggcgtagggtcgggtacggtgggactacggtcctactactcctacaccgtatccgacgccgacgtccgtagaccgtccgtagggtacgtttacgtttcgtacgttagtttttaactcgttcgtacgtacgtcgtacgtagttctacggtagtacggtactaccgtacccggttacggaaccggtaacggacctaaccggacgttacgtaaacgaacgttacggtggtacggtctacgaccgtacgtacttaccggtcctttcgtacccttaccgttaccccg

SEQ ID NO: 244384 - DNA, 630 bp, Homo sapiens
  misc_feature: GYAE6OF02HE10W.11.71.G05.1.454.CMB.1.raw
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggaggtcgtgggggaggcgtggtccagccgtgggacggtcccgtggagacctcctccgtgtacacgccttgtggccttcacccttcacttacctagtcggcatgccagtcgggtcccnctanaccgtcgaggcggagggggctagggaggtggggtgtacgtagtttactttcgatagtgtaagtaggtaaatgttgtacttctattcgacgtaacgtccgtaggacggtccgtattccgaccgttcctaccgaagacgtaacctaactccgagaccaccgactcgtattcactacgaacaagtaccggaaatacgcttaaggagaacggtcgtaacgggacggtaccgaggtttgacgggtttaagtacttcgtagggagttacggtaaattcctttaggacggtttaagccggggttacggg

SEQ ID NO: 244385 - DNA, 715 bp, Homo sapiens
  misc_feature: GYAE6OF02IAFBS.11.71.G05.1.454.CMB.1.raw
  modified_base (151)..(151): a, c, t, g, unknown or other
  misc_feature (151)..(151): n is a, c, g, or t
  modified_base (166)..(166): a, c, t, g, unknown or other
  misc_feature (166)..(166): n is a, c, g, or t
  modified_base (199)..(199): a, c, t, g, unknown or other
  misc_feature (199)..(199): n is a, c, g, or t
  modified_base (238)..(238): a, c, t, g, unknown or other
  misc_feature (238)..(238): n is a, c, g, or t
  modified_base (458)..(458): a, c, t, g, unknown or other
  misc_feature (458)..(458): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccgganaaattgtgttgacanagtctccagccacctgtctttgctcgagggaanacgccacctctcctgcgacggccagtcagagtgttaacngtcttacttagccgttaggtaaccaacgaacgaaacctggacctacggacctacccgaggtactccctacgattactatacgatcgctaactaccgaacgtcggacctacgtccggacccacccgtacggacccgttaaggtccgacggtggacgttagggtcgggttcgtacgggaactacggtaccgttacaccttcgtaccaccgtaattccgaacncgtaccgtaccgtacggacgtaccgtaggtacggtttacgttacggtactttaacgtttacgttcgtaacgtcgaacgtacgtacgtacgttacgtaccgttacggtacgtacgttacccgtaccggttccggaaccggtaacgggtaaccttacggtaacgttaagggttaaacccgtaacggttacggtacgggtcgtaaccgtccgtaactacgttcgttaccgttacggttaccttacggtaccttaccccgg

SEQ ID NO: 244386 - DNA, 796 bp, Homo sapiens
  misc_feature: GYAE6OF02FN9GH.11.71.G05.1.454.CMB.1.raw
  modified_base (206)..(206): a, c, t, g, unknown or other
  misc_feature (206)..(206): n is a, c, g, or t
  modified_base (335)..(335): a, c, t, g, unknown or other
  misc_feature (335)..(335): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggcctccagatagcaaccggagaaattgtgttgacacagtctaccagccacccttgtctttgtcctccgaagggggaanacgacccaccctctccgtgccgagggccctagtcaagtagttcgttaaacagtccttaacgtacgtcctagggtaacccaaacgaacgaaaccgtcggaccacgtacctacccgaggtccctccgttanacgttcttaagttcgaatcggactaacttacccgaacgaccggggaccctacgtccgggaccccaaaccccgtacggtacccgtacgggttaccgacggtcgggtacgtacggggttcggggtaccggtagggtaacgtacggttactaccggtaccttacgtaccctaccgattaccgacgtacgaccgtaccgaaggaccgtaccgtagggtacgttacgtttggtaccgttaaggttttacgttacgttagttaccgaacggtccgtaagtaccggttagtaccgtaacggttacgggttactacccggttaaccggttccgggaaaccgtaaacgggtaccggaaccgttaacggttaaaccggtaaccgttaaccgaacggttcggtacgtaccctaccggttacctaccgtaacgtttcgtccgtttacgtacccgttactttccccggtaaccc

SEQ ID NO: 244387 - DNA, 668 bp, Homo sapiens
  misc_feature: GYAE6OF02H70BD.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccaggccgtgggacggtccctgacgactctcctgtacacgccttctcggtcttccacctttcatttaccctatggcagttcgacacgtcgggtcccgccagcctaccgaggccggacgggggtctagggagggtggggtcggcgtagtttactttcaagttatgaatagggtaaaattgtagtacctttctattcgaagacttccggtaggaacggtcgtacttccgaccgtctaccgagacgacctaacgttaccaacggacaccgtaccgcgttacgtactaccgtcgaactaaaagttcgaaaccgcgtacccgtagaacgagtaccgtcgggaacggaccgaccgggtacgttagggttacgttaagttaaccgttggtacggtaacggttaaagttaaccgtttacggttaacgttagggtacggttaaccgggg

SEQ ID NO: 244388 - DNA, 776 bp, Homo sapiens
  misc_feature: GYAE6OF02JTYGG.11.71.G05.1.454.CMB.1.raw
  modified_base (161)..(161): a, c, t, g, unknown or other
  misc_feature (161)..(161): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagtctgggttttaccncgttgcttctttaagaggtgtccagtgtcaggtgacacgtggaggagtcggtgggggagtcgtgggtccacgccgtggggtacgtcccgtaggacgtacctccgttcccgtaggtaaccgcgcccgtcgtcgggtccttaccgtaccctttcgtaacttaccgtagtcggtacacgttcgcgacgttccgggcccgacctacgaccgtccgagggaccgggtacggggtcgtacgggtagggtcggggtcggtactacggtttaattacgcgttaaggtgaaggtttaacgggaaatttcggtaaggtttaccttagtttaacgtaccgtaaggttacccgttccgggtaaggtaaccggggtccttacgttaccggtaaccgtccggtaacgtaacgtaacggtacttaacgtaccgtaggaccacgttaacggttcgtaacgttcgtacgtacgtaactaaacgtagtaaccaccggtacgttaacggacgagtccgtaaaggaccggtaagtaccggttcggttagttacggttacgtaacggttaggtcgtaaacggttagttacgtttaacggagtttacgggtacgggttaccggtacggggttccggg

SEQ ID NO: 244389 - DNA, 728 bp, Homo sapiens
  misc_feature: GYAE6OF02FXXQZ.11.71.G05.1.454.CMB.1.raw
  modified_base (178)..(178): a, c, t, g, unknown or other
  misc_feature (178)..(178): n is a, c, g, or t
  modified_base (273)..(273): a, c, t, g, unknown or other
  misc_feature (273)..(273): n is a, c, g, or t
  modified_base (328)..(328): a, c, t, g, unknown or other
  misc_feature (328)..(328): n is a, c, g, or t
  modified_base (632)..(632): a, c, t, g, unknown or other
  misc_feature (632)..(632): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagnggtgtcctagtgtcaggtgcaactggaggagtcgtgggggagcgtggtccaggccgtgggacggtccctagacgacttctccgtgtacacgcctntggccttccaccttcactttaccctagtcggactattcggctacgtcggggtccnccgaagaccctcgagggtcgagggggtctaggggacggtggggtacgtacgtagtttactttcagttagtagtaacgtaggtaaaagtcgttagtacctttactagttaccacggtaacgtttcccgggaaggtaacgggtccgttacttccgaacccggttctaccgaaacggtacaaaaccgtacgtccgtaacgggaccctaacgtacccgtcgttaggtaaccttcggtacggaaactaaaccgttacgaaaccgacggttaccctagggaacgtacggtacgttacgggaacgggtacncccggttaggttagttacggttaacgttaccgttcgggtaacgtaacggttaaacgtttacctttaaggtaccggttaggtaagggtttacccggg

SEQ ID NO: 244390 - DNA, 617 bp, Homo sapiens
  misc_feature: GYAE6OF02HAUUA.11.71.G05.1.454.CMB.1.raw
  modified_base (344)..(344): a, c, t, g, unknown or other
  misc_feature (344)..(344): n is a, c, g, or t
tcagcgagagataccacgaccggtgctcgatttagtgtcgtcgcaagagagagggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtctggggggaggcgtggtccagcctgggaggtccctgagactctcctgtacagcctctggcttcaccttcattacctatggcatgcactgggtcccgccagacctccaggcagggggctgggagtggggtgcagtttnttcatatgataggaaatagtgacttctattcagtactccggtagaacgggccgattccgaccgttctaccgagacgactaacgttccgaggccacgacgtcgttagtactcgtagactaaacgtgaaccgtagccgtaggagacgtacgtggaacggtaccgaccgggtcttacggttcggttaactttacggttcggtaggtaacggtaaagttacgttttaccgttaagttaagggtacgggttacggtaaccggggttaacccggggggg

SEQ ID NO: 244391 - DNA, 730 bp, Homo sapiens
  misc_feature: GYAE6OF02J16YY.11.71.G05.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
tcagcgagagataccacgaccggtgctcgatttagtgtcgtcgcaagagagaggggggaactgctcagttaggaccagagggaaccatggaagccccagctcagcttctcttctcctgctactctggctcccagatagcaccggagaaattgtgttgacacagtctccagccacctgtcttgtctccgaggggaancgccaccctntcctgcagggccagtcaggagtacgttaacngcttacttagcctaggtaaccaacagaaacctgaccaagctaccgagtcctcctcatctatgtactcgacatacccaaaggcggtaccacggtcggaccaccccgtaacggccttaaggtccaggttcggaccgtagggtccggggtctacggggacctaacgaccctttcgaccgttccaccgtaacccgataccgagaccgtacgtaccgtagaaccgtccgtaaggttacggttaccgtttaggtaccgtttaacggttttacctacgtttacggtcgttaaccggttcacggttacggttaaccgttacggtaactttacccgggtagtttaacccgttacccgggttaaccgggaaccgtaaaccggggttaacctaccggggtaaacgttaaccgggtaaacttaaacggtaaccgtgggttaccgtagtacccgtaacgaccgttacgtttcgtcgttaccgtaccttaccgttccgttaaccccg

SEQ ID NO: 244392 - DNA, 730 bp, Homo sapiens
  misc_feature: GYAE6OF02IJUV8.11.71.G05.1.454.CMB.1.raw
  modified_base (174)..(174): a, c, t, g, unknown or other
  misc_feature (174)..(174): n is a, c, g, or t
  modified_base (178)..(178): a, c, t, g, unknown or other
  misc_feature (178)..(178): n is a, c, g, or t
  modified_base (187)..(187): a, c, t, g, unknown or other
  misc_feature (187)..(187): n is a, c, g, or t
  modified_base (270)..(270): a, c, t, g, unknown or other
  misc_feature (270)..(270): n is a, c, g, or t
  modified_base (335)..(335): a, c, t, g, unknown or other
  misc_feature (335)..(335): n is a, c, g, or t
tcagcgagagataccacgaccggtgctcgatttagtgtcgtcgcaagagagagggggggggagaggacgcccagcactagaagtcggcggtgtttccattcggtgatcagcactgaacacagaggactcaccatggtagtttgggctgagcgtggtttctcgtgctactttagnggtntcagtgtcnggtgcaacgtggaggtgtcgtgggggagcgtggtccagccgtgggacggtcctgaagccttccgtcctgtacgacgtcccttntgggtccttacaccctttactacttacctagtcgggctaacgtcgactaccggttcgggtccccnccgtaacggccctaccggaaggggcggtagggggtctagggggagtttgggggcgtcgttaagtttactttcgaagttgttaacgtaggtaaaggtaaaaacgtttcgtaaaccttttcgttaaacgtttccaaaggacccgttttaccggggagtaaaccgggggtcctacgtttacccgtacccgttaccgtacgtacggaacgtacgtaacctaacggtacgaccgaacgtaacgtcgttgtacctattacccgaagtaaactagaacctacgccgtagagtcggacgtagggcaaccggtacgtgtacggtttacttagttaccgttggtacgaaaggttagtaaggtttactaacggttaggtaacggtacggtacggttcggggttacg

SEQ ID NO: 244393 - DNA, 871 bp, Homo sapiens
  misc_feature: GYAE6OF02HS67V.11.71.G05.1.454.CMB.1.raw
  modified_base (344)..(344): a, c, t, g, unknown or other
  misc_feature (344)..(344): n is a, c, g, or t
tcagcgagagataccacgaccggtgctcgatttagtgtcgtcgcaagagagagggggctgggagaggagcccagcactagaagtcggccggtgtttccattcggtgatcagcactgaacacagaggactcaccatggagtttgggctagagctgggtttcctcgttgctctttaagagtgtcagtgtcaggtgcaactggagagtcgtgggggagcggtggtccaggcctggggacggtccctaggagacttcctccgttgtaccgacgcccgttactcggtaccttccgaccttttccattaacccgttatcgggcctattagccgaacgttggggtaccccnccgaacgtacctcccgagggccgaacggggggtcctaggggacgggtggggttcggacgtaaggtttacgttttcgaacgttagttaggtacgttagggtaaaaattacgggttagtaacctttaccgttaactttaccgaaacggtaaccgttcccgggtaacgggtaaacggggtaccccggttaagtttaccccgtaaccgggtttacccttaccccggtaaaggtaacccggttaaacaaaccgtttacccgttaaacgggacccgtaaaccgaaccggttacccgtttaacggttaaccttaccggttaccggtaaaccttaaaacgtacccgtttaaaccggaacccgggtaccccgtaaggggtaacgggtaccggtaccggttaggggaaccggttaacccgggacggttaacccggttggtttaacggtttaaacgtttcccggtaaggtttccgggaaacggttaaccggtttaactttttaacgttaaacgtacggggtttaaggttaacccgggg

SEQ ID NO: 244394 - DNA, 816 bp, Homo sapiens
  misc_feature: GYAE6OF02JEYH5.11.71.G05.1.454.CMB.1.raw
  modified_base (128)..(128): a, c, t, g, unknown or other
  misc_feature (128)..(128): n is a, c, g, or t
  modified_base (181)..(181): a, c, t, g, unknown or other
  misc_feature (181)..(181): n is a, c, g, or t
  modified_base (384)..(384): a, c, t, g, unknown or other
  misc_feature (384)..(384): n is a, c, g, or t
tcagcgagagataccacgaccggtgctcgatttagtgtcgtcgcaagagagaggggctgggagaggagcccagcactagaagtcggcggtgtttccattcggtgatcagcactgaacacagaggactnaccatggagtttgggctgagcgttgggttttccctcgttgcttcttttaaggnggtgttccagttgtcaggtgcaacgtggaggtagtcgtggggggagcggttggtccgagtccgttggggaccgttcccgtaggacgtaccttctccgtagtaccacgtccttctggtctttaccaccgtttacactttacctacgtcggctaactcggactacccgttggggtccccgccaggtaaccctccgagggaccggnggggggtcctgggtaacggggttcgggtgggacttaaggttttacttacgtatagttcgaagtaaggtaaagttacggttgtaactttcttaacgtttcggaacggttaccgtacgggttaccgggtaacgggtcccgttactttaccgacccgttaccgtcgtaacggaacgtaactaacgttaccgacggactacccgtaccgtaccgttgtaccgttacgtacggttaaccgtaaaacggtacgtaaactaaccgggttaacccgtcgggttaaacgaccggtacggttaacggggaaccggtacggtaaccgggtacgggtttaacccggttaagtttaacgttaccggtttaggttaaccggtaacgggttaaacgtttaacgtttacgggtttaaacggtaagggttaaccgggttaacccggggg

SEQ ID NO: 244395 - DNA, 919 bp, Homo sapiens
  misc_feature: GYAE6OF02GV364.11.71.G05.1.454.CMB.1.raw
tcagcgagagataccacgaccggtgctcgatttagtgtcgtcgcaagagagagggggggagaggagcccagcactagaagtcggcggtgtttccattcggtgatcagcactgaacacagaggactcaccagtggagtttggctgagtcgttgggttttcctcgttgcttacgttttaagaggtgtccagtgtcaggtgcgaacgtggaggtaggtcggtaggggggacggcggttcggtaccgacggtccggtggggtacggtcccccgtgggaacgtaccttccgttccgtcgtacgacgtcccttcgtcggttccttacctaccttccttaactttacctagttcggactacgttcgcgtacgttccgggtacccgaccgacggtaccgtcccgaacgggtcccgggagggggtccgtggggttacgggtggggtacggtacgttaacggttttacgttttaccgaagttacgttagggtaaacgttaaagggtaaaagtttgggtttaacgtttaaccttttccgttaaacgtttaaccggtaaaccggtttacccccggttaccggggttaaaccggggtaaaccgggttcccggttaaaccgtttaacccggttaccccggttccttaacccggaaagttaaaccgggaaacctttaaacccgggttaccgaaccggacccgtaaccggtaaccgttcggtttaacgttacctacccggtaaggaaacctaaacgtaacggtaaaccgacccggttaccgtaacgaacgggttacgtaccggtaaggtaacccggaaccggtacgggttaccggttagtttaccggtttaagtttaccggtagtaacggtaccgtttaaagttacgtttaacggttaaggttacggacggggttacgtaccgggttaaccgggg

SEQ ID NO: 244396 - DNA, 651 bp, Homo sapiens
  misc_feature: GYAE6OF02FLGNQ.11.71.G05.1.454.CMB.1.raw
  modified_base (311)..(311): a, c, t, g, unknown or other
  misc_feature (311)..(311): n is a, c, g, or t
  modified_base (641)..(641): a, c, t, g, unknown or other
  misc_feature (641)..(641): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagccgtgggacggtccctgagactctccgtgtacagcctgtggcttcaccttcattacctatggcatcgctacgtgggtcccncagacctccgaggcgagggggctgggagtgggtgctagttattcgatagtgagtaggaaattggtcgactttacgtattcgacgtaccgttcgtaggtaacggggtaccgtagtttaccgaccgttcctacccgaaggtaacgtaacctaaacgttcccggaacggtaccaaccgtaaccgtacgttacgtacgttccgtacgtaaactaaagtacgaaaccacggtacccgttaggaacggtacgtcgtaacggacggtaccgacggtacgtaggttacgtaacgttacgttaggtaacgacggtaattacgtttacgtaagttacggnggttaacggg

SEQ ID NO: 244397 - DNA, 758 bp, Homo sapiens
  misc_feature: GYAE6OF02I6I2E.11.71.G05.1.454.CMB.1.raw
  modified_base (165)..(165): a, c, t, g, unknown or other
  misc_feature (165)..(165): n is a, c, g, or t
  modified_base (200)..(200): a, c, t, g, unknown or other
  misc_feature (200)..(200): n is a, c, g, or t
tcagcgagagataccacgaccggtgctcgatttagtgtcgtcgcaagagagagggggtctgggagaggagcccagcactagaaggtcggcggtgtttccattcggtgatcagcactgaacacagaggactcaccatggagtttgggctgagcgttgggttttccncgttgctcttttaagaggttgtccagtgtcaggtncaactggagagtcgtggggagtcggtggtccagccgtgggagtcccgtagacgacctcgtcgtagtacacgtcctacgtggtccttccgaccctttaccgtaactttaacccgtacgtacggtacgtacttcgtacccgtaacgttccggggggtacccgtaaccccgaggtaccctacccggaacggggcccgggtaggggggggtaccgtggggtaaccgggtgggggtacggcgttaaacgtttacgtttcgtaagtacgttacggaaggttacggaaagttaggtaccgtagttcttacgtacgtacgtaaccgttccggtaacgggaacggtcccggtatcgtacccgtactacccgtagacgaacctaacgttcccgaaacggcacccgaaccgtatacgtacgtcgtacgtactaaagttacgaataccgtcgtaacggtaagtacgacgtaggtaacggaccgtaaccggtcggttacgtaagttacgttacgttaggaacgtaacgtaaagtttccgttaaccgttagttacgggtacgttaacccggg

SEQ ID NO: 244398 - DNA, 886 bp, Homo sapiens
  misc_feature: GYAE6OF02JCNUB.11.71.G05.1.454.CMB.1.raw
tcagcgagagataccacgaccggtgctcgatttagtgtcgtcgcaagagagaggggggaactgctcagttaggacccagacggaaccatggaagccccagcgcagcttctcttcctcctgctactctggctcccagatagcactggagaaatagtgatgacgcagtctccagccaccctgtctgtcgtcgtccgaaggggaaacgacgccctacccctctcctggccgacggggcctaggtcaggtaggttagggttaagggacgtacctaaacgtttacggtcccggttacggtaaccaaggtaccaaacggtaaacccgtcgggacccgaacggggtcccctacccccggtaagggtccccttcccgttacgtacgttacctaaggttcgggtacgccgtaaccgtaccccggaaccggtaccgggtccctaacgtttcccgggtttaccccacggtcccgttaacgggttacacgggtcgggacgtacgggttgggtaccgtaagggacgtaacgtacggttacgttcctaaccgttccgtaccgtaacccgtacgtacccgtaaacgggtcccgtaggtaccgtaagttcgtaaaggttaacggttttacgtttaccgggtaacgttttacgttttaacgtttaccgtcgttaacgtaacggtacgtaaagtttaaacgtaaaccgttacggttcccgggttaccgttaaccggggttaacggtacccgggtaaaccgggtaaaaccgggtacggttaaagggggtacggtaaaccgggttaacctaaacgggtccggttaacggtccggtaacgttaccggtaacccctagtttacccttacggtttaccggttaccctttaacgtcccgtttaaccccgg

SEQ ID NO: 244399 - DNA, 794 bp, Homo sapiens
  misc_feature: GYAE6OF02JXTBC.11.71.G05.1.454.CMB.1.raw
  modified_base (326)..(326): a, c, t, g, unknown or other
  misc_feature (326)..(326): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcttgggttttcctcgttgcttcttttaagaggttgtccagtgtacgaggtgactaacgtgggaggtagtcgtgggggacggcggtggtccgagtcccgtggggacggtccctggacgactctccgtagtacgacgtcctcgtcgtaccttccgtacttctacttaacctgtaggcngttcgaccgtacgtccgggtcccaccgacgtaccgtccgacgggtcggacggggacgtggggtaaggtcgggtacgtacgttaggttttacttcgagttagtaggagttaacggtaaagttacggttactacgttacgttaagttcgaacccgtaccgtttacgggtacggtaacggggtaaccttaccgttacccgttaccgttccgttaaccggacgttaaacggtaccttaaaccgttcccgaacggtacccgtaccgaccggttaccgttagttacccggttaccgttacgaaacgttaaaccgtaccgtaaacgacgggtacccgtaaggactaccggacgttaaccgggaacggtacggtaacggtacggttaacgttcggttaaacgtttcccggtggtttaaaccgtaacggttaacggtttatttaacggtttaacgttagggtacggtttaacccggg

SEQ ID NO: 244400 - DNA, 646 bp, Homo sapiens
  misc_feature: GYAE6OF02FTLCV.11.71.G05.1.454.CMB.1.raw
  modified_base (161)..(161): a, c, t, g, unknown or other
  misc_feature (161)..(161): n is a, c, g, or t
  modified_base (179)..(179): a, c, t, g, unknown or other
  misc_feature (179)..(179): n is a, c, g, or t
  modified_base (240)..(240): a, c, t, g, unknown or other
  misc_feature (240)..(240): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
  modified_base (580)..(580): a, c, t, g, unknown or other
  misc_feature (580)..(580): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgtggtttccncgttagcctactttaagngtgtccagtgtcaggtgcaactggaggtatcgtgggggagcgtgaccagcctgggagtccngacgctctcgtagtacagtcgtcgtaggacttccaccttcgagngcctagtgactncgacncgtcggccncaggtacctcgaggctagggcttgggatcgggnctagttagcgtggttangtaacgtggtaatttacaaattcgacgttgggatacccgcggtaggaacggtcgtacgttaccacttactaccgtacaacggtacctacgtaacccgtttaacgaaacggttaactacggggtaccttacgtccgtagttaacgaaacgtagaaccgacgtactaggacgtacgaaccggtagacccgtacgggtattaccggtacgttaaggttaccgnggttaccggaacggggtaacgtaaacggcggttaacggacgtttacgggaccggtaccggtagggg

SEQ ID NO: 244401 - DNA, 786 bp, Homo sapiens
  misc_feature: GYAE6OF02GNBHB.11.71.G05.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
tcagcgagagataccacgaccggtgctcgatttagtgtcgtcgcaagagagaggggggaggaactgctcagttaggacccagagggaaccatggaagccccagcgtcagcttctcttcctcctgctactctggctcccagatagcaccggagaaattgtgttgacacagtctccagccaccctgtcttgtctccgagggaangccacctcncctgcaggccagtcagtagtacgttaacgagcctaacgttagccgttaggtaaccctaaacacgaaaccgtggacccagaccctcccgaagcctaccctacaacttacgtataggactcgacctacgtacccaaacggacggggtacccacggttccggacccgaccccgacgtacccgtacggttcgaacgggtcggtaccgtacgggtttcgggggtaccgttcggggacccgttaaacggtaacccgttaccttacccgttcctaacccgtaacccctacgtttaaccgaaggaccccgtaacgggtacccgttaaagggtacccgggtacccggttaaagggttaacgggttaacgttttacggaacccgttttaaagttttaaccggttactttacgggtccttaacggtacgtaaccgggtacttaacggtcggttaacggtacggttaccgtcccttacgggttaccggaaccgtaagggtaccacggttaacgtacgggtaaactaacggtaacggttggtacggtacctaggtaccctacgtctcgttacgtcttacacttccccg

SEQ ID NO: 244402 - DNA, 660 bp, Homo sapiens
  misc_feature: GYAE6OF02GAWGL.11.71.G05.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (288)..(288): a, c, t, g, unknown or other
  misc_feature (288)..(288): n is a, c, g, or t
tcagcgagagataccacgaccggtgctcgatttagtgtcgtcgcaagagagaggggggagaactgctcagttaggacccagagggaaccatggaagccccagctcagcttctcttcctcctgctactctggctcccagatagcaccggagaaattgtgttagacacagtctccagccacctgtctttgctcagggaanagccacctctccngacaggccagtcagagtgttaacagtctaacttagcctaggtaccaacagaaacctggaccagactccgagctcctnatcgtatcggatcgactactaccgaacgacggtccacgtcgaccaaccccaggacccttaggttaccgagttggacctaggtcgggtccgtggaacaggttacctacgctactaccgaacacgtacgacgaccgtacgacctaagtaccgtccgttaagtacggtttaacgtttcggaaccttaaggttttaactttaccgtcggttaacacggtaacgtccggttagttaacctacggtaacctggtaccttccggtaaccgtttaccgggaccttaacgggaacccgtaagtaccgtaaggtaaaccgttaacgaacggttgtacggacctgaacctactacggtcttcttacgttccactttccccggg

SEQ ID NO: 244403 - DNA, 798 bp, Homo sapiens
  misc_feature: GYAE6OF02JSQ4G.11.71.G05.1.454.CMB.1.raw
  modified_base (133)..(133): a, c, t, g, unknown or other
  misc_feature (133)..(133): n is a, c, g, or t
  modified_base (346)..(346): a, c, t, g, unknown or other
  misc_feature (346)..(346): n is a, c, g, or t
tcagcgagagataccacgaccggtgctcgatttagtgtcgtcgcaagagagagggggggagaggagcccagcactagaagtcggcggtgttccattcggtgatcagcactgaacacagaggactcaccatggngtttgggctgagctgggttttcctcgttgctctttaagtaggtcgtccagtgtcaggtgcaaactggaggagtgtgggggaggcgtggtccagtcctgggacggtccctgacgactctcctgtacaggccttctcggtccttataccttccagttaccctattcggctatggctaaccgttggggtcccgccagtaccgtacggtaacgggtnaccgggtgggggtcgtcggtagggttgggttccgaaggttacgttacgttacgtaaggtaagtcggtaacgggtaaaattcggttaacgttaaccgttttccgtaaacgtttaccgaaggggtaccctttaccggggtaacgggtaaaccggggttccccgtaacgtttacccgaacccgttaccgtaacccgtaacggtaaccggtaaaccgtaaacgttacccgaaggtacccgtaaaccggtaccgtacgttacggttaaacgttacgtaacggtaccgtaaaacgttcgtaaacgtacggtacccgtaggaacggtacggtaccgtacggtacggtacgtaacgggtaccgttacggttacggttaacggttcccggtaaggttaacggttacgttaacgtaacgttacggtaacggttacggtaacggttacggggtacgtacgggg

SEQ ID NO: 244404 - DNA, 725 bp, Homo sapiens
  misc_feature: GYAE6OF02JMB0G.11.71.G05.1.454.CMB.1.raw
  modified_base (196)..(196): a, c, t, g, unknown or other
  misc_feature (196)..(196): n is a, c, g, or t
  modified_base (259)..(259): a, c, t, g, unknown or other
  misc_feature (259)..(259): n is a, c, g, or t
  modified_base (589)..(589): a, c, t, g, unknown or other
  misc_feature (589)..(589): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctcgttgctcgttttaaagaggtcgtccagtgtcaggtncaactggagagtcgtgggggagcgtggtccagccgtgggacgtccctgagcctctctgtaacngcctgtggtccttccgaccttctagttaaccctatcggcctagttggcctaacggttcgggtcccgacccaggtaaccgtcccgaaggtcgggacggggtctggggtaacggtggggttcggacttaaggtttactttcgaagttactgggtaactaaggaaaacgttgtcgtaatttaaccgttattaccgaacgtcgtacccggttaagggtaaacggggcccgttaacttacccggtaacccgtcccgtacggtaaacgtacgtaaacttaccgtacgtaccgacgtaacgccgtagttaacgttaccgtagttaccgaaagttaanaaccgatccggtacgtaaggaccgtacgtacggtagaccgtcgggtaacgtcgttaacggtcgttaacgttgaaacggtcgtaaacgttaacggtttctaaggtaacgtaggtaagttaccggtaccgggttacgg

SEQ ID NO: 244405 - DNA, 634 bp, Homo sapiens
  misc_feature: GYAE6OF02FWX4S.11.71.G05.1.454.CMB.1.raw
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagctgggttttcctgttgcttcttttaagaggtgtccagtgtcaggtgcaactggaggagtcgtggggggaggcgtggtccagccgtggggacgtccctggacgactctcctgtacagcctntggccttcaccttcattacctatggcatgcacgtgggtcccnccagacctcgaggcgagggggctgggaggtggggtgcgtagtttacttcgaattagtcgaattaggaaacttaggtcgtaacctttcgtaatttcgaacgttaccgttaccggtaggaacgggtcctacttccgaccgtctaccgagtaacacgtaacttccgaggaccacgtacgtctagtactcgtagaacctaagtcgaacacgtccgtaggacgagccgtaggagaccgcgggtacttagtcggtttaacttacgttacggtacggtaacgtaagttacgtttacgtaacgtaggtacggtaccggtacgggttaccgggg

SEQ ID NO: 244406 - DNA, 943 bp, Homo sapiens
  misc_feature: GYAE6OF02GQVDT.11.71.G05.1.454.CMB.1.raw
tcagcgagagataccacgaccggtgctcgatttagtgtcgtcgcaagagagagggggggggagaggagcccagcactagaagtcggcggtgtttccattcggtgatcagcactgaacacagaggactcaccagtggagtttgggctggagcgttgggtttttcctcgttgcttactttttaaggaggttcgtccagttgtcgaggtgacaacgttgggacggtaggttcgggtaggggggaggcgttcgggtccacggtccggtgggggacggttccctaggacggtaccttcctccgttacgttaaccgacgtcccgttcgttcgggtccctttaccgtaccctttacctaactttaaccccgttaagttcgggaacctagttacggaccttaaccgggttccgggggttaccccgacccggtaaccgtacccgttaccccggaggggtacccgggacgggggggtccgttagggggtagggtttacgggggtcgggtaacggtacgtttttaacgtttaccgaggttaacgttaggtaaacggttaacgggttaaaagtttaacgggttacgttaaccgttttaacgttaacgtttaccgtaaaccggttaccggtttaccgggtaacggggtaaacgggtacccggttactttaccggtaccgttaccgttaccgtaacggtaccgtaaaccgtaaccgtttacccggacggtaacctaccgttaacgtcgtttaacggttactacggtacttaaaccgaaagtaaccggactaacgggtaccgagtaacggagtaccggtaggaaacggtaccgggacggttacgttcggttaacggtttcttaaccggttagggtaaccggttaacggttaaggtttacccgttttaaggtaacggttaacgggttacgggttacgggttaccggggtttacccgggg

SEQ ID NO: 244407 - DNA, 872 bp, Homo sapiens
  misc_feature: GYAE6OF02JIADM.11.71.G05.1.454.CMB.1.raw
  modified_base (206)..(206): a, c, t, g, unknown or other
  misc_feature (206)..(206): n is a, c, g, or t
  modified_base (251)..(251): a, c, t, g, unknown or other
  misc_feature (251)..(251): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatacgcaccggagtaaattggtgttgacacagtctcagccaccctgtctttgtctccgaggggaaanacgccaccctctcctgccagggccagtccaggtacgtgttaaacngtcttacgttacgccttacggtaaccaaacgaacggaaacccgttcggggacccctaaacggtaccccttacccggaacgggtcccttaccccgtaccgtaacttccgtttaacgttcggtaaacgttcggacctaaaccttacccgaaaaccggtaccgggggacccctaccgttccgggaaccccaacccccgaggtaccccgtaaggggtttacaacggttcggaccgtaggggttcgggtccgttaagggggacctaacggttaccttcgtaaccctacctacccgaacctacttaccgacggacctaaccgaccgtaacggtacggtacccgttaggtacgggttacttttcggacgttttacggtttttaaccgttacgtttacggtacctaacgggtaccgtaggtccgttaacgtcccggttaacggttcggtaaccgtttacccgtaccgggtttaccccgggaaccggtaaaccgggtaacccgtaaccgtaaaccggtttacggtaaaaccgtttaacccgggttaaaggttaccggtacggttaacccgtacggtaccctaaccgttaccgtttccgttacgttaacccttcgttaccctttaccccgg

SEQ ID NO: 244408 - DNA, 698 bp, Homo sapiens
  misc_feature: GYAE6OF02G2ABB.11.71.G05.1.454.CMB.1.raw
  modified_base (148)..(148): a, c, t, g, unknown or other
  misc_feature (148)..(148): n is a, c, g, or t
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (284)..(284): a, c, t, g, unknown or other
  misc_feature (284)..(284): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccgganaaattgtgttgacacagtctccagccacctgtctttgctcaggggaaancgccaccctntctgcagggccagtcagatgtaacngctacttagcctaggtaaccaacagaaacctggaccagacctccaggctccncatctatgaatcgactactaccaaacgacgggaccacgtcggaccaaccccgagtaccacgggtttacaagggtcggacgtaacggtggggtctaggggaacacggtaccttcacgtccttaccactacgtacgaaccggtctcgtaccgtaggttacctaggtaaacgttagttttagaccgttaagttttacgttacgttacggtaactagtactaaagttaacttaaaacgttaacggtcggtaaccgttaccgggtaacggtaccggtaaccggaaaggggtaacccgtaaaggggtacggtaaacgttaccgaaaacgttacggtcggtaacggtacggtactaacccggacgttacgttaacgttcgtttcccttaacgaccgttttccctaccccggacttaaccgg

SEQ ID NO: 244409 - DNA, 888 bp, Homo sapiens
  misc_feature: GYAE6OF02FXGMZ.11.71.G05.1.454.CMB.1.raw
  modified_base (201)..(201): a, c, t, g, unknown or other
  misc_feature (201)..(201): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctgcctcccagatagcaccggagaaattgtgttgacacagtctccagccaccctgtctttgtctccgaggggaaancgccaccctctcctgcgacgggccagtcagagttgtaacagcttacttacgcccgttaggtaacccaaacgaacgaaacccgtcggacctaacgaacccgtaccccgtacggcccttccccgtactaacttccttaagttcgtaagtcgaccgaaccgttacccgaaaccgtaccgggggacccctaaccggtccgggaccccaaccccccggaaccgacccgtaacggggtttaccaacgggtccgggtaccgtaggggttacggggttaccgttacgggggaaccgttaacggtaaccgtttccgtaacccgttaccgtaacccgtaacccgtaaccttaccgaaccgtacgtaaccggtacccttaacgggaccgtaccgttacgggtaaggtttaacgttttacggtaacgtttaacgtttttaacgtttaacgttacggttaccgtaacggtccctaaacggtacgttaacggttacccgttaacgggttcggtaaccgttaacccgtttacccgggttaccgggaacccggtaaacgggaaccgtaaccgttaaccgttaaacgggtaaaacgttaaacccggttaaacgtacgggtaccggtaacccggttacgtaacccgtaccgtaccgtttactttaccggttccctttaaccgttaccctaccccgtttacccccg

SEQ ID NO: 244410 - DNA, 740 bp, Homo sapiens
  misc_feature: GYAE6OF02FMFYN.11.71.G05.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
tcagcgagagataccacgaccggtgctcgatttagtgtcgtcgcaagagagagggggggaggaactgctcagttaggacccagagggaaccatggaagccccagctcagcttctcttcctcctgctactctggctcccagatagcacggagaaattgtgttgacacagtctccagccacctgtctttgtctcgaggggaanacgccaccctctctgcgaggccagtcagagtataacngtctactacgcgtacggtaaccaacacgaaacctcggaccacgactccgacggcctcctactactctatgattcgctaactaccaacgacgggcccacgtaccggacccaccccgacggtacccgtaggttccgtaaggtcggaccgtaaggggttcgggttaccggaggggaactacggtacctttacgaccttaccgtaccaacctactacgtacgaccgtaaccgaccgtaacgacggtaccgttagggtaacgtttacgtttacgtaacggttttaacgtttttaacgttaacgttacggtacgtaccggtaactacgggtttaccgtacggttacggttacggtacggtaccttaacgtaacccggtttaccgaaaccgttaacgggacctaaacggtacggttaaaggtaaaaccttaaacggtaacggtcggttaacggtctaacggttaccaacgtacgttccgttaccttttacgttaccgttactttccccg

SEQ ID NO: 244411 - DNA, 775 bp, Homo sapiens
  misc_feature: GYAE6OF02GW6UK.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggagcgtggtccagccgtgggacggtccctgacgccttctcctgtacacgcctcgtcggtccttcctaccgtttcaactttacctagtcggcagtgcctacgtcgggtcccgcctacgacctccgagggacgacggggggtctaggggaggttcgggggtggtaccgtaggttttactttacgaattaggtagtaggttaacgggtaaatttacggtaggttactttactttaacgttacgaacgtaccgtttaccggtaaggggtaaccgggtaccgttaacgtttcccgtaacccgtccgtaccgtaaagggaccgttaacgtaacccgttacccggaaggaccctaaccggtaccggtaccgtttacgttaagttaccgttacggtaaacctaaacggttaccggtaaaccaccggtacccgttaaggaaacccgggtactaggttaccgggacggaacccggtacggtcggttagtttacgttacgtttaacggtacgtacgggtaaacgttaacggtttacttaccggttaagtaacgggttgggttaaccgggg

SEQ ID NO: 244412 - DNA, 742 bp, Homo sapiens
  misc_feature: GYAE6OF02HR1FG.11.71.G05.1.454.CMB.1.raw
  modified_base (211)..(211): a, c, t, g, unknown or other
  misc_feature (211)..(211): n is a, c, g, or t
  modified_base (255)..(255): a, c, t, g, unknown or other
  misc_feature (255)..(255): n is a, c, g, or t
tcagcgagagataccacgaccggtgctcgatttagtgtcgtcgcaagagagagggggggaggaactgctcagttaggacccagagggaaccatggaagccccagctcagcttctcttcctcctgctactctggctcccagatagcaccggagaaattgtgttagacacagtctccacgcctaccctgttctttcgtctccgaaggggaaanacgcccaccctctcctgcgacgggccagtcagacgtagttaacngtacctacgttacgaccgttacggtaaccaacgaacgtaaaccgtcggacctacgaccctcccgaacggtccctcctacacttacgttaacgtgagttcgaacctataacccgtaacggaccggacctacgtccggacccaccccgaggtaccgtacggtcgtaggtcggtacgtacgggtagggtccggttagggaccgtaacgtaccttacgacccgttacctaaccaccgtactaccgacgtacgacggtaccgtaacggacgtaccgtaaggttacgtttagtttcggtaactttaggtttacttaacgtcggtaagtacgtactaggttaccgtataccggtattaccggtactacccgtaacggttccggggaacgtaacggtaacgtacgtaacggtaaacgttaacgtaccggtaacggtggtaccgtacgtacgactaacttcgtaacgtttccgtaacttaccgtacttacccccgg

SEQ ID NO: 244413 - DNA, 754 bp, Homo sapiens
  misc_feature: GYAE6OF02F0CTI.11.71.G05.1.454.CMB.1.raw
  modified_base (201)..(201): a, c, t, g, unknown or other
  misc_feature (201)..(201): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaaanacgccaccctctccgtcgcgacgggcccagtccaggtagttacgttaaacagtaccttacgttacggccgttacgggtaaccaacgtaacggaaacccgtcggaccaacggtaccctacccgacggtccctaccctctattacctatcgaagttcgacaactacccaacggacgggacctacggtcggacccgaccccaggtaccgtacggttaccgaggtcggtaccgagggttcggggtcgaacggggacctacggttaccttactacgtcccgtaccgacctacgtcgaacgtaccgaccggtaccgtacgggaaccgtccgtagggtaacggttagttttcggaacgtttaggtttacctttaacggttcgacgtaacggtacacggttacgttaacctacgggtaacggttcggtaacctacgttcccggttaccggaacgtaaccgggaacctaacggtagttaacggtaaacttaaccggacgttggtaacggctaccggtcctaagtcgttaccgttctaccgttacctacttaccccgtacccg

SEQ ID NO: 244414 - DNA, 848 bp, Homo sapiens
  misc_feature: GYAE6OF02JBQW7.11.71.G05.1.454.CMB.1.raw
tcagcgagagataccacgaccggtgctcgatttagtgtcgtcgcaagagagaggggggggaggaggagcccagcactagaagtcggcggtgtttccattcggtgatcagcactgaacacagaggactcaccatggaggtttgggctgagcttgggttttcctcgttgcttcttttaagaggtgtccagtgtctaggtgcaacgtggaggagtcggtgggggaggtcggtcggtccaggccgttggggacggttcccctggacgacctcgtaccgtagtacgacggtcctcgtggtccttcctacccgttctactttaacctagtcggtacctagttcgaccgtaccggttcggggtccccgccgtaacggaccgtaccccggaggggtcccggacggggggtccttagggggacggggttggggggtaccggtaccgttaaggtttatttcaacgtttaaggtgtaaacgtttagggtaaaattacgggttacggttaaccttttcgtaaagttttaccgaaaggttaaacttcccgggtaaggaccgggtacccgttacttaccgtacccgttactacccgtaagtaacgtaccgtaacgtaccgtaacggaccaaccgtaacccggtacccgttacgttaccgtcgtaaaccgtaacgtacgtaaaaccgtcgttaccgtaacggtaacggacgtaccggtaacggaccggtaacggtacggtacggttcggtttaacggttaccggtttaacggttcggttaacggtaacggttaaacgttacgtttacgttaaggtaaccgggttagggttaacgggttaccggggttaaccgggtttccgggg

SEQ ID NO: 244415 - DNA, 1030 bp, Homo sapiens
  misc_feature: GYAE6OF02I4LXN.11.71.G05.1.454.CMB.1.raw
tcagcgagagataccacgaccggtgctcgatttagtgtcgtcgcaagagagagggggggggagaggagcccagcactagaagtcggcggtgtttccattcggtgatcagcactgaacacagaggactcaccatggtagtttgggctgagcgttgggtttttcctcgttgcgttctttttaaaggaggttgttccctagttcgtacgagggttcgaccaaacgttgggggaaaggtaacgggtttcggttagggggggggtaaggggtccggtttacgggggttcccccgtaagggtccccggtttggggggggaaacccgggtttccccccgttagggaaccggtacccccgtttcctttacccccgttagggtaaacccaaccggtccccggtttacccgttccggttccttttaccctaaccccgttttactaacccgttttaacccttagtacgggtaccagtttcggcctaaccggtttcgggggtttaacccccgcctaacggttacccctacccggtacggggaccgggtaccggggggggtccttagggggtacgggttacgggggttcgggaacccgttttaggtttaccttttaggtaacttagggttagtaaacgggtttaaagggtaaaaccgtttaggttaccggtttaaccttttaccgtttaagtttaacccgtacggttaaccccggtttacgggtaacggggtaacccggttacccggttaacgtttacccgtaacccccggtttcgtaacccggtttaaacggaaacggttaaccccgtaaacgttaccggtaccggtaacccgtacggttacccgtacgttaccgtaccttacgggttaaccacggttaaaacgtcgaaccggttaccggtaacccggtagttaacgggccgttacggaacggtaaccggaaccggtccgggtacgttacggtagtttctaacggtgtacggtaaagtaagttacgtttaacggaggtttcgtaaacgggttagggtacccggttaacgggg

SEQ ID NO: 244416 - DNA, 827 bp, Homo sapiens
  misc_feature: GYAE6OF02GPWPB.11.71.G05.1.454.CMB.1.raw
  modified_base (499)..(499): a, c, t, g, unknown or other
  misc_feature (499)..(499): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgttgggttttcctcggttcgcttacgtttttaaggaggtcgtccaggttgtcgaggtgacaacgtgggaggtagtcggtggggggagtcggtggtccaggtccgtggggacgtccctggacgtaccttcctcccgtgtaccgacgtccccttcgtcggtacctttccctaaccctttactaactttaccccgttagtcggactagtcggtacctaccggttcgggggtccccaccgagtacccgtcccggagggtaccggaggggggtctcggggagggttggggtaggtacttaggtttactttacgaattagtagtacgtaaggtaaagttaggtgttaccgtttnttaacgttcgaacggtaccgtccggtagggtaaccggtaccgtaccgttcccgtaacccgttcccgtaaccgtaacgtaacgtaaccgttaaaccgttacccgaacggtaccgtaaccgaccgttacgttacgttaccgttaccgtaacgtaactaacgtacgtaaccgtaccgtaccggttaaggaacgtacggtaccgtaggtaaccggacgtaccgggtaggtccggtttaagttttaaccggttccgttaacgggttacgggtaacgtttaaacggtttacgttttaacgttaacggttaccgggttaagggttaacccggggg

SEQ ID NO: 244417 - DNA, 756 bp, Homo sapiens
  misc_feature: GYAE6OF02JPMCT.11.71.G05.1.454.CMB.1.raw
  modified_base (276)..(276): a, c, t, g, unknown or other
  misc_feature (276)..(276): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatgggagtttgggctgagcttgggttttcctcgttgcttcttttaagacggttgtccagtgtcaaggtgcaagtggagtaggtcgtggggggaggtcgtggtccaggccgttggggacggtccctgacgtacctctccgtgtaacncgccttccgtcggtctttaccacctttcgaactttaccctagtcggactagttcgacgtacggtcggggtcccaccgtacgacccgtaccggacgggccggaacgggggggtccttaggggagggttggggtacgggccgttaagttttacgtccgtattaagaggtaacggtttaaggggtaaacttaaggtcgtttaccgtttacttaaactttcgtaaacggacccttacggggttaaggaccgggttaccctagttacccgtaccgtaccgtaccgaacggtaacgaaccgtacgttacccggagaccaacgtaccgcgttacgtactaccgataaccgtaactaacgaacggtcgaccgtagacgacggtcgaggtaaccgcgtaaccgggtcttagtaggttaacctgttaccgggaatacggttaacgtttagttaacgtacggtaaggtaaccgtcggtacggtacccgggg

SEQ ID NO: 244418 - DNA, 703 bp, Homo sapiens
  misc_feature: GYAE6OF02FPAEW.11.71.G05.1.454.CMB.1.raw
  modified_base (266)..(266): a, c, t, g, unknown or other
  misc_feature (266)..(266): n is a, c, g, or t
tcagcgagagataccacgaccggtgctcgatttagtgtcgtcgcaagagagagggggggagaggagccagcactagaagtcggcggtgtttccattcggtgatcagcactgaacacagagactcaccatggagtttggctgagcttgggttttcctcgttgcttacgttttaaggaggttcgtccagtgtcgaggtgacaacgtggaggagtcgtgggggagcgtggtccaggccgtgggacgtccctgacgactcctctagtacngcctcgtgtcttctaccttcacttacctatcggctatcgctacgtcgggtcccgccgacggtcctccggacggccgggaggggggtcgtaggggtagggttggggtcggtcgttaggtttactttaccgtagttagtcggtaagtaagggtaaagttaggttacgttaacttttacgttactttaccgaacgtaaccgttacccgggtaggaaccgggtccgtacgtttacccgtacccgttcgtacccgtaacgacgtaacctaacgttacccgagtaccgaaccgtacgtcgttacgtactctacgaactaagtaacgtaccagaccgtaggagagacggtggaacggtaccgacggttctaggttagttaacgttcgttaggacgtacgtaagttacttgtaagtaggtacgggtacggtaccggttaccgggg

SEQ ID NO: 244419 - DNA, 732 bp, Homo sapiens
  misc_feature: GYAE6OF02JLY18.11.71.G05.1.454.CMB.1.raw
  modified_base (103)..(103): a, c, t, g, unknown or other
  misc_feature (103)..(103): n is a, c, g, or t
  modified_base (272)..(272): a, c, t, g, unknown or other
  misc_feature (272)..(272): n is a, c, g, or t
tcagcgagagataccacgaccggtgctcgatttagtgtcgtcgcaagagagaggggggggagaggagcccagcactagaagtcggcggtgtttccattcggtnatcagcactgaacacagaggactcaccatggagtttgggctgagcttgggttttcctcggttgccttacttttaaggaggttcgtccagttgtacgaaggtgacaacgtggaggacgttcggtgggggacgcgtacggtccaggccgtgggacgtccctggacgcctcnccgtgtaccagtccttcgtcggtcttcctaccgttctacgtttacttagtcggcagtcgaccgtacgttcggggccctaccgagtccccgtccgaacgggccggtacggggggtcttggggaacgggttcggggtacggaccttaaggtttacgtttacgattacggtgtaacgttaagggtaaatacggttagtactttacgtaacttacgacggtaccggttaccggagggaaccgggtcgtacgttaccgtaccgtacgtaccgtaagtaacgtaacgacttaccgacgtaccgtaaccgacgtacgtacgtacgtacgtacgaacgtaagacgtaacgacgtccgtaggtacgtacgacgtacggtacgacgaccggtacgtacggttcgtaagttccgtagtacggtagtaacgttacgtttacgagtacggtacggtacgtacgggtaaccggg

SEQ ID NO: 244420 - DNA, 910 bp, Homo sapiens
  misc_feature: GYAE6OF02GATXZ.11.71.G05.1.454.CMB.1.raw
  modified_base (163)..(163): a, c, t, g, unknown or other
  misc_feature (163)..(163): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcttgggttttccncgttgcttacgttttaagaggtgtaccagtcgtcaggtacaacgtggaggagtcgtgggggagcgtgtccagcctgggacgtccctgacgctcctctagtacagtcctcgtacggtccttacctacccgtttctaacgtttaacctagtcggactagttcgacctaaccggttcggggccccgaccgaacgtaacccctacccggtacggggaccggaacggggggtcctagggggaagggttcgggggtacggtaccgttaacggttttacgtttacctaagttacgtaggtaacgttaaggtaaaactttagggttaccgttaccgttttaacgttaacgtttaccgtaacgggtaacccgtttacccgggtaacggggtaacgggggtacccgttaacggtttaccccgaacccggttacccgtaacccggtaacggaaccgtaaaccgttaaaccgtttaaccccgggaacggtaacccgtaaccggtacccgttcgttaaccgtttaacgttacccggttacgaaacgtaaaacgttaaccgaaaccctaacgggtacccgttaagggaaacgtaaccggtacgttaacggaaccgggtaaccggtaccggttccgttaacgggtttaaacgttaaccgtttaacccgggttaggtaaaccgggttaaacccggttaaaacggtttacgtttaaacccggttaaggttaacggggttaaccgggttacggttaacccggggg

SEQ ID NO: 244421 - DNA, 837 bp, Homo sapiens
  misc_feature: GYAE6OF02JPKF2.11.71.G05.1.454.CMB.1.raw
  modified_base (702)..(702): a, c, t, g, unknown or other
  misc_feature (702)..(702): n is a, c, g, or t
  modified_base (782)..(782): a, c, t, g, unknown or other
  misc_feature (782)..(782): n is a, c, g, or t
tcagcgagagataccacgaccggtgctcgatttagtgtcgtcgcaagagagaggggggaactgctcagttaggacccagagggaaccatggaagcccagctcagcttctcttctcctgctactctggcctccagatagccgaccggagaaattgtgttgacactagtctccagccaccctgtctttgtctccgaagggtaacacgtcctacccgtctaccgtcgacgacgggcctaagtccaggtacgttagttaaactaggtccttaacgttacgtcccgttagggtaacccctaaactaacggtaaaacccgtcgggcccgtaacggtaaccccttccccggaacggtcccttacccgttaccgtaacttaccggttaacgttacgtaacgtttcggaccttacccgtaaccgtaaacgtaaccggggaccctaaccggttaccggaccgtaaccccccgtaaggtaccccgtttaacggggttaccggaacggttaccgggggtaccttagggttacgggggtaccgttacgggggtaaccgaacggtttccgtttaactaaccccgttctaacccgtacccgtacttacccgacggtaccgtaggtaccccggtaaggtacgccccggtaaggttacggtttacgtttacggctttaaccgtttaaattcgtcgttaccgagtaccctagcgtttacncgtcgttacgtactcccgtaattccgggacctaaggtacgtaccgaagtaaccggttaacttaacggacgaacgggtttnaccggtacaccgtaacgtcgttaccgtcgttacgtaccgttctccgttaacccgg

SEQ ID NO: 244422 - DNA, 719 bp, Homo sapiens
  misc_feature: GYAE6OF02IPHWQ.11.71.G05.1.454.CMB.1.raw
  modified_base (273)..(273): a, c, t, g, unknown or other
  misc_feature (273)..(273): n is a, c, g, or t
  modified_base (314)..(314): a, c, t, g, unknown or other
  misc_feature (314)..(314): n is a, c, g, or t
tcagcgagagataccacgaccggtgctcgatttagtgtcgtcgcaagagagagggggggggagaggagcccagcactagaagtcggcggtgtttccattcggtgatcagcactgaacacagaggactcacatggaggttgggctgagcgttgggttttcctcgttcgcttacttttaaggaggttgtccaggtgtcagggtgacaacgtgggaggagtcggtggggggagcggtggtccagccgtgggacgtcctgagtctcctccgtagacncgtcctcgtgtccttacctaccttctacttacctatcggcntcgactaccggtcgggtaccccgccgtacgaccgtccggaggggccgggtaggggggtctggggtaggtggggtgtcgtagttttagttacagtactaggtaagtaaggtaaagttagtacgttgtttactttaagttaccacggttaccggtaccgtaggggaaccgggtacccgttacgttccctaacccggttaccaccgaagtaaccgaactacggttacccgtaacggacccaaccgtacgtaccttagtaaacttcgtacctaacgtaaagaccggtaacacgggtaccgtaagtacggaaccgtgtaaccgggaacgtaccgacggttacgtgttagtacgttaacgtggtaagaacgtaagttcttaacgtagtaggtagtaccggtaggtacgggg

SEQ ID NO: 244423 - DNA, 659 bp, Homo sapiens
  misc_feature: GYAE6OF02FK3OA.11.71.G05.1.454.CMB.1.raw
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcaacgtggaggagtcgtgggggaggcgtggtccaggccgtgggacggtccctgacgacttcctcctgtacgacgccctctggtccttccgaccttcctattacctattcggcatgctacgtcgggtcccgccagtcctccgacgggacgacgggggcgtagggtaggtgggtggacgagtttagttcatagtagagtaggaaattgtacgtacttcgtattccgacgtacctccggttaggaacgggccgtacttccgaaccgtccgtaccgtacgacgtaactaactacccgtacgaccaacgtaccgtagtacgtacttctcgtaacaaacgttcgaaagtccgacgtagacgtacggtcgtacgggacgtacgacggttacgtacggtacggttaagttaccgtaggttacggagtaaacgtttagtttaaccgttaggtacggtacggttaaccgggg

SEQ ID NO: 244424 - DNA, 879 bp, Homo sapiens
  misc_feature: GYAE6OF02GISQP.11.71.G05.1.454.CMB.1.raw
tcagcgagagataccacgaccggtgctcgatttagtgtcgtcgcaagagagaggggagaggctgaggaggaggctccaggaggctattccaaggcaggggttccgggccctggggctgaagggcgccgaccctatgcagtgtctggcccctctgctgcacagaagaaaggccttggaggcagaggcaggctagtgaccgagggcccgtgggcaagtcgaggcccacgtcgacgtaggggacggccagtcgcgtggacgcgggcgaggggtcgacggggtcgttcggagggggcgtacgggggacccaaccgaggacgccagtctaggaacgaacgtaggtcgtccgaacgttcggtactaacggaccgaacggaccaacccgaaacgttaaaacgggtccgttacggggaacggtaccgggggaccgtaaaacggtcgggggtactaacggtacggacggtaccccggttacccggtagggtaaccggggtacgggacccgtacccgggtaacgttaccgggaccccgtaacgggtacgggtacccgttacggggaacccgggtacccgaaaacggtaccgttaaagggaacccggtaacggtaacccggtaggtaaacccggtttcggttacggtacggtttacccgtacccgggtaccccgggaccggaaacggtacccgtaaaccgggaagaccccgggtaacgtacccgggttaccgtaccccgggtttaggggaacccccgtttcgggacccccggtaccggacccccccgggtccggtttaacccggtacccgggtacccgggttcggtacccggggttaccggggttccgaccccggttagggaaccccggtacggggaaccgggtaccccg

SEQ ID NO: 244425 - DNA, 820 bp, Homo sapiens
  misc_feature: GYAE6OF02JQ4OW.11.71.G05.1.454.CMB.1.raw
  modified_base (196)..(196): a, c, t, g, unknown or other
  misc_feature (196)..(196): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (293)..(293): a, c, t, g, unknown or other
  misc_feature (293)..(293): n is a, c, g, or t
tcagcgagagataccacgaccggtgctcgatttagtgtcgtcgcaagagagagggggggaggaggagcccagcactagaagtcggcggtgtttccattcggtgatcagcactgaacacagaggactcaccatggagtttgggctgagcttgggttttcctcgttgcttcttttaagaggtgtcctagtgtcaggtncaagtggaggagtcgtgggggagcgtggtccagccgtgggacggtcctgacgctcctcgtgtacgatccgtntggtccttacncctttcattacctntcggccagttcggcctacggtcgggtcccacccgtagtacccgtccgaagggccggagggggtcctaggggtagggttcggggtacgggtccttaaaggtttactttaccgaagtttaccgttaagggacgttaacgggtaaaattaccggttgttaaacctttggttaacttaacgtccggtaaccgtttaccgggaagggttaaccggtacccgtaacgttaacccgtacccggttaccgtaaccgtaacggtaaaccgtaaaccgttaacgtacccggtacgaccgtaccgtaacggtccgttacgtaacgtcttaacggtaaccgttaaacgtaccgaacgtaaccgaccgttagaaaccggtacgttaccgaacggtaaccggtacccgtaacggttcggttaacggttacgtttaaaccggtttagttaccggttaaccgggaacgtttaacggtttaacttacggttaaacggtttaacggggtaaccgggtttaccggtacccggggttttaaccgggg

SEQ ID NO: 244426 - DNA, 818 bp, Homo sapiens
  misc_feature: GYAE6OF02HXQM3.11.71.G05.1.454.CMB.1.raw
  modified_base (181)..(181): a, c, t, g, unknown or other
  misc_feature (181)..(181): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatgggagtttgggctgagcttgggttttcctcgttgcttcttttaagnggtcgtcagtgtcaggtgacaactgggaggagtcggtgggggacgtcgtcggtccacggccgttggggaccgtcccgtgacgacctcctccgtacgtacacgtccttcgtcggtccttccgtaccttctaactttaacctagtcggtactagtcgaccgtaccggtcggggtccccaccgtacgtccgtacccggagggtccgggacgggggtcttaggggtagggttcggggtcggtaccgttaaggttttacttacgtaagttagtacggtaagttaagggtaaaatttcgggtacttaaccgttttaacgttacgttaaccgaacggttacccggttaccgggtaaagggtacccgggtaccctttaccgtttaccccgtaacccggttacctaacggtaacggtaaacgaaccttaaccgttacccggaacggtaccctaaccggtaccgttacttacgtaccttcgtaacgtaactaaacggtacgtaaaccgtaccgtaccgtaaggacgtacggtacggtacggaacgtaccggacggttacggttacgtttagttaaccggttggtacgtaacgggtaacgttaagttaccgttttaacggtaacggttacgggtagggttaacccggg

SEQ ID NO: 244427 - DNA, 785 bp, Homo sapiens
  misc_feature: GYAE6OF02ILVS9.11.71.G05.1.454.CMB.1.raw
  modified_base (150)..(150): a, c, t, g, unknown or other
  misc_feature (150)..(150): n is a, c, g, or t
  modified_base (163)..(163): a, c, t, g, unknown or other
  misc_feature (163)..(163): n is a, c, g, or t
  modified_base (198)..(198): a, c, t, g, unknown or other
  misc_feature (198)..(198): n is a, c, g, or t
  modified_base (652)..(652): a, c, t, g, unknown or other
  misc_feature (652)..(652): n is a, c, g, or t
tcagcgagagataccacgaccggtgctcgatttagtgtcgtcgcaagagagaggggggaggaactgctcagttaggacccagagggaaccatggaagccccagctcagcttcttcttcctcctgctactctggctccagatagcacgganaattgtgtgacanagtctcagtccacctgtctttgtctcgaagggaancgcccacctctcctagccaggcctagtcaggagttagttaacgagtacttaacgttagcccgtaaggtaaccctaaacgaacgtaaaaccgtggtaccccgaacggtaccctaaccccgtacgggtcccttacccgtacgtaattcccttaacgtacggtattacggtacctagttaaccccgaaaaccggtaacggggaccctaccgtaccggtaacccccgaccccgaaacggtacccgtaacgggtttcgaacggttacggtacccgtagggttcggggttacccgtagggggtaacgtacgtaaacgttccgaaacgtttcccaacgtaacgtacgtacgaacgtaccacggtactaacggacgtaccgtagtaggttacgtttcggtaacttagtttacttacgttacgtctacgacgtacggtcgtacgttacgtaccgtacggtacnccgttaacgtaccggtaaccgaaagggacccaagggttactaaggttaaacgttaacggaagtaccggtaggttaacctaccgttaacggaacgtactttaggtacccgttaacgttccctaacgttaccccg

SEQ ID NO: 244428 - DNA, 752 bp, Homo sapiens
  misc_feature: GYAE6OF02G5TGV.11.71.G05.1.454.CMB.1.raw
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagcgtgggttttcctcgttgctcttttaagaggtgtccagtgtcaggtgcaacgtggaggagtcgtgggggaggcgtggtccaggcctgggacgtccctgacgtactcctcctgacngcctntggccttccaccttcacttacctagtcgcatgctacgtcggggtcccaccgaagacctccgagggcgaggggctaggggaggttgggcggctagtttattacgatagtgaagtaggaaattaggttcgtaactttacgtaactttacgaacgttccgttaccggtagggaaccgggtccgtaacgtttcccgaacccgttacgtacccgtaaacgggtaacaaccgttaaacgttcccgtaaacggacctaaccgtaaccgtaccgttacggtacttaccgtacgtaacgtaaaacgttaccggaaacgtacggttacccgtaggtaacggtaaaccggtcggttaaacgggaacccgggtccggtaaccgggttacgttaacgggttaactttaaccggtttaaccgttaggggttaacgtaaccgggtttaaactttaacggttttacgtaaaaccgggtttgggtaacgggttaccggg

SEQ ID NO: 244429 - DNA, 749 bp, Homo sapiens
  misc_feature: GYAE6OF02F969W.11.71.G05.1.454.CMB.1.raw
  modified_base (241)..(241): a, c, t, g, unknown or other
  misc_feature (241)..(241): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaaagacgccaccctctcctgcgagggccagtcagagtgttaacngcttacttagcctaggtaaccaacagaaacctggccaagacctcccaggcctcctcatctatgatcgacatcccgaaacgagggcccacgtcggacccacccccgagacccgtaagggtttccaaggtcggactaggtcggggttcctaggggtaacctagtaccttttcgaaaccttccgtaccaaacccgtacgtccaaggtccgaacgtcccgttaaggaacgtcccggtaaggtaaggtttacgtttttacgacgtttaagttttaactttaccgttacgttaccgaagtccgtaaaggttaccggtttacgtaccggtaacgttaccgggttaaccgttacccggttaaaccccggtttccggaaaccccgggtaaaacgggaccccgtaaagggtaaaccgtttaagggtaaaaacgttaaccgttaacgtaggtaccggtacgtcgaaccctaacgttacttaccgtttcggttaccttacgttacctcccgtttaccccg

SEQ ID NO: 244430 - DNA, 849 bp, Homo sapiens
  misc_feature: GYAE6OF02HK52R.11.71.G05.1.454.CMB.1.raw
tcagcgagagataccacgaccggtgctcgatttagtgtcgtcgcaagagagagggggaactgctcagttaggacccagagggaaccatggaagccccagctcagcttctcttcctcctgctactctggccttcccgagatagcaccggagtaaattgtgttgacacagtctccagccaccctgtctttgtctccgagggaaagcgacccgacccttcgtacctcgaccacgggcctaggtacaggtagttacgttaaactacgtaccgtttaacgttacgaccgttcggtaaacccaaaacgtaacgtaaaaaccgttgggaacccgtaacgtaaccccgttaccccgagggtaccttccctaccgaactttaccttaacgtacgacgttacgactaacctacccgaaacggacggtacccctaacgttccgggaccctaaccccgacggtcccgttaacggttaccgaccggttaggaccgttaggtacggggtacgttacgggtaccgtaaacggttcttaccgtacccttacgttaaacccacgttaacgtacctacggaactaaccccggtacgttaacggaccgttccgtaggtaacgttcgtttttacgacgttttaaagtttacttacgtacgttacgacgtactagtccgttacgtacgtacgttacgtacgttaccgttacccgaccggtaaccgaacggggtaaactaccgggtaacgttaacggttaaaacccgttaaggtaaccggtgggttaaccggtccgttaccgaacccggttacttacggtttaccttcggttttacccgttacgtttacccgtttaccccgttaaccccgg

SEQ ID NO: 244431 - DNA, 832 bp, Homo sapiens
  misc_feature: GYAE6OF02JRBBY.11.71.G05.1.454.CMB.1.raw
tcagcgagagataccacgaccggtgctcgatttagtgtcgtcgcaagagagaggggtctgggagaggagcccagcactagaagtcggcggtgtttccattcggtgatcagcactgaacacagaggactcaccagtggtacgtttgggctgagccgttgggtttttccctcggttgtcctttacgtttttaaaggacggttcgtcccgtaaggttcgtacgtagggttgaccaaacgttgggaacgggacgttccggtggggggacggtcgtcgggtacccgtcggtacccggttggggtacggtcccctagggtaacgtaccttccgttccgttagtaccgtacggtcccttcggttacggtccttttaccctaacccgtttacgtaacctttaacccgttaggttccgggacctaacggttcgtacccggttacgtccggggttccccaccgtacggtacccgttaccggagggccgggagggggttcctggggtaggtcgggtcgtaccgttaagttttacgtctagtagttacgagttaaggaacgttgtcgtacttactagttacgacgtcgtccggaggtacggcgtacttaccgtaaccgtcgtacgtaacgtacgtaacctaacgtccgaacgaccgtaaccgtaccgtacgttacgttacgtacgtacggtaaacctaaaggtaccgtaaagtcggttaaccgagtaaccggtacgttacgaacggtacgggaccgacgggttccgttaggttacgttaacgttacggttaccggtaagtaacgttaaggttaccttaacggtacgttaggttacggtaacggg

SEQ ID NO: 244432 - DNA, 936 bp, Homo sapiens
  misc_feature: GYAE6OF02GVTXY.11.71.G05.1.454.CMB.1.raw
  modified_base (181)..(181): a, c, t, g, unknown or other
  misc_feature (181)..(181): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggaggtttgggctgagtcttgggttttcctcgttgcttcttttaaaggnggttcgtccagtgtcgaggtgacaacgtgggaggtagtcggtgggggggaacggtccggtggtcccaggtccgtaggggacggttcccctggacgtacctcctccgtagtaccacgtcccttcgtggtcctttacctaccctttactaactttaacccttaagtcggacctagttcgaccgtacgtttccggggtccccgaccgtaacgtacccgttacccggtagggccggtaacgggggggttcgtagggggaacgggttgggggtagggtaccgtaacggttttaacttttccgtaaatttaggtacggtaaggttaaagggttaaaaacgttaggtttaacggtaacttttaccgttaactttaccgtaaacggtacccgttacggggtaacgggtaaccggggtaccgtttaaccgttacccggtacccgttacccgttaacccggaaggtaaacccgtaaacgttaaaccgttaccggaaccgggtacctaaccggtaaccggtaccttaacggttaaccgtccttaacgaaccgttaaattaacgaaaccgtaccgtacgttagggaacgtaacggtggtaccgggtaaaccggtaccggtaccgggtacgttaacggttacggtttaacgttacggtttacggtaaacgggtaaacgttaaaccggtttaaacgtttttcggtaaaaccgggttaaaggggtttaaccggggttaacggggtttaacccggggtttaaccggggggg

SEQ ID NO: 244433 - DNA, 578 bp, Homo sapiens
  misc_feature: GYAE6OF02F8G2Z.11.71.G05.1.454.CMB.1.raw
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (382)..(382): a, c, t, g, unknown or other
  misc_feature (382)..(382): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctgagcttgggttttcctcgttgcttcttttaagaggttgtccagtgtcaggtgcaactggaggagtcgtgggggaggcgtggtccagccgtgggacgtccctgacgactctcctgtacagcctcgtggcttccacttcattaccctatcggcatgcacgtgggtcccnccagacctccaggcgagggggctgggagtgggtgctagttnttcatagtgatacggaaatgtagtactttntattcagtactccgaggaacggccgtattccaccgtctacgacgacgaactaacttccgaggccacgacgcttgtactcgtacgacaaatgaaccacgtccagacgagctaggacgaccgacggcttaggtagttaacgttactggtacgtaacgtaagttactttacgtagtacggaggttaggacggtacgggg

SEQ ID NO: 244434 - DNA, 681 bp, Homo sapiens
  misc_feature: GYAE6OF02HV1NT.11.71.G05.1.454.CMB.1.raw
tcagcgagagataccacgaccggtgctcgatttagtgtcgtcgcaagagagaggggggaactgctcagttaggacccagagggaaccatggaagccccagctcagcttctcttcctcctgctactctggcctcccagatagcaccggagaaattgtgttgacacagtctccagcccaccctgtctttgtctaccgaggggaagcgcccaccctctcctgcagggccagtcaggagtagttaacagtccttacttacgccttacggtaaccaacaacgaaacccgtggacccaggtaccctcccgaggtcctacctcactctagtagatgacctactaccgaacgcgggacctacggtcgcccacccgacgccgtacggttacgacggtcggacgtagggttcggggtacgtagggactacggtacttccacctctaccacctatccgacgaccacgtaccgtaacgcgtccgtaggtaacgttagtttacgactttagttttactcgtacgttacacggtctagtaccgtacgtacggttacgtcggtacctccgttacccggttaccgggaaccgtaacgggactaacggtaacgtaacggttaaacgttaacgaccggttggaccgtcgtacgacctaccgtctttaccggttacttcctactccgttacccttacccg

SEQ ID NO: 244435 - DNA, 568 bp, Homo sapiens
  misc_feature: GYAE6OF02G9C8F.11.71.G05.1.454.CMB.1.raw
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagcgccaccctcncctgcagggccagtcagngtgttaacngctacttagcctggtaccaacagaaacctggaccagacctccccaggtcctacctcatcgtatagatgacactacccaaacgcgggaccacgtggacccaccccgaggccaggttccaggtcgactggtcgggctagggacagtacttcacgtctaccacatcgagcagtccagcgcgtaggtaggttactttcggcttacgtttattactgttacagcacgtcgtaatcgatgacctcgtaccgtcgaccgagtaccacgtactaggtaactaacggacgttggtccgtgtcgactaccgattcctgttaccctagtccttacccg

SEQ ID NO: 244436 - DNA, 651 bp, Homo sapiens
  misc_feature: GYAE6OF02GX1JV.11.71.G05.1.454.CMB.1.raw
  modified_base (173)..(173): a, c, t, g, unknown or other
  misc_feature (173)..(173): n is a, c, g, or t
  modified_base (256)..(256): a, c, t, g, unknown or other
  misc_feature (256)..(256): n is a, c, g, or t
  modified_base (311)..(311): a, c, t, g, unknown or other
  misc_feature (311)..(311): n is a, c, g, or t
  modified_base (338)..(338): a, c, t, g, unknown or other
  misc_feature (338)..(338): n is a, c, g, or t
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
  modified_base (485)..(485): a, c, t, g, unknown or other
  misc_feature (485)..(485): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggagtttggctgagctggtttcctgtgctctttaagaggtntccagtgtcaggtgcaacgtgggagagtcgtgggggagcgtggtccagccgtgggacggtccctgacgactcctcctgtaacngtcctgtgccttacaccttcgtattaccgtatcggcatcgctacgttcgggcccncgaagtctccgaggcggacgggggtcngggaggtcggggtgactagtttattcaagttctggatagggaaagttgatactttntacttanacgcttaccggaggaacgggtcctagttccnccggttcacganaacgtactaactccgaggtccacgagtacgtgttactacgntaacgaaactacgaacacgaccgttaggaacgagtacgtagggaaccgaacccggtaggttcctaggtacgtttaacgttaccggttacgttacgggtaacgtttaaagttcgtttttaacgagttaacgggttacggaccggggttaaccggttaacccgggggg

SEQ ID NO: 244437 - DNA, 658 bp, Homo sapiens
  misc_feature: GYAE6OF02GJ112.11.71.G05.1.454.CMB.1.raw
  modified_base (201)..(201): a, c, t, g, unknown or other
  misc_feature (201)..(201): n is a, c, g, or t
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
  modified_base (411)..(411): a, c, t, g, unknown or other
  misc_feature (411)..(411): n is a, c, g, or t
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccgaggggaaanacgcccaccctctcctgcagggccagtcagagtgtaacagctacttgcctggtaaccaanacgaacctggaccagacctcccagcctcctnatctatgatcgacactaccaagacggacctacgcggacccaccccgaggccgtagggttaccaggtcggaccgtagggttcgggtcgtgggaacacgtacttccgacttccactaaccntaccacgccgacgtcctcgacgtaggtctacggtaagtttacgtttcgttacgtttacgtttttaccttcgtactacggtactaagttactaacgtaaccgttccggtaccttaccgttacgtttaccggtttacggacccggtaacgggtaccaaacggtacgtaaacgtaacgtaaccgaaacggtaacgttaggtacgccgtacgtcctaactcttaccgttacgttcttacctaccttccccg

SEQ ID NO: 244438 - DNA, 735 bp, Homo sapiens
  misc_feature: GYAE6OF02I9KG0.11.71.G05.1.454.CMB.1.raw
  modified_base (199)..(199): a, c, t, g, unknown or other
  misc_feature (199)..(199): n is a, c, g, or t
tcagcgagagataccacgaccggtgctcgatttagtgtcgtcgcaagagagaggggggggagaggacgcccagcactagaagtcggcggtgtttccattcggtgatcagcactgaacacagaggactcacagtggagtttggctgagcgttgggttttcctgttgcttacgttttaagaggtcgtccagtgtcgaggtncgaacgtggaggagtcgtggggagcgttggccaggcctgggacgttcctgacgtacctctccgtagtacagccttgtcggtcctttaccgacctttctaactttaaccgtagtcggctaacgtcgacctacggttcgggccccgaccgacgtacccgtaccgacggggcggaacgggggtctaggggtagggtggggtcgtacgttaagttttacgttacgtaataggttagtaagtaggtaaacgttagggtttacgttaacttttctaacgtttacgaacggttaccggttaccggttacgggaacgggtacccttagtttacccgtacccgttacgtacccgaagtaacgaaccgttaacgttaccggaacgactaacccgtacgtaccgtattaaccgttacgtacgacgtaaacgtgaaccgtgtaccgtagtacgacgtggtaacgaacggcgacgtgtacgtagttacgttagtagaacggtacgtaagtttatttacgaagttagggtacgtacggtcggttaccggg

SEQ ID NO: 244439 - DNA, 727 bp, Homo sapiens
  misc_feature: GYAE6OF02IJ356.11.71.G05.1.454.CMB.1.raw
tcagcgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttagacacagtctccagccaccctgttctttagtcctccgaaggggaagacgacccaccctctcctgcagggccagtcagtagtattaacacgtcttactgcctacggaaccaacacgaaaccgtggaccacgacctacccgaggtcctccctcacttctatgatcgacctactaccgaacgacgggtacctacggtaccggaccaccccgagacccgtacgtacgaggtcggacgtacgggtcgggtacgtacgggactaacgtacctttactacttcctaccacctatacgacgtactcgacctaggaccgtacgtaggtaggtttacgttttacgtacgtttaacgttttacgtacgttcggtacacggtactacggttacgttaagtccgtaagttggtaacctccggttacgtaacccgggaacgaaacgggtaaccgtaaccgtaagggtttaaacgtaaacgttaaaccggttacggtacggttaccggaacctacggttaaccaccggtttacggtttaccgttaccgtttacctttaccgtccccgttttccccgtaacccg

SEQ ID NO: 244440 - DNA, 763 bp, Homo sapiens
  misc_feature: GYAE6OF02FJFRS.11.71.G05.1.454.CMB.1.raw
  modified_base (161)..(161): a, c, t, g, unknown or other
  misc_feature (161)..(161): n is a, c, g, or t
  modified_base (178)..(178): a, c, t, g, unknown or other
  misc_feature (178)..(178): n is a, c, g, or t
  modified_base (198)..(198): a, c, t, g, unknown or other
  misc_feature (198)..(198): n is a, c, g, or t
  modified_base (382)..(382): a, c, t, g, unknown or other
  misc_feature (382)..(382): n is a, c, g, or t
  modified_base (486)..(486): a, c, t, g, unknown or other
  misc_feature (486)..(486): n is a, c, g, or t
  modified_base (649)..(649): a, c, t, g, unknown or other
  misc_feature (649)..(649): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctgggtttccncgttgcttcttttaagnggttgtccagtgtctaggtnaccgaacgtgggaggacgttccggtggggggacgcgttcgggtccgaggtcccgttagggggaccgtccccgtaggacgtaccgttccgtccgtgtaccgacgtccctgtcggtccttaccgtaccgttctaacgtttaaccgtgtcggtacctagtaccgaccgtacggttccggggtacccncccggtaacgttacccgtacccgggacggtaccgggaacggggggtcctaaggggtacgggttcggggtccgtacgttaaggtttttcttaccgaagtttaggngtaacggtagggtaaattaggttaccggtactttattacgttaccgaatacccggtccggtaagggaaccggtcctaacgtttcccgaccggtttactcccggaaggtaccgtaactacgtaccgagtaaccactacggtctacgtactcgactaagaacgtnaaccgcgtacgtagacgaggttagacggacgtacgcggttcgtacggttctaacgttcggtacgtaaccggtacggttaacttcgttaagtaacggttacggttagggtaccgg

SEQ ID NO: 244441 - DNA, 662 bp, Homo sapiens
  misc_feature: GYAE6OF02G4FUQ.11.71.G05.1.454.CMB.1.raw
  modified_base (268)..(268): a, c, t, g, unknown or other
  misc_feature (268)..(268): n is a, c, g, or t
tcagcgagagataccacgaccggtgctcgatttagtgtcgtcgcaagagagaggggggggagaggagcccagcactagaagtcggcggtgtttccattcggtgatcagcactgaacacagaggactcaccatggtagtttgggctgagcgttgggttttacctcgttgcttcttttaagaggtgtccagtgtcaggtgcaacgtggaggtagtcgtggggagcgtggtccagccgtgggacgtccctggacacttctcgtagtaccgngcctcgtggtccttacgtaccttctaacttacctatggacatcgacctacgtcggtcccgaccacgaccgtccgaggcggaggggctgggaggttgggcgtcgtagttacttcagtacgtagacgtaagtaacgttagtcgtactttacgtacgttactacggtacccgttaccggaggtaacgggtaccctacgttaccgtccgttccgaccgagtaacgtactaacgttaccgacggtaccaaccgtcgtacgtacgtacgttcgtagaaccaaagtcgaacgtacgcgtaagtacgagtcgtacggagtacggacgtcgtacgttacgttattcgtagtacgtaacgtaaagttcttacgttagaggttacggtacggtacggttaccggg

SEQ ID NO: 244442 - DNA, 791 bp, Homo sapiens
  misc_feature: GYAE6OF02IWJ5F.11.71.G05.1.454.CMB.1.raw
tcagcgagagataccacgaccggtgctcgatttagtgtcgtcgcaagagagaggggggggagaggagcccagcactagaagtcggcggtgtttccattcggtgatcagcactgaacacagaggactcaccatggagtttgggctagagcgttcggttttcctcgttgcttacgttttaagaggtcgtccagtgtcgaggtcgacacgtggacggtaggtcggtaggggggacggtccggttcggtcccgaggtcccggtagggggtaccggttccccgtaggaaccggtcccttccgttacccgttacggtaaccgtccgtcccgttacggttcggttccctttacctaaccccgtttcttaaaccgtttaccgttaacggttcggacctaggttccgaccgttaaccgggttccggggtaccccgtaaccccggtaaccggtaccgtacccgggacgggtacccggggtaaggggggccgttgggggtaacgggttcgggggtagtaccgttaggtttaacttcgaagttacggtagtacgtaagtagttagtcgttacttacgtagtcacgtacgtcgtaacggacgtctacgtaccgtacgtccgtacagactacctacgtcgacgacacacgtcgtactcgttacgtacacgtaacgtcgaaacgtcgtaccgagtaggtacgacgtacgaaccggaccgtagcgttaacgtcgttacgtacggtacgtacgtaacggttacttacggttactacgggtaaggtacggttacggttacgggtaccgg

SEQ ID NO: 244443 - DNA, 912 bp, Homo sapiens
  misc_feature: GYAE6OF02GWNET.11.71.G05.1.454.CMB.1.raw
  modified_base (293)..(293): a, c, t, g, unknown or other
  misc_feature (293)..(293): n is a, c, g, or t
tcagcgagagataccacgaccggtgctcgatttagtgtcgtcgcaagagagaggggggggagaggagcccagcactagaagtcggcggtgtttccattcggtgatcagcactagaacacagagactcaccagtggtagtttgggctgagtcgttgggttttccctgttgtactttacgtttttaaaggacggttcgtcccgtaggttggttacgagggtgaccaagtgggaaggtagttcggtgggggagcgttggccaggtccgtgggacgttccaggacgaccttctccgnggtaccacgtcctgtcggtccttacaccgttcaactttacctagtcggactatcggacctacggttccgggtaccgacctacggaccttacccggagggccggtaacgggggtctaggggtaggttcggggagtccgttaagttttactttacgaagttagttaggacgttaaaggtaaacgttaggttaccgttaaccgttttagttaaaccgttacggtaaccgttaacccggtaccggggtttaaggggaaacccgggttacccgtttaacggtttaccccgtaacccggtttaacccgtacccgggtaaggtaaaccgtaaaaccgtttaacccgtttacccgggaaaccggttacccgaaccggttaaccccggtaggtttaacgtttaacccgggttacctaagggaaacccgttaaaaggttaacccgaaacggttaccgtaacccgttaggtaacgggaccggttaaccgtacggtaaaccggtaaccggcggtttaccgtttaggttacgttaaacggtttacgtaagggttaacccgttaaacggttacgttaagtttaccgttaaaggtaccggtaacgggttacggttaacccggggttaaccgggg

SEQ ID NO: 244444 - DNA, 895 bp, Homo sapiens
  misc_feature: GYAE6OF02FFFZ9.11.71.G05.1.454.CMB.1.raw
  modified_base (254)..(254): a, c, t, g, unknown or other
  misc_feature (254)..(254): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagcccacctgtctttgtcctccgaggggaaagacgccaccctctccgtgcacggggccagtacgagtacgtagttaaacgngtactacgttacgccttacggtaaccaaacgacgaaaacccgtggaccacgaccttaccccgacgggtcccttcccttacacgttacctacgtgaacttgaccgtaactacccaacgaccggggtaccctaacgtaccgggacccaaccccccgtacggtacccccggttaagggttacccgtaaacggtttcggggaccgttaacggggggtttacggggttccggttacgggggaaaccctaacgggttaacccgtttaccctaacccgttacccttacccgaaacccttacgtcccgtaaccggtaccgaccgtaccggttaacggtaaccggtacccggtttaagggtaacgggtttaacggtttttacggacgtttaacggttttttaaccgtttacggtttaccggttaccgtaacggtaccggaacggtttaccggttaacgtaccggttaacggttacgggtaaccgttacccggttacccgggttaaccccgggtaaccgtaaacgggggtaacccgtaaacccgggtaaccgttacgggaaccggttaaaccggtaaaaccggtaaccggttcggtacggtactaccggtaccgaaccctacgttacgttaccgttacctttacgtacccg

SEQ ID NO: 244445 - DNA, 696 bp, Homo sapiens
  misc_feature: GYAE6OF02G8SA3.11.71.G05.1.454.CMB.1.raw
tcagcgagagataccacgaccggtgctcgatttagtgtcgtcgcaagagagagggggggggagaggagcccagcactagaagtcggcggtgtttccattcggtgatcagcactgaacacagaggactcaccatggagtttgggctgagcgttgggttttcctcgttgcttcttttaagaggtgtccagtgtcaggtgacaacgtgggaggtagtcggtggggggaggtcggtggtccaggccgtggggacggtccctggacgtactcctcctgtaccagcctcgtcggtcttcctaccttctacttacctagtcggctatgccacggtacgggtcccaccgacgacctccgagggcggagggggcgtgggtaggtggggtggtcgtagtttacttcgtatagtagtaagtagaaagttgtatacgttatacttacgacgtacgtaccgtagggaacggtaccgtacttccgtaccgtcctaccaggacgtaacgtaacttaccgacgacctacgtaacgtctagtactcgtacgaactaaacgtacgtaaaccgacgtaccgtaaggacgtacgcgtacggaacggtaccgtaacgggtacgtttggtacggttattaaccggttaggtacgggtaagttaaaggttacgtttacgttagtaacggggtagttacggggtaacggttaaccggggg

SEQ ID NO: 244446 - DNA, 737 bp, Homo sapiens
  misc_feature: GYAE6OF02F4ERD.11.71.G05.1.454.CMB.1.raw
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
tcagcgagagataccacgaccggtgctcgatttagtgtcgtcgcaagagagagggggtctgggagaggagcccagcactagaagtcggcggtgtttccattcggtgatcagcactgaacacagaggactcaccatggagtttgggctgagctggggtttttcctcgttgcttcttttaagaggttgtcctagtgtcaggtgcaaacgtggaggagtcgtgggggagcgtggtccagccgtgggagtccctgagactctcctgtacngcctntggcttcacttcattaccatggctatgctacgtcgggtccgccagaccgtaccgagggtccggagggggctaggggaggttcggggtcggacgttaggtttaatttccgaagttaactggaacgtttaaagggtaaattcggtacgttaacgtttacttaacgttaccgaagtaccgttaccgggttaagggtaaccggggtacccgtaagtttacccgtaaacccggttccttaaccgggaacgtaaaccgtacctaaacgtcccgaaggtcccacggtaaccgtccgtaaggttacctacggtacgtaacgtaaacgtacgtaaacgcgtaccgtaagaacgtacgtaccgttagggaacgcggtaaccggtacgtttacggtacggtttacttaacggttacgtaggtaaacccgttaaggtttaaccgtttacgtaacggtaccgggttaggtaacccgggg

SEQ ID NO: 244447 - DNA, 1147 bp, Homo sapiens
  misc_feature: GYAE6OF02IQG0P.11.71.G05.1.454.CMB.1.raw
  modified_base (202)..(202): a, c, t, g, unknown or other
  misc_feature (202)..(202): n is a, c, g, or t
tcagcgagagataccacgaccggtgctcgatttagtgtcgtcgcaagagagaggggggggagaggagcccagcactagaagtcggcggttgtttccattcggtgatcacgcactgaacacaggaggactcaccatggagtttgggctgagtcttgggttttcctcgttgcttcttttaaggaggtgtccagtgtctagggtnactagtggaggtgtcggtgggggacgtcggttcggtccgaggtccgtggggtccggtcccgtggtacgaccttccgttacctcgggtaaccacgtcccttcgtcggtccttacctacccgtttctaacgttttaaccctagtccgggtactacgtacggtacctacccggtttccgggggtacccccgtaccggtaaccgtaccccgtaccccgggtaacggggggtacccgggggaacggggggggttcccggttaggggggtttaaaccgggggggtttcgggggtttaccgggtaccggttttaaacggggttttaacctttttaacctaagggttttaaacggttaacgggttaaacggttttaaaacgggggtaaaaagtttttaccggggtttaacgtttaaccgttttttaccgtttaaacgtttaaccgggtaaacggttaaacccggtttacccggggggtaaacggggtaaacccggggggtttaccccgggttttaaccgtttaacccccggtttaaccccgggtttacccttaaccccgggtaaacggggtaaacggtaaacccgttttaaaaccgggttaaccccgggtaacccggtaaacccgtaaacccggttaacccgtttccggtttaaccgtttacggttaacgttaacccggttaaaagtaaaaccggtaaacggtaaaccggtaacccgttaacccgggtaaggtaaacggtaacccggggtttaaccggtacgggggaaaccgggtaacccgggtacggggttttaccgttaacgggttttaacggtttaacggttttaaaccgggttacgggttttaaacccggaagggttttaaaacgtttaccgttttaacggggttaaacgggttaaccggggtacgggggtttaacccggggtaacccggggttttaaccccggggggg

SEQ ID NO: 244448 - DNA, 753 bp, Homo sapiens
  misc_feature: GYAE6OF02F8SKC.11.71.G05.1.454.CMB.1.raw
  modified_base (152)..(152): a, c, t, g, unknown or other
  misc_feature (152)..(152): n is a, c, g, or t
  modified_base (206)..(206): a, c, t, g, unknown or other
  misc_feature (206)..(206): n is a, c, g, or t
  modified_base (258)..(258): a, c, t, g, unknown or other
  misc_feature (258)..(258): n is a, c, g, or t
tcagcgagagataccacgaccggtgctcgatttagtgtcgtcgcaagagagaggggggaggaactgctcagttaggacccagagggaaccatggaagccccagctcagcttctcttcctcctgctactctcggctcccagatagcaccgganaaattggtgttgaacacagtctccagcccacctgtctttgtctaccgagggaanagccaccctctcctgccgagggcctagtcagagtagttaacagtctacttanccgtacggtaaccaaccgaacgtaaaccgtggaccgagtaacctccccaggcccttccgtaccattcctaatgtagtcgactaccgttaccgaaaccggacggaccctaggtccggacccaacccccgagtaccggacggtttcacggttaccggacggtacgggttcggtaacgtcggggtactacggttaccttacgacctttcgaaccttaccgattaccacgtccaacgtacccgtaacgacggtaccttagggaggtttcttacggtaacgttaacgttttaaccttacgtacgttacgacgtacgtacgttaccggtacgttacgtaaggttccgtaacgttacccgttccccggttaacggttaccggaaccggttaaccgtataaccggttaacggtaaaccgtaacggttaaccgttggtaaccgacggtaccacgtaccggttactttaccgtaccgttttaacttcccgtaccgtttaccccgg

SEQ ID NO: 244449 - DNA, 757 bp, Homo sapiens
  misc_feature: GYAE6OF02FVQ8D.11.71.G05.1.454.CMB.1.raw
  modified_base (295)..(295): a, c, t, g, unknown or other
  misc_feature (295)..(295): n is a, c, g, or t
  modified_base (382)..(382): a, c, t, g, unknown or other
  misc_feature (382)..(382): n is a, c, g, or t
  modified_base (683)..(683): a, c, t, g, unknown or other
  misc_feature (683)..(683): n is a, c, g, or t
tcagcgagagataccacgaccggtgctcgatttagtgtcgtcgcaagagagaggggggggagaggagcccagcactagaagtcggcggtgtttccattcggtgatcagcactgaacacagagactcaccatggagtttgggctgagccttgggttttcctcgttgtcttacgttttaaggaggttgtccagtgtacaggtgcaacgtgggacggagtcgtgggggagtcggtacggtccaggtccgtggggacggtcccctggacgtacttcctcctagtaccgacgtcccgttntcggtacttcctacctttcctaacttaacctagtcggtacattcggcctacggttcggggtacccctacgaacggtaccctaccggnggccgggacgggggtctggggaggttggggtggccgttaggtttactttcgaagtagttacgtaaggtaataaaggttacgttgttactttaccgtatttacccggaaacgtcccgttcggttaacggggaagggtccccggttaacttacccggtaacccgtttccaacccgtaagtaacgtaaccttacccgtaccggaacggtacctacggaccgtcttagtacgtctacgtaactaaagtaacgacgacgtccgagtaaggacgtcggagaacggacgcggttctacgttacggttnttaccgtcggtaggtaacgtaagtttaccgtttacgtaggttaaggtacgggttcgggtaacgggtttcccggg

SEQ ID NO: 244450 - DNA, 675 bp, Homo sapiens
  misc_feature: GYAE6OF02JEL73.11.71.G05.1.454.CMB.1.raw
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
  modified_base (553)..(553): a, c, t, g, unknown or other
  misc_feature (553)..(553): n is a, c, g, or t
  modified_base (569)..(569): a, c, t, g, unknown or other
  misc_feature (569)..(569): n is a, c, g, or t
  modified_base (610)..(610): a, c, t, g, unknown or other
  misc_feature (610)..(610): n is a, c, g, or t
tcagcgagagataccacgaccggtgctcgatttagtgtcgtcgcaagagagagggggggagaggagccagcactagaagtcggcggtgtttccattcggtgatcagcactgaacacagaggactcaccaatggagtttggctgagctgggtttcctcgttagctactttaagaggtgtccagtgtccaggtnacaactgggaagngtcgngggggagcggtggtcccagccgtgggacgtccctggagaccttcncccgttagaccagtcctgtcgaccgttctaacctttcacgtttacctagtcggcctatcgacctacggtcggtccgcaacgtccacgtaggcggtacggggcttcggggaaggtgggtcgtactaagggtttactcgaagtttatacgacggtaaacgtaagttacggttactaccggtttactaagttaccgaacggtacccttccggggtaaggacccggtaccgtacgtttaccgaccgtcgttaaccgagaacgtaacctacgtacgacgcctacgacgtcgtatactacgtanacgtaatacgtacganccgtaacgagacgtcgacggtaacgacgtactggtaacgtnttaaccggttacgtgacgttaaccgtaataccgtttacgagtaggaccgttaggaccgttacggg

SEQ ID NO: 244451 - DNA, 946 bp, Homo sapiens
  misc_feature: GYAE6OF02FK6EH.11.71.G05.1.454.CMB.1.raw
  modified_base (134)..(134): a, c, t, g, unknown or other
  misc_feature (134)..(134): n is a, c, g, or t
tcagcgagagataccacgaccggtgctcgatttagtgtcgtcgcaagagagaggggggggagaggagcccagcactagaagtcggcggtgtttccattcggtgatcagcactgaacacagagactcaccatggnggtttgggctgagcttcgggtttttccctgtttcgcttactttttaaggaggttcgtacctaaggttcgtacgagggttgacaaacgtgggagggtacgttccggtagggggggtacgtcggttgggtccccaagggcccttgggggaccggtcccctggacgtaccctttccgttcccgtagtaccgacgtccccttacggttcggtccctttacccgtacccttttacgtaaacgttttaacccttaggtcgggtaccctaagttccgcccgttaaaccggttcgggggtacccccacccgtaaacggtacccctccgggagggtacccgggaacggggggttccgtaggggtacgggtacgggggttggcctttaaaggttttacccgtctaagttagtagggtaacgttagggtaaaatttacgggttacgtaacccgtttttagtacttacgtaccggtacccggtttacgaacggggtaacgggcccgttaaacgttcccgtacccggtaccgttacccgtaacgaaacggtaaccgttaacccgttaacccgaccgggtaccgtaacccggttaccgtaccgtttacgttaaccgttacgtaacgtaaaccgtaaacgttaacccgaaacgtaaccgttaacgtaccggaagttaaccgacggttaacggaacggtaaccgttaaccgggagtttaaccggtaggtttaagttaccgggttaacgtaaggttaaccgggttaaacgttacggttttaacgtaaccggttagggttaacggtacgggttaaccccggttacggggg

SEQ ID NO: 244452 - DNA, 849 bp, Homo sapiens
  misc_feature: GYAE6OF02IY05Q.11.71.G05.1.454.CMB.1.raw
  modified_base (153)..(153): a, c, t, g, unknown or other
  misc_feature (153)..(153): n is a, c, g, or t
tcagcgagagataccacgaccggtgctcgatttagtgtcgtcgcaagagagaggggggaggaactgctcagttaggacccagacgggaaccataggaagccccagctcagcttctcttcctcctgctactctggctccagatagcaccggaanaaattcgtgttagactacgagtcctccgacgtccctaaccccgttgtttccgttttacgtccgttaccggaaagggggaaaacgtcggtaccccgtaaccccttaccgtaccctcgggaccgaccgggtcctacggttacgaacgttacggttaaccggttaaccgacggtaccctttaacgttaccggtccgttaccggtaaccctaaaccgaacgtaaacccgtccggtaccgaacgtacccctacccgtaacggtcccttacccaccggtacttacctaagtccggtaatcggtaaccctaacgtacccaaacggtaccggaccctacggtaccgccccaacccgacgtcgtaacgttcgaggacgtcgtacggtcgggtacgtacgggaccgttataccgtctactccctaacgtaccgtacctagaacgtcccgtaaagtacccgaggtaccccggtacgtaagggttaccggtttaatttcgaaaccgttttaagtttaccgttaagtcggttaccgacggtacgttacggccgtttaacgtaccgcgttaacgccttaaccggttccgtaaccgggacctaaaggccttaaacggtacgtaaagtaaaacccgttacggaaggtccgtaaacgtctaaccgaccgttactaccgttagttcccgttactaaccttccggttaacccccg

SEQ ID NO: 244453 - DNA, 150 bp, Homo sapiens
  misc_feature: GYAE6OF01BUNE0.18.37.D04.1.454.CMB.1.raw
  modified_base (143)..(150): a, c, t, g, unknown or other
  misc_feature (143)..(150): n is a, c, g, or t
tcagtacgagtatgcacgaccggtgctcgatttagtagcatactgttgggttgggaggatcaaacgaactgtggctgcaccatctgtcttcatcttccgccatctgacatactcgtactgagcgggctggcaaggcgcatagnnnnnnnn

SEQ ID NO: 244454 - DNA, 128 bp, Homo sapiens
  misc_feature: GYAE6OF01A0GZX.18.37.D04.1.454.CMB.1.raw
  modified_base (128)..(128): a, c, t, g, unknown or other
  misc_feature (128)..(128): n is a, c, g, or t
tcagtacgagtatgcacgaccggtgctcgatttagtagcatactgttgggttggcacagcggccctgggctgcctggtcaaggactacttcccatactcgtactgagcgggctggcaaggcgcatagn

SEQ ID NO: 244455 - DNA, 145 bp, Homo sapiens
  misc_feature: GYAE6OF01E0D74.18.37.D04.1.454.CMB.1.raw
  modified_base (145)..(145): a, c, t, g, unknown or other
  misc_feature (145)..(145): n is a, c, g, or t
tcagtacgagtatgcacgaccggtgctcgatttagtagcatactgttgggtttggggagatcaaacgaactgtggctgcaccatctgtcttcatcttcccgccatctgacatactcgtactgagcgggctggcaaggcgcatagn

SEQ ID NO: 244456 - DNA, 130 bp, Homo sapiens
  misc_feature: GYAE6OF01B1Y4N.18.37.D04.1.454.CMB.1.raw
  modified_base (130)..(130): a, c, t, g, unknown or other
  misc_feature (130)..(130): n is a, c, g, or t
tcagtacgagtatgcacgaccggtgctcgatttagtagcatactgttgggtttgggcacagcggccctgggctgcctggtcaaggactacttcccatactcgtactgagcgggctggcaaggcgcatagn

SEQ ID NO: 244457 - DNA, 130 bp, Homo sapiens; identical to SEQ ID NO: 244456
  misc_feature: GYAE6OF01CCJQS.18.37.D04.1.454.CMB.1.raw
  modified_base (130)..(130): a, c, t, g, unknown or other
  misc_feature (130)..(130): n is a, c, g, or t

SEQ ID NO: 244458 - DNA, 133 bp, Homo sapiens
  misc_feature: GYAE6OF01A5M1V.18.37.D04.1.454.CMB.1.raw
  modified_base (131)..(133): a, c, t, g, unknown or other
  misc_feature (131)..(133): n is a, c, g, or t
tcagtacgagtatgcacgaccggtgctcgatttagtagcatactgttgggtttgggcgacagcggccctgggctgcctggtcaaggactacttcccatactcgtactgagcgggctggcaaggcgcatagnnn

SEQ ID NO: 244459 - DNA, 174 bp, Homo sapiens
  misc_feature: GYAE6OF01CI9BD.18.37.D04.1.454.CMB.1.raw
  modified_base (149)..(174): a, c, t, g, unknown or other
  misc_feature (149)..(174): n is a, c, g, or t
tcagtacgagtatgcacgaccggtgctcgatttagtagcatactggttgggtttgggggagatcaaacgaactgtggctggcaccatctgtcttcatcttcccgccatctcgacatactcgtactgagcgggctggcaaggcgcatagnnnnnnnnnnnnnnnnnnnnnnnnnn

SEQ ID NO: 244460 - DNA, 132 bp, Homo sapiens
  misc_feature: GYAE6OF01BI8SD.18.37.D04.1.454.CMB.1.raw
  modified_base (130)..(132): a, c, t, g, unknown or other
  misc_feature (130)..(132): n is a, c, g, or t
tcagtacgagtatgcacgaccggtgctcgatttagtagcatactgttgggtttgggcacagcggccctgggctgcctggtcaaggactacttcccatactcgtactgagcgggctggcaaggcgcatagnnn

SEQ ID NO: 244461 - DNA, 146 bp, Homo sapiens
  misc_feature: GYAE6OF01D2FIZ.18.37.D04.1.454.CMB.1.raw
  modified_base (145)..(146): a, c, t, g, unknown or other
  misc_feature (145)..(146): n is a, c, g, or t
tcagtacgagtatgcacgaccggtgctcgatttagtagcatactgttgggtttggggagatcaaacgaactgtggctgcaccatctgtcttcatcttcccgccatctgacatactcgtactgagcgggctggcaaggcgcatagnn

SEQ ID NO: 244462 - DNA, 131 bp, Homo sapiens
  misc_feature: GYAE6OF01EA867.18.37.D04.1.454.CMB.1.raw
  modified_base (130)..(131): a, c, t, g, unknown or other
  misc_feature (130)..(131): n is a, c, g, or t
tcagtacgagtatgcacgaccggtgctcgatttagtagcatactgttgggtttgggcacagcggccctgggctgcctggtcaaggactacttcccatactcgtactgagcgggctggcaaggcgcatagnn

SEQ ID NO: 244463 - DNA, 145 bp, Homo sapiens
  misc_feature: GYAE6OF01BGONX.18.37.D04.1.454.CMB.1.raw
tcagtacgagtatgcacgaccggtgctcgatttagtagcatactgttgggtttgggggagatcaaacgaactgtggctgcaccatctgtcttcatcttcccgccatctgacatactcgtactgagcgggctggcaaggcgcatag

SEQ ID NO: 244464 - DNA, 174 bp, Homo sapiens
  misc_feature: GYAE6OF01DXO1Y.18.37.D04.1.454.CMB.1.raw
  modified_base (150)..(174): a, c, t, g, unknown or other
  misc_feature (150)..(174): n is a, c, g, or t
tcagtacgagtatgcacgaccggtgctcgatttagtagcatactgttgggtttgggggagtagtcaaacgaactgtggctgcaccatctgtcttcactcttcccgccatcttgacatactcgtactgagcgggctggcaaggcgcatagnnnnnnnnnnnnnnnnnnnnnnnnn

SEQ ID NO: 244465 - DNA, 147 bp, Homo sapiens
  misc_feature: GYAE6OF01E1BL3.18.37.D04.1.454.CMB.1.raw
  modified_base (140)..(140): a, c, t, g, unknown or other
  misc_feature (140)..(140): n is a, c, g, or t
  modified_base (146)..(147): a, c, t, g, unknown or other
  misc_feature (146)..(147): n is a, c, g, or t
tcagtacgagtatgcacgaccggtgctcgatttagtagcatactgttgggtttgggggagatcaaacgaactgtggctgcaccatctgtcttcatcttcccgccatctgacatactcgtactgagcgggctggcaaggcncatagnn

SEQ ID NO: 244466 - DNA, 143 bp, Homo sapiens
  misc_feature: GYAE6OF01B7KCR.18.37.D04.1.454.CMB.1.raw
  modified_base (125)..(125): a, c, t, g, unknown or other
  misc_feature (125)..(125): n is a, c, g, or t
  modified_base (131)..(143): a, c, t, g, unknown or other
  misc_feature (131)..(143): n is a, c, g, or t
tcagtacgagtatgcacgaccggtgctcgatttagtagcatactggttgggtttgggcacagcggccctgggctgcctggtcaaggactacttcccatactcgtactgagcgggctggcaaggcncatagnnnnnnnnnnnnn

SEQ ID NO: 244467 - DNA, 143 bp, Homo sapiens
  misc_feature: GYAE6OF02G87WU.18.37.D04.1.454.CMB.1.raw
  modified_base (142)..(143): a, c, t, g, unknown or other
  misc_feature (142)..(143): n is a, c, g, or t
tcagtacgagtatgcacgaccggtgctcgatttagtagcatactgttgggttgggagatcaacgaactgtggctgcaccatctgtcttcatcttcccgccatctgacatactcgtactgagcgggctggcaaggcgcatagnn

SEQ ID NO: 244468 - DNA, 130 bp, Homo sapiens; identical to SEQ ID NO: 244456
  misc_feature: GYAE6OF02I64AO.18.37.D04.1.454.CMB.1.raw
  modified_base (130)..(130): a, c, t, g, unknown or other
  misc_feature (130)..(130): n is a, c, g, or t

SEQ ID NO: 244469 - DNA, 130 bp, Homo sapiens
  misc_feature: GYAE6OF02HMN5F.18.37.D04.1.454.CMB.1.raw
  modified_base (130)..(130): a, c, t, g, unknown or other
  misc_feature (130)..(130): n is a, c, g, or t
tcagtacgagtatgcacgaccggtgctcgatttagtagcatactgtttggtttggccacagcggccctgggctgcctggtcaaggactacttcccatactcgtactgagcgggctggcaaggcgcatagn

SEQ ID NO: 244470 - DNA, 130 bp, Homo sapiens; identical to SEQ ID NO: 244456
  misc_feature: GYAE6OF02GDAMR.18.37.D04.1.454.CMB.1.raw
  modified_base (130)..(130): a, c, t, g, unknown or other
  misc_feature (130)..(130): n is a, c, g, or t

SEQ ID NO: 244471 - DNA, 130 bp, Homo sapiens; identical to SEQ ID NO: 244456
  misc_feature: GYAE6OF02H98B9.18.37.D04.1.454.CMB.1.raw
  modified_base (130)..(130): a, c, t, g, unknown or other
  misc_feature (130)..(130): n is a, c, g, or t

SEQ ID NO: 244472 - DNA, 145 bp, Homo sapiens; identical to SEQ ID NO: 244455
  misc_feature: GYAE6OF02I2PT6.18.37.D04.1.454.CMB.1.raw
  modified_base (145)..(145): a, c, t, g, unknown or other
  misc_feature (145)..(145): n is a, c, g, or t

SEQ ID NO: 244473 - DNA, 130 bp, Homo sapiens; identical to SEQ ID NO: 244456
  misc_feature: GYAE6OF02HGKCK.18.37.D04.1.454.CMB.1.raw
  modified_base (130)..(130): a, c, t, g, unknown or other
  misc_feature (130)..(130): n is a, c, g, or t

SEQ ID NO: 244474 - DNA, 146 bp, Homo sapiens
  misc_feature: GYAE6OF02IU6NU.18.37.D04.1.454.CMB.1.raw
  modified_base (146)..(146): a, c, t, g, unknown or other
  misc_feature (146)..(146): n is a, c, g, or t
tcagtacgagtatgcacgaccggtgctcgatttagtagcatactgttgggtttgggggagatcaaacgaactgtggctgcaccatctgtcttcatcttcccgccatctgacatactcgtactgagcgggctggcaaggcgcatagn

SEQ ID NO: 244475 - DNA, 145 bp, Homo sapiens; identical to SEQ ID NO: 244455
  misc_feature: GYAE6OF02FU2V0.18.37.D04.1.454.CMB.1.raw
  modified_base (145)..(145): a, c, t, g, unknown or other
  misc_feature (145)..(145): n is a, c, g, or t

SEQ ID NO: 244476 - DNA, 145 bp, Homo sapiens
  misc_feature: GYAE6OF02FKX11.18.37.D04.1.454.CMB.1.raw
  modified_base (145)..(145): a, c, t, g, unknown or other
  misc_feature (145)..(145): n is a, c, g, or t
tcagtacgagtatgcacgaccggtgctcgatttagtagcatactgttgggtttgggggagatcaaacgaactgtggctgcaccatctgtcttcatcttccgccatctgacatactcgtactgagcgggctggcaaggcgcatagn

SEQ ID NO: 244477 - DNA, 147 bp, Homo sapiens
  misc_feature: GYAE6OF02F0KIR.18.37.D04.1.454.CMB.1.raw
  modified_base (146)..(147): a, c, t, g, unknown or other
  misc_feature (146)..(147): n is a, c, g, or t
tcagtacgagtatgcacgaccggtgctcgatttagtagcatactgttgggtttgggggagatcaaacgaactgtggctgcaccatctgtcttcatcttcccgccatctgacatactcgtactgagcgggctggcaaggcgcatagnn

SEQ ID NO: 244478 - DNA, 146 bp, Homo sapiens; identical to SEQ ID NO: 244474
  misc_feature: GYAE6OF02GONCC.18.37.D04.1.454.CMB.1.raw
  modified_base (146)..(146): a, c, t, g, unknown or other
  misc_feature (146)..(146): n is a, c, g, or t

SEQ ID NO: 244479 - DNA, 148 bp, Homo sapiens
  misc_feature: GYAE6OF02FQ7RL.18.37.D04.1.454.CMB.1.raw
  modified_base (146)..(148): a, c, t, g, unknown or other
  misc_feature (146)..(148): n is a, c, g, or t
tcagtacgagtatgcacgaccggtgctcgatttagtagcatactgttgggtttgggggagatcaaacgaactgtggctgcaccatctgtcttcatcttcccgccatctgacatactcgtactgagcgggctggcaaggcgcatagnnn

SEQ ID NO: 244480 - DNA, 147 bp, Homo sapiens; identical to SEQ ID NO: 244477
  misc_feature: GYAE6OF02GI2WS.18.37.D04.1.454.CMB.1.raw
  modified_base (146)..(147): a, c, t, g, unknown or other
  misc_feature (146)..(147): n is a, c, g, or t

SEQ ID NO: 244481 - DNA, 637 bp, Homo sapiens
  misc_feature: GYAE6OF01ECQBT.44.45.E01.1.454.CMB.1.raw
  modified_base (298)..(298): a, c, t, g, unknown or other
  misc_feature (298)..(298): n is a, c, g, or t
tcagacagtatatacacgaccggtgctcgatttagtgagtcagtaagggaaagggatcaggacttctcagttcatcttctcaccatgaggctccctgctcagctcctggggctgctaatgctctggatccctggacccagtgcagatgttgtgctgacccagactcccctctctctgtccgtcacccctggacagccggcctccatgtcctgcaagtctagtcagagcctcctgcatagtgatggaaagacatatttgtactggtacctgcagaggtcaggccagtctccgcagctcncatctatgtatttcttacaagtccgcccttcttccgtgggacgttcgaccctaagtattagggttccaggttgggccgaggccggggtacgggactaggtactttccgaacgtactagaaaactcgaaggtccgggtaggacggcgtaggaaggtagttaggtttaggtaaattttagttaacgtgtacctaagttcgaccgtaaggtcgtacgttacgtaccggtttaccccgggttacccgttacccgggttacccgggaaaccgggtaaaccgggtaaccgggtaacggggtaaacgtaaccgtaaacggtaacggtaaccggtaacggttacggg

SEQ ID NO: 244482 - DNA, 516 bp, Homo sapiens
  misc_feature: GYAE6OF01DAB5F.44.45.E01.1.454.CMB.1.raw
  modified_base (173)..(173): a, c, t, g, unknown or other
  misc_feature (173)..(173): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatcccctggacccagtgcagatgttgtgctgacccagactcccctntctctgtccgtcacccctggacagccggcctccatgtcctgcaagtctagtcagagcctcctgcatagtgatggaaagacatatttgtactggtacctgcagaggtcaggccagtctccgcagcctcctcatctatgattctttcaagcgcctctctggatgccagtataggttcaggtggcaggcggggtcgggacagatttcacaactagaaatcgagccgggtgagctgaggatgttaggaatttatactgcatgacgaaggctattcctaggtttccccggacctttccgggaccgtaaagggaccctaagggtcgaaatacgaagacgagtggtacgg

SEQ ID NO: 244483 - DNA, 401 bp, Homo sapiens
  misc_feature: GYAE6OF01EHYBO.44.45.E01.1.454.CMB.1.raw
  modified_base (396)..(401): a, c, t, g, unknown or other
  misc_feature (396)..(401): n is a, c, g, or t
tcagacagtatatacacgaccggtgctcgatttagtgagtcagtaagggaaagggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttcccctggcgccctgctccaggagcacctccgagagcacagcggccctgggctgcctggtcaaggctacttcctatatactgtctgagcgggctggcaaggcgcatagnnnnnn

SEQ ID NO: 244484 - DNA, 403 bp, Homo sapiens
  misc_feature: GYAE6OF01DRPMC.44.45.E01.1.454.CMB.1.raw
  modified_base (241)..(241): a, c, t, g, unknown or other
  misc_feature (241)..(241): n is a, c, g, or t
  modified_base (395)..(403): a, c, t, g, unknown or other
  misc_feature (395)..(403): n is a, c, g, or t
tcagacagtatatacacgaccggtgctcgatttagtgagtcagtaagggaaagggctggagtgggtggcagtcatctggtctgatggaagtaagaatactatggaaactccgtgaagggccgattctccgtctccagagacaattccaagaacaccgtgtatctacaaatgaacaatttgagagccgaggactcggctctctattattgtacgagcccatcgttctactggggccaggganccctggtcaccgtctcctcagcctccaccaaggcccatcggtcttcccctggcgccctgctccaggagcacctccgagagcacagccggccctgggctgcctggtcaaggctacttccacgtctactgctgagcgggctggcaaggcgcatagnnnnnnnnn

SEQ ID NO: 244485 - DNA, 425 bp, Homo sapiens
  misc_feature: GYAE6OF01DIGSU.44.45.E01.1.454.CMB.1.raw
  modified_base (246)..(246): a, c, t, g, unknown or other
  misc_feature (246)..(246): n is a, c, g, or t
  modified_base (413)..(413): a, c, t, g, unknown or other
  misc_feature (413)..(413): n is a, c, g, or t
  modified_base (416)..(425): a, c, t, g, unknown or other
  misc_feature (416)..(425): n is a, c, g, or t
tcagacagtatatacacgaccggtgctcgatttagtgagtcagtaagggaaaggggcgtggagttgggtggcagtcatctggtctgatggaagtaaagaatactatggaaactccgtgaaggccgattctccgtctccagagacaattccaagaacaccgtgtatactacaaactgaacaatttgagagccgaggactcggctctctattatgtacgagcccatcgttctacgtggggccaggganccctggtccaccgtctccctcacgcctccaccaagggcccatccggtcttccccctggccgcccctgcctccaggacgcacctcgagacgcacgagcggccctgggctgcctggtcaaggacctactccgacgtctactgctgacgcggctggcaaggcgacatagncgnnnnnnnnnn

SEQ ID NO: 244486 - DNA, 576 bp, Homo sapiens
  misc_feature: GYAE6OF01AD3ZY.44.45.E01.1.454.CMB.1.raw
  modified_base (173)..(173): a, c, t, g, unknown or other
  misc_feature (173)..(173): n is a, c, g, or t
  modified_base (303)..(303): a, c, t, g, unknown or other
  misc_feature (303)..(303): n is a, c, g, or t
tcagacagtatatacacgaccggtgctcgatttagtgagtcagtaagggaaaggggagtcaggacttctcagttcatcttctcaccatgaggctccctgctcagctcctggggctgctaatgctctggatccctggacccagtgcagatgttgtgctgacccagactcccctntctctgtccgtcacccctggacagccggcctccatgtcctgcaagtctagtcagacgcctcctgcatagtgatggaaagacatatttgtactggtacctgcagaggtcaggccagtctccgcagctcctnatctatgattctttcaagcgcctctctggatgccagataggttcaggtggcaggcgggtcgggacagtatttcacacgtagaaaactcgacggtccgggtggaggcgtaggaggtagttaggttaggtaaattttacgttaacgttgtactagtggacgaagggtctacgtttaccgtaccggtttacccccggtaccgtttaccgggaccgtaacggggacccgtaaggggtacggtaaacgttacgaaaggccgtaaacgttggtaccggg

SEQ ID NO: 244487 - DNA, 540 bp, Homo sapiens
  misc_feature: GYAE6OF01COQAT.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctgggctgctaatgctctggatccctggacccagtgcagatgttgtgctgacccagactcccctctctctgtccgtcacccctggacagccggcctccatgtcctgcaagtctagtcagagcctcctgcatagtgatggaaagacatatttgtactggtacctgcagaggtcaggccagtctccgcagctcctcatctatgattcttcaagcgcctctctggatgaccagtataggttcagtggcgaggcgggtcgggacagtatttcacactagaaatcgaaggccgggtggacggcgtaggaggattggttaggtaattttagttacgtgactagtgacaaggctagttccgtacggtttcccccggaccttcgggacccgtaaaggggaccctaggggtacgaaacgtacgaaaggccgtaagtggtacgg

SEQ ID NO: 244488 - DNA, 556 bp, Homo sapiens
  misc_feature: GYAE6OF01COVYU.44.45.E01.1.454.CMB.1.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
tcagacagtatatacacgaccggtgctcgatttagtgagtcagtaagggaaaggggatcaggacttctcagttcatcttctcaccatgaggctccctgctcagctcctgggctgctaatgctctggatccctggacccagtgcagatgttgtgctgacccagacctcccctctctctgtccgtcacccctggacngcccgcctccatcgtcctgcaagtctagtcagacgcctcctgcatagtgataggaaanacattatttgtactggtacctgcagaggtcaggccagtctcgcagcctcctnatctatgatttcttcaacgcgtcctctctggatcgaccagtataggttcaggtggcagggcgggtcgggacagtattcactataagaaatcgaggccgggtaggaggcgtaggaggtattggttagtaattttagtacgtgactagttagacgaaggtctagttccgtacggtttcccccggaaccgtttcggacccgaaaggggtacccgaaggggttagaaacgttacgaaggccgtaaagtggtacgg

SEQ ID NO: 244489 - DNA, 407 bp, Homo sapiens
  misc_feature: GYAE6OF01BWE67.44.45.E01.1.454.CMB.1.raw
  modified_base (313)..(313): a, c, t, g, unknown or other
  misc_feature (313)..(313): n is a, c, g, or t
  modified_base (401)..(407): a, c, t, g, unknown or other
  misc_feature (401)..(407): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctacgtggggccagggacgccctggtccaccgtctcctcagcctccaccaaggcccatcggtcttcccctggcgccctgctccaggngccacctccgagagcacagccggccctgggctgcctggtcaaggactacttcctatatactgtctgagcggctggcaaggcgcatagnnnnnnn

SEQ ID NO: 244490 - DNA, 409 bp, Homo sapiens
  misc_feature: GYAE6OF01D2BTK.44.45.E01.1.454.CMB.1.raw
  modified_base (402)..(409): a, c, t, g, unknown or other
  misc_feature (402)..(409): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttcccctggccgccctgcctccaggacgcacctccgagacgcacagtcggccctgggctgcctggtcaaggctacttcctatatactgtctgagcgggctggcaaggcgcatagnnnnnnnn

SEQ ID NO: 244491 - DNA, 401 bp, Homo sapiens
  misc_feature: GYAE6OF01ERFJT.44.45.E01.1.454.CMB.1.raw
  modified_base (398)..(401): a, c, t, g, unknown or other
  misc_feature (398)..(401): n is a, c, g, or t
tcagacagtatatacacgaccggtgctcgatttagtgagtcagtaagggaaaggggttggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggacgccctggtcaccgtctcctcacgcctccaccaagggcccatcggtcttcccctggcgccctgctccaggagcacctccgagagcacagcggccctgggctgcctggtcaaggctactcctatatactgtctgagcgggctggcaaggcgcatagnnnn

SEQ ID NO: 244492 - DNA, 403 bp, Homo sapiens
  misc_feature: GYAE6OF01D6CSF.44.45.E01.1.454.CMB.1.raw
  modified_base (398)..(403): a, c, t, g, unknown or other
  misc_feature (398)..(403): n is a, c, g, or t
tcagacagtatatacacgaccggtgctcgatttagtgagtcagtaagggaaagggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagcccctggtcaccgtctcctcagcctccaccaagggcccatcggtcttcccctggcgcccctgcctccaggagccacctccgagagcacagcggccctgggctgcctggtcaaggctacttcatatactgtctgagcgggctggcaaggcgcatagnnnnnn

SEQ ID NO: 244493 - DNA, 407 bp, Homo sapiens
  misc_feature: GYAE6OF01EFB5B.44.45.E01.1.454.CMB.1.raw
  modified_base (394)..(394): a, c, t, g, unknown or other
  misc_feature (394)..(394): n is a, c, g, or t
  modified_base (400)..(407): a, c, t, g, unknown or other
  misc_feature (400)..(407): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttcccctggcgccctgctccaggacgcaccgtccgagagcacagcggccctgggctgcctggtcaaggactacttcctatatactgtctgagcgggctggcaaggcncatagnnnnnnnn

SEQ ID NO: 244494 - DNA, 520 bp, Homo sapiens
  misc_feature: GYAE6OF01B2L5L.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggacagccggcctccatgtcctgcaagtctagtcagagcctcctgcatagtgatggaaagacatatttgtactggtacctgcagaggtcaggccagtctccgcagctcctcatctatgattctttcaagcgctctctggagtgccagataggttcagtggcaggcgggtcgggacagatttcacactagaaaatcgaggcgggtggacggcgtaggaggtagtggttaggtaatttagttacgtgctatgacgaaggctattcacgtttccccggacgttcggccgacgggaccgagggtaggtaacgtacgaagcgtaagtggtacgg

SEQ ID NO: 244495 - DNA, 699 bp, Homo sapiens
  misc_feature: GYAE6OF01DUY93.44.45.E01.1.454.CMB.1.raw
  modified_base (306)..(306): a, c, t, g, unknown or other
  misc_feature (306)..(306): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatcccctggacccagtgcagatgttgtgctgacccagacctcccctctctctgtccgtcacccatggacagccggcctccatcgtcctgcaagtctagtcagagcctcctgcatagtgataggaaagactattatttgtactggtacctgcagagtcaggccagtctccgcagctcctnatctatcgtatttctttacaagccgtccctctcgtaggacgtcgcccgtagtacgttacgggtttccagggttcgggacgtacgggtccgggggttaccgggggactaagggttactttcgaaaccgtacgttaagaaaacttcggaacgggtccggggtaggacgggtcgtagggaagggtagtttagggtttagggtaaatttttacgttaacgttcgtacgtaagttacggacgtaaacgggtccttaaccgtttaccggtaacccggtttttaccccccgggaaccccggttttacccggggaccccggtaaaacgggggtaaccccggtaaacgggggttaacgggtaaaaccgtacggtaaacgggtaaccgtaaccggttacgggg

SEQ ID NO: 244496 - DNA, 577 bp, Homo sapiens
  misc_feature: GYAE6OF01ESEZY.44.45.E01.1.454.CMB.1.raw
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggacagccggcctccatgtcctgcaagtctagtcagagcctcctgcatagtgatggaaaagacattatttgtactggtacctgcagaggtcaggccagtctccgcngctcctnatctatgtattcttacaagtccgccttctcgtggagtcgcctagtattaggttcaggtggcgagggcggggtacgggactagtatttcaacgtactagaaactcgaggccgggtaaggacggcgtggaggtatggttaggtaatttagttacgtgactagtcgacgtaaggtctagtttccgtaaccggttttcccccggtacttaccgggaccgtaacggggtaccggtaaggggtaacggtaaacgtacgaaaggaccgtaagtcggtcgg

SEQ ID NO: 244497 - DNA, 815 bp, Homo sapiens
  misc_feature: GYAE6OF01DGEY8.44.45.E01.1.454.CMB.1.raw
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagacagtatatacacgaccggtgctcgatttagtgagtcagtaagggaaaggggactacaggacttctccagttcatctcctcaccatgaggcctccctgctcagctcgtggggctgtcttaagtgctcgtggatcccctggacccagtcgcagagtgtgtgctgacccagcctccccgtctcgtcgtcgtccgtaccacccccgtgggaccacggcccggtcctacgtactcggtaccctggacctaagtccgtagtccaaggtcnccctccgtgacctaagttaggtagtagtagggaaaanacctattacggtttcgaacgtacgggtcctggcgtaaggtacggtcgaacgggtcctaacgtcccgacccggntaacggccttacccgtanaacttaacctaaagttcgtaaacttttccgttaaccgaaggtcccggtacccttcgtacggttacggaaccgttacgacccgtaaagtacgtttaacgggtccgaaggtacgggtaccgtaagggtccggggttaacgggacgtaacgtacgtttacgaacgtaacgtaagtaaaaccgtcggaacggtaccgggtaggaacggtacgtaggaggtagttaggtttaggttaatttacgtaccgttagactaggttacgaaccggtaagtacgttaaccgtttacccggtaacccggtttacccccggtaccggttaccggtaacccccgggtaaacggggtaacccgggtaaacgggttaacccgggtaaaaacggttacgaaaccgggtacccgttaaacggtcggttacccgggg

SEQ ID NO: 244498 - DNA, 565 bp, Homo sapiens
  misc_feature: GYAE6OF01E46O4.44.45.E01.1.454.CMB.1.raw
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (482)..(483): a, c, t, g, unknown or other
  misc_feature (482)..(483): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (523)..(523): a, c, t, g, unknown or other
  misc_feature (523)..(523): n is a, c, g, or t
  modified_base (556)..(556): a, c, t, g, unknown or other
  misc_feature (556)..(556): n is a, c, g, or t
tcagacagtatatacacgaccggtgctcgattttagtgagtcagtaagggaaagggcgtggaagtgggtggcgagtcgatctggtactgagtggaagtaaagaatacctagtggaaactccgttgaagggccgtattctccgtctccagagactaattccaagacaccgtgtatctacaaatgaacaactttgagagccgaggacctcggctcgtctattattggtacgagcccgatcgttctacgtgggccaggganccctggtccacgtcttccncagcctacaccaaggccctattcggtccttccccgtggccgccctgacctccgaggacgcctaccctcgagagccacgtagccggccctagggcctacgcccgtcggtacaacggtactacgtccgacgtcgtacgtgcgtgacgcggtctcggcaaggccacgagtaggcagctgacgtgngangngtgtcgtcgtagtgtcgnngtntntatntctcgactcgtagtcgacgacgacgacgagngacgtagacgtcgacgtagtacgtcgtacgacnctcgtgtcg

SEQ ID NO: 244499 - DNA, 688 bp, Homo sapiens
  misc_feature: GYAE6OF01CV49R.44.45.E01.1.454.CMB.1.raw
tcagacagtatatacacgaccggtgctcgatttagtgagtcagtaagggaaagggatcaggacttctcagttcatcttctcaccatgaggctccctgctcagctcctgggctgctaatgctctggatccctggacccagtgcagatgttgtgctgacccagacctcccctctctctcgtccgtcacccctggacagccggctccatgtcctgcaagtctagtcagacgcctcctgcatagtgatggaaagactattatttgactggtacctgctagaggtcaggccagtcctcgcagcctcctcattctaatcgtactttctttacgaacgccgtcccttcgtacgtcgggaacgttcgacccgtaagtaacgttacggggtttccaaggttcgggaccgacgggtcggggtacggggacctaggtactttaccgaacgtaacgtaggaaaaacgtcggtaacgggccggggttaggaacgggtccgtagggtaagggtagtttggggtttaaaggtaagtttttaacgttaacgttgaccttaagttacggtaccgaaaagggttccgtaagttaccggttaaccggtttcccccggtaacccgttaccggggtaccccgaaacggggtaccccggtaaggggtacggtaaaacgtaccggaaaggcccggtaaagtcggttacggg

SEQ ID NO: 244500 - DNA, 571 bp, Homo sapiens
  misc_feature: GYAE6OF01ATMXP.44.45.E01.1.454.CMB.1.raw
  modified_base (171)..(171): a, c, t, g, unknown or other
  misc_feature (171)..(171): n is a, c, g, or t
tcagacagtatatacacgaccggtgctcgatttagtgagtcagtaagggaaagggatcaggacttctcagttcatcttctcaccatgaggctccctgctcagctcctgggctgctaatgctctggatccctggacccagtgcagatgttgtgctgacccagacctcccctntctctgtccgtcacccctggacagccggcctccatgtcctgcaagtctagtcagagcctctgcatagtgatggaaagacattatttgtactggtacctgcagaggtcaggccagtctcgcagctcctcatctatgatttctttcaagtcgcctctcgtggacgtgccagattaggttcaggttggacaggcggggtcgggactaggtatttcacgtacgtagaaaactcgaggccgggtggaggcgtaggaggattggttaggtaattttagttacgtgtactagttggactaaggtctagtttccgtaccggtttcccccggaccgtttaccgggacccgaaacggggtacccgaaggggttacggaaacgttacgaaggacgtaaacgttggtacggg

SEQ ID NO: 244501 - DNA, 647 bp, Homo sapiens
  misc_feature: GYAE6OF01D5ZF3.44.45.E01.1.454.CMB.1.raw
  modified_base (255)..(255): a, c, t, g, unknown or other
  misc_feature (255)..(255): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctcgtccgtccaccctggacacgcccggcctccatcgtcctgcaagtctagtcagcgcctctgcatagtgataggaaanactattatttgtactggtacctgacaggaggtcaggcctacgtccgtccgcacgcctcctacattctaattcgtaactttccttacgaacgtccgtaccttcgtcgtgggacgtcgaccgtaagtacgtttacggttcgagggtcggcggacggggtccgggggtacggggaactaggttaactttacgaacgtaacgtaagtaaacgtcggacgggtccgggtaggacgtcgtaggaggtagttaggttaaggttaatttacgttagttacgactagttacggacgtaagtactacgttccgttacccggttccccggtaccgttaccggaaccgtaacgggaaccggtagggtaacggtaaacgtacgaacggtacggtacgtggtacgg

SEQ ID NO: 244502 - DNA, 625 bp, Homo sapiens
  misc_feature: GYAE6OF01AFYWR.44.45.E01.1.454.CMB.1.raw
  modified_base (173)..(173): a, c, t, g, unknown or other
  misc_feature (173)..(173): n is a, c, g, or t
  modified_base (228)..(228): a, c, t, g, unknown or other
  misc_feature (228)..(228): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctntctctgtccgtcacccctggacagccggcctccatgtcctgcaagtctagtcagngcctctgcatagtgataggaaagacattatttgtactggtacctgcagaggtcagccagtctccgcacgctcctcatctatgtactttcttacaagccgtcccttctccgtgggacgttcgacccgtaagtacgtttacgggtttcaagggttcgggacccgtaaggggtccggggggtaccgggggtaacaacggttacttttacccgaacgtaaccgttagaaaactcgaacgggtccggggttaggacggtcgtggaaggtagttaggtttaggtaaattttagttacgtgactagtcgacgtaaggctagttccgtaccgtttccccggtacgttccgggacgaacgggtaccgagggttaacgaaacgttcgaaaggcgtaacgtggtacgg

SEQ ID NO: 244503 - DNA, 591 bp, Homo sapiens
  misc_feature: GYAE6OF01CQJYB.44.45.E01.1.454.CMB.1.raw
  modified_base (257)..(257): a, c, t, g, unknown or other
  misc_feature (257)..(257): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatcccctggacccagtgcagatgttgtgctgacccagacctcccctctctctgtccgtcacccctggacacgccggcctccatgtcctgctaagtctagtcagacgcctcctgcatagtgataggaaancattattgactggtacctgcagaggtcaggccagtcctccgcagtcctcctcatctatgtatttcttacaagtccgtcctctcgtggagtcgacctagtataggttcaggtcggacgagggcggggtcggggactaggtactttacaacgtacgtaagtaaacgtcgaacgggtccggggtaggacggtcgtaggaacggtagttggttaaggtaattttagttaccgtgtacagttcgacgtaaggtctagttccgtaccggtttaccccggacgttcggaaccgtaacggggaccgtaggggtaacgaacgtacgagacgtacgtggtacgg

SEQ ID NO: 244504 - DNA, 402 bp, Homo sapiens
  misc_feature: GYAE6OF01A0IZ9.44.45.E01.1.454.CMB.1.raw
  modified_base (398)..(402): a, c, t, g, unknown or other
  misc_feature (398)..(402): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtccaccgtctcctcagcctccaccaagggcccatcggtcttcccctggcgccctgctccaggagcacctccgagagcacagcggccctgggctgcctggtcaggactacttcctatatactgtctgagcgggctggcaaggcgcatagnnnnn

SEQ ID NO: 244505 - DNA, 416 bp, Homo sapiens
  misc_feature: GYAE6OF01BNVL1.44.45.E01.1.454.CMB.1.raw
  modified_base (408)..(416): a, c, t, g, unknown or other
  misc_feature (408)..(416): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagcccctggtcaccgtctcctcagcctccaccaacgggcccatccggtccttccccctggccgcccctgcctccaggacgccacctccgagagcacagtcggccctgggctgcctggtcaaggctacttcctatatactgtctgagcgggctggcaaggcgcatagnnnnnnnnn

SEQ ID NO: 244506 - DNA, 417 bp, Homo sapiens
  misc_feature: GYAE6OF01AJ6FC.44.45.E01.1.454.CMB.1.raw
  modified_base (408)..(417): a, c, t, g, unknown or other
  misc_feature (408)..(417): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagcccctggtccaccgtctcctcagcctccacccaagggcccatcggtcttccccctggccgccctgcctccaggacgcacctccgagagcacagccggccctgggctcgcctggtcaaggactacttccacgtctactgctgagcgggctggcaaggcgcatacgnnnnnnnnnn

SEQ ID NO: 244507 - DNA, 455 bp, Homo sapiens
  misc_feature: GYAE6OF01BK6JQ.44.45.E01.1.454.CMB.1.raw
  modified_base (243)..(243): a, c, t, g, unknown or other
  misc_feature (243)..(243): n is a, c, g, or t
  modified_base (448)..(455): a, c, t, g, unknown or other
  misc_feature (448)..(455): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggancccgtggtccaccgtctcctcacgccctccaccaacgggcccatccggtccttcccccgtggccgcccctgcctccgaggacgccacccgtccgagacgccacgacgccggccccgtgggcctcggcccgttgggtccaaagggtaccttaccgttaccctaagtactactgtccgtggacggcgggctggcgaaggcgcaatgnnnnnnnn

SEQ ID NO: 244508 - DNA, 480 bp, Homo sapiens
  misc_feature: GYAE6OF01D1MEN.44.45.E01.1.454.CMB.1.raw
  modified_base (254)..(254): a, c, t, g, unknown or other
  misc_feature (254)..(254): n is a, c, g, or t
  modified_base (265)..(265): a, c, t, g, unknown or other
  misc_feature (265)..(265): n is a, c, g, or t
  modified_base (432)..(432): a, c, t, g, unknown or other
  misc_feature (432)..(432): n is a, c, g, or t
  modified_base (435)..(445): a, c, t, g, unknown or other
  misc_feature (435)..(445): n is a, c, g, or t
  modified_base (447)..(455): a, c, t, g, unknown or other
  misc_feature (447)..(455): n is a, c, g, or t
  modified_base (457)..(480): a, c, t, g, unknown or other
  misc_feature (457)..(480): n is a, c, g, or t
tcagacagtatatacacgaccggtgctcgattttagtgagtcagtaagggaaagggggtcgtggagtgggtggcagtcatctggtctgatggaagtaaacgaatactatggaaactccggtgaagggccgattctccgtctccagacgacaattccaagaacaccgtgtatctacaaatgaacaatttgagagccgaggactcggctctctattagtgtacgagcccatcgttctactggggccagggagcccnggtcaccgtcncctcagcctccaccaagggccccatccggtacttcccccctggccgcccctgctcccaggagccacctccgagagcacagccggccctgggctgccgtggtcaaggactacttccgtatatacgtgtctggaggcgggctaggcaaagggccgactaagtaaggtcncgnnnnnnnnnnntnnnnnnnnncnnnnnnnnnnnnnnnnnnnnnnnn

SEQ ID NO: 244509 - DNA, 415 bp, Homo sapiens
  misc_feature: GYAE6OF01ECOI7.44.45.E01.1.454.CMB.1.raw
  modified_base (320)..(320): a, c, t, g, unknown or other
  misc_feature (320)..(320): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
  modified_base (409)..(415): a, c, t, g, unknown or other
  misc_feature (409)..(415): n is a, c, g, or t
tcagacagtatatacacgaccggtgctcgatttagtgagtcagtaaggggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggacgccctggtcaccgtctcctcagcctccaccaagggcccatccggtccttcccctggccgcccctgcctccaggacnccaccctccggagagcacagccggcctgggctgcctggcaaggactacttccatactactgtctgacgcgggntggcaaggcgnatagnnnnnnn

SEQ ID NO: 244510 - DNA, 413 bp, Homo sapiens
  misc_feature: GYAE6OF01ABZWB.44.45.E01.1.454.CMB.1.raw
  modified_base (398)..(399): a, c, t, g, unknown or other
  misc_feature (398)..(399): n is a, c, g, or t
  modified_base (401)..(413): a, c, t, g, unknown or other
  misc_feature (401)..(413): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggacgcacctccgagagcacagcggccctgggctgcctggtcaggctacttccatatactgtctgagcgggctggcaaggcgcatagcnngnnnnnnnnnnnnn

SEQ ID NO: 244511 - DNA, 561 bp, Homo sapiens
  misc_feature: GYAE6OF01E2CBL.44.45.E01.1.454.CMB.1.raw
  modified_base (172)..(172): a, c, t, g, unknown or other
  misc_feature (172)..(172): n is a, c, g, or t
  modified_base (195)..(195): a, c, t, g, unknown or other
  misc_feature (195)..(195): n is a, c, g, or t
  modified_base (430)..(430): a, c, t, g, unknown or other
  misc_feature (430)..(430): n is a, c, g, or t
tcagacagtatatacacgaccggtgctcgatttagtgagtcagtaagggaaagggatcaggacttctcagttcatcttctcaccatgaggctccctgctcagctcctggggctgctaatgctctggatccctggacccagtgcagatgttgtgctgacccagacctcccctntctctgtccgtcacccctggacngccggcctccatgtcctgcaagtctagtcagagcctcctgcatagtgatggaaagacattatttgtactggtacctgcagaggtcaggccagtctccgcagctcctcatctatcgtatttctttacaagccgtcctctctggagtcgccagtagtaggttcaggtggcgaggcggggtacggggacaggtactttcaactactagaaaactcgaggccgggtggaggcgtgaggnttaggttagtaatttattacgtgactagtgacgaagctatttaccgtaccggtttaccccggccgtttccgggacccgtaaacggggaccgtaagggtacggaaactacgaaacgtcggaaagtggtacgg

SEQ ID NO: 244512 - DNA, 419 bp, Homo sapiens
  misc_feature: GYAE6OF01BDILB.44.45.E01.1.454.CMB.1.raw
  modified_base (245)..(245): a, c, t, g, unknown or other
  misc_feature (245)..(245): n is a, c, g, or t
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
  modified_base (409)..(419): a, c, t, g, unknown or other
  misc_feature (409)..(419): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctacgtggggccagggacnccctggtcaccgtctcctcacgcctccaccaagggcccatcggtcttccccctggcnccctgctccaggncacctccgagacgcacacggccggcccctgggctgcctggtcaaggtactacttccacgttctactgctgagcgggctggcaaggcgcagtagnnnnnnnnnnn

SEQ ID NO: 244513 - DNA, 731 bp, Homo sapiens
  misc_feature: GYAE6OF01D1U3Y.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagattgttgtgctgacccagacctcccctctctctcgtccgtccaccctggacacgccggcctccatcgtcctgactaagtctagtcagacgcctcgtgctaagtaggtagtagtaagggaaaactactaatttagtttgtaaccgttacggtacctggacgtaggtacggtcacgggtccctaggtccctccggacacgtcccttccgtactacttactagttcgttactttcctttacgaacgtcccgtccgttcgttcggtacggtacgttccgaaccgtaaggttcgtttaacgggttccgaagggttcgggacgtacgggggtaccggggtacgggactaggttaccgtttacgaacgtaacgtaagtaaaccgtccggacggggtccgggagggtacggtacgttagggaaggttagttaggttaacggtttaatttacgttagtcgtagtagtacggacgtaacggttccttacggttaccgttaccgggtttacccccggtacggtacccggaacgggtaaccgggtacggtaacgggtacggtaaaacgttacgaaacggtaccggttagcggtacgg

SEQ ID NO: 244514 - DNA, 680 bp, Homo sapiens
  misc_feature: GYAE6OF01CL51V.44.45.E01.1.454.CMB.1.raw
  modified_base (301)..(301): a, c, t, g, unknown or other
  misc_feature (301)..(301): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatcccctggacccagtgcagatgttgtgctgacccagacctcccctctctctcgtccgtccacccctggacacgcccggcctccatgtcctgcaagtctagtcagacgcctcctgcaatagtgaatggaaaagacattatttgtactggtacctgcagaggtcaggccagtcnccgcagctcctcatctatgtatttcttacaacgcgtccctctcgtggagtcgccagtagttaggtttcaggttcgggacgacgggtccgggggttcggggaaccgaggttaacgtttaccaacgtaacgttaaaggaaaacttccggaacgggtacccgggggtagggacgggtaccgttagggaagggtaagtttagggtttaggttaaatttttacgtttaacgttgacttaagtacggacgtaaacggtctaacgtttaccgttacccgtttacccccgggtaaccgtttacccgggaacccggtaacgggggtaacccgtaagggggttaacggtaaacgtaccggaaaggtaccgtaacggttgggtaaccggg

SEQ ID NO: 244515 - DNA, 532 bp, Homo sapiens
  misc_feature: GYAE6OF01C6RRH.44.45.E01.1.454.CMB.1.raw
  modified_base (239)..(239): a, c, t, g, unknown or other
  misc_feature (239)..(239): n is a, c, g, or t
  modified_base (509)..(532): a, c, t, g, unknown or other
  misc_feature (509)..(532): n is a, c, g, or t
tcagacagtatatacacgaccggtgctcgatttagtgagtcagtaagggaaaggggctggagtgggtggcaattatatcagaagatggaattgaagaacactacggagactccgagaaggccgattcaccgtctccagagacaattccaggaacacactgcatctgcaaatgtacaacctcacaagtgaggacacggctgtctattattgtgcgagacgccccctgagaccggtccccnttgactacgtggggccagggaccctggtccaccgtctcctcacgccctccaccaacgggccccagtccggttcccttccccccgtggcccgccctgacctcccgaggaccgccacctcccgagacgccacgtacggccggtcccgtgggccgttcgcccgtggtaccgtaaacgggtccttaaccgtttcccgtacggtacgttccggtaccgtttcgtacgggacggtccggggcgttacggggccgaaacgggccgacaagtaggcannnnnnnnnnnnnnnnnnnnnnnn

SEQ ID NO: 244516 - DNA, 747 bp, Homo sapiens
  misc_feature: GYAE6OF01DJEU3.44.45.E01.1.454.CMB.1.raw
  modified_base (199)..(199): a, c, t, g, unknown or other
  misc_feature (199)..(199): n is a, c, g, or t
tcagacagtatatacacgaccggtgctcgatttagtgagtcagtaagggaaagggggaggaactgctcagttaggacccagagggaaccatggaagccccagctcagcttctcttcctcctgctactctggctcccagactaccgaccgggtaattgtgttgacacaatctccagccacctgtctttgctcgagggaancgccaccctctcctgcagggccagtcagtagtcgttaggaacttacgttagcctaggtaacccaaacacggtaaacctggacccgaggtccctcccgaaggtcccttacctactatccttagtgacgttggacctacgtaccgaagtacgggttcaacgtcggacccaacccgagacctagggttacaggtcgacgaggttcgggtcacgggactagtaccttcaacgtctaaccgaccgtagagtactaaacgtcggtaaccaggtacccgttaaggtaactttacgttttgaacttttacggtttttaaacttccgttaggtaccgtacggtacgtacggtttccctacccgtcggtaaccggtcccgttacgtaccgttacggggttttaccggggaccggggttaccgaacggggttagaacgtacgtaacgtacggaaccggttaacggttggtaccggtacgtaccggtaccgtacgtacgttccgtttcgtaacccgtttcctaccgttaccccgttacccgaccttacgttcttaaccgg

SEQ ID NO: 244517 - DNA, 683 bp, Homo sapiens
  misc_feature: GYAE6OF01DRYGK.44.45.E01.1.454.CMB.1.raw
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
tcagacagtatatacacgaccggtgctcgatttagtgagtcagtaagggaaaggggatcaggacttctcagttcatcttctcaccatgaggctccctgctcagctcctgggctgctaatgctctggatccctggacccagtgcagatgttgtgctgacccagacctccctctctctgtccgtcaccctggacagccggcctcatgcctgcaagtctagtcagacgcctcctgcatagtgataggaaanactattatttgacttggtacctgacaggaggtcaggccagtcctccgcagctcctnatctatcgtactttccttacgaacgtccgtacccttcgttccgtagggtacgtccggaccgtaaggtaacgttacgggttaccgagggttcgggacgtaacggggtcccgggggttacggggaacctaggttaacgtttaccaacgtaacgttaagaaaacgttcggaacgggtccggggtaggaacggtcgtaggaagggtattagggttacggtaaattttacgttacgtgtacctagtacgtacgtaaagggtccttaacgttcccggttaccggtttacccccgggtaacgtttacccggggaccgtaaacggggtacccgtaaggggtaaccggtaaaacttacggaaacggtacggaaacgttgggtaaccgg

SEQ ID NO: 244518 - DNA, 731 bp, Homo sapiens
  misc_feature: GYAE6OF01A10LV.44.45.E01.1.454.CMB.1.raw
  modified_base (251)..(251): a, c, t, g, unknown or other
  misc_feature (251)..(251): n is a, c, g, or t
tcagacagtatatacacgaccggtgctcgatttagtgagtcagtaagggaaagggatcaggacttctcagttcatcttctcaccatgaggctccctgctcagctcctggggctgctaatgctctggatccctggacccagtgcagatgttgtgctgacccagactcccctctctctgtccgtcacccctggacagccggcctccatgtcctgcaagtctagtcagacgcctcctgcatagtgataggaaanacattatttgtactggtacctgcagaggtcaggccagtctccgcagcctctcatctaatcgtatttcctttacaacgtccgccttcgtcgtggtagtcgacccgtagtacttagggttccaaggtcgggacgtagggtccggggtacggggacgtaacggtactttaccgaaacgtaacgttaagtaaaacttccgaaacgggtcccggggtagggaacgggtccgtagggtaacgggtagtttagggttttaagggttaaagtttttacgttaaccgttaggtaccgtaagttacgggaaccgtaaacgggtaccgttaacgtttacccggttaacccggtttttacccccccggggtaacccgtttacccggggtaaacccggtaaaccggggggtaaacccgggttaacgggggttaaacgggtaaaaaccgttaccggaaaacgggtaaccggtaaaccggttgggtaacccgggg

SEQ ID NO: 244519 - DNA, 694 bp, Homo sapiens
  misc_feature: GYAE6OF01C8FC0.44.45.E01.1.454.CMB.1.raw
  modified_base (268)..(268): a, c, t, g, unknown or other
  misc_feature (268)..(268): n is a, c, g, or t
  modified_base (336)..(336): a, c, t, g, unknown or other
  misc_feature (336)..(336): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatccctggacccagtgcagatgttgtgctgacccagacctcccctctctctcgtccgtccaccccgtggacacggccgcctcatcgtcctgactaagtctaagtcagacgcctcctgactagtagtagaatagggaaaanactattatttgtaacgtggtaacctgacaaggacggtcacggcctagtcctccggacacgtcctcctnacttctaatcgtaatttccttacgaacggtcctccttcgttcgaggtacgtcgaccgtaaggtacgttaggttaccgaggtacgggaccgtaacgggccgggggttacgggaactaaggttacgtttacgaaacgtaacgtaaagaaaacgtcgaacggggtccgggtaggaagggtcgttagggaagggtagtttagggttaaggttaaattttacgttacgtagacctaagtcggacgaaggttccttaacgttccggtaaccggttttacccccgggacgtttacgggacccggtaaacggggtaacccggaagggttaacgaaaactacggaaagaccggtaagtggttaccgg

SEQ ID NO: 244520 - DNA, 431 bp, Homo sapiens
  misc_feature: GYAE6OF01AEZD6.44.45.E01.1.454.CMB.1.raw
  modified_base (416)..(420): a, c, t, g, unknown or other
  misc_feature (416)..(420): n is a, c, g, or t
  modified_base (422)..(431): a, c, t, g, unknown or other
  misc_feature (422)..(431): n is a, c, g, or t
tcagacagtatatacacgaccggtgctcgatttagtgagtcagtaaggggaaaggggctggagtgggtggcagtcatctggtctgatggaagtaaagaatactatggaaactccgtgaagggccgatttctccgtctccagagacaattccaagaacaccgtgtatctacaaatgaacaatttgagagccgaggactcggctctctattattgtacgagcccatcgttctacgtggggccagggagccctggtcaccgtctcctcagccctccaccaagggcccatccggtcttccccctggccgccctgcctccaggacgccaccctccgagagcacgacgccggccctgggcctgcctggtcaaggctacttccacgtctactgctgacggcgggctggacacggcgcagtagnnnnngnnnnnnnnnn

SEQ ID NO: 244521 - DNA, 714 bp, Homo sapiens
  misc_feature: GYAE6OF01EFEX2.44.45.E01.1.454.CMB.1.raw
  modified_base (151)..(151): a, c, t, g, unknown or other
  misc_feature (151)..(151): n is a, c, g, or t
  modified_base (171)..(171): a, c, t, g, unknown or other
  misc_feature (171)..(171): n is a, c, g, or t
  modified_base (194)..(194): a, c, t, g, unknown or other
  misc_feature (194)..(194): n is a, c, g, or t
tcagacagtatatacacgaccggtgctcgatttagtgagtcagtaagggaaagggatcaggacttctcagttcatcttctcaccatgaggctccctgctcagctcctgggctgctaatgctctggatccctggacccagtgcagatgttgngctgacccagacctcccctntctctgtccgtcacccgtggacngccggcctcatgtcctgcaagtctagcagacgtcctcgtgcctagtagtgagtacggaaacgtctaattacgtttggtaacctgggtaaccctggacctagggtacggtccgaacgggtccctaaggttcccgtacccggagtaacggtcccttaccgtactacgttaccgttaagttcggtaactttccgtttaaccgaaacggtcccgtaccgttacgtccgtagggtaaccgttcgaaccccgtaaggtaccgttacgggttccaacggtcggtaccgtacgggtccggggttacgggtaactacgggttaactttaccggaaccgttacgtaacggtaaaactccggtacggtacccgggtagtacggtccgttaggtacggtagtttacggttaggttaaactttacggttacgtacgtacgtagttcgacgttaacgtcttacgttcgtaccgtttcccggactttcgggactaacgggacgtagggtacaacgtcgaagcgtaagtggtacgg

SEQ ID NO: 244522 - DNA, 672 bp, Homo sapiens
  misc_feature: GYAE6OF01DECB5.44.45.E01.1.454.CMB.1.raw
tcagacagtatatacacgaccggtgctcgatttagtgagtcagtaagggaaaggggatcaggacttctcagttcatcttctcaccatgaggctccctgctcagctccgtgggctgctaatgctctggactccctggacccagtgcagatgttgtgctgacccagacctccctctctctcgtccgtccacccgtggacacgccggcctcatcgtcctgcaagtctagtcagaccgcccctgcatagtgataaggaaacactagttatttgtactcggtacctgtacgagtacggtcacggccacgtcctccgcacgtcctcctcatctatagtacttcttacgaacgtcgtcccttcgtcgtacggtacgttcgtaccgtaggtagtttacggtacgtagggttcgggacgacggggtccggggtacggggtactaacggttactttacgaacgtaacgtaacggaaaagtccggaacggggtccggggtaggacggtcgtagggaacggtagtttcgggttaaggtaacttttacgttacgtcgtactaacgcgtaacgacgtcctaacgttaccgtacccggttcccggaccggtttccgggaaccggaaacggggacgtaacggggtaacgtaaacgtacggtaaacgccggttaacgtggttaggaccg

SEQ ID NO: 244523 - DNA, 726 bp, Homo sapiens
  misc_feature: GYAE6OF01BK6M8.44.45.E01.1.454.CMB.1.raw
  modified_base (196)..(196): a, c, t, g, unknown or other
  misc_feature (196)..(196): n is a, c, g, or t
  modified_base (347)..(347): a, c, t, g, unknown or other
  misc_feature (347)..(347): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatccctggacccagtgcagatgttgtgctgacccagacctccctctctctcgtcctccaccctggacncgcccgcctcatcgtcctgacaagtctagtcagacgtcctccgtgcagttagtagtagtaggaaagacttattagtttagtaacgttggtaaccctggacgtaaggtacggtacgacgggcctaggtcccgtccgactacgtccttacctntacgtctatagttactttctacgacgtcctccgttcgtacgtggacgtcgaccgtaagtacgtttaggttacgaggtcggtacggacgggtcggggtacggaacgtaggttacttacgactaagtaacgtaaacgtccggtaacgggtcggggtaacggtacggtacgttagggaacggttaggtttacgggttaacgtttaaagtttttaccgttaacgttcggtacttaagtaccgggtacgtaaacgggtacctttaacgttacccgggttaacccggttttaccccgggacggttaacccggtaaccgggaaccgggtaacgggtaacggtaaggtaacctaacggtaaccgtacggttaacggtcggtaaccgg

SEQ ID NO: 244524 - DNA, 440 bp, Homo sapiens
  misc_feature: GYAE6OF01CFNPC.44.45.E01.1.454.CMB.1.raw
  modified_base (318)..(318): a, c, t, g, unknown or other
  misc_feature (318)..(318): n is a, c, g, or t
  modified_base (420)..(420): a, c, t, g, unknown or other
  misc_feature (420)..(420): n is a, c, g, or t
  modified_base (426)..(440): a, c, t, g, unknown or other
  misc_feature (426)..(440): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccgagaacatcgtgtatctacaaatgaacaatttgagagccgaggactcggctctctattattgtacgagcccatcgttctactggggccagggacgccctggtccaccgtctcctcagcctccaccaacgggcccatcggtccttcccctggccgccctgctccgaggcncacctccgagacgccacgacgccggcccgtgggcctcggccgtggtaccaaggtacctacttcccgtcgactcgccgtcgtggacgcgggctggcgaaggcncatagnnnnnnnnnnnnnnn

SEQ ID NO: 244525 - DNA, 613 bp, Homo sapiens
  misc_feature: GYAE6OF01AO9QT.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacagcccggcctccatgtcctgcaagtctagtcagacgcctcctgcatagtgatggaaagctattatttgtactggtacctgcaggaggtcaggccagtcctccgcagtcctcctcattctatgtactttcttacaacgtcctccctcgtcgtggtagtcgaccagtattacgggttcaggtcggacgagggtcgggggtacgggactaggtacgtttcgaactacgttagaaaactcggacgggtccggggtaggacgggtacgtaggaggtagttggtttaagttaattttacgtacgtgtacctagtcgacgtagtctacgttaccgtaccggttaccccggtacgttaccgggaccgtaacggggtaccgtaaggggttacgaaacgttaccgaaaggtaccggtaggtcggtacgg

SEQ ID NO: 244526 - DNA, 623 bp, Homo sapiens
  misc_feature: GYAE6OF01AQZIP.44.45.E01.1.454.CMB.1.raw
  modified_base (195)..(195): a, c, t, g, unknown or other
  misc_feature (195)..(195): n is a, c, g, or t
  modified_base (299)..(299): a, c, t, g, unknown or other
  misc_feature (299)..(299): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacngccgcctccatgtcctgcaagtctagtcagagcctctgcatagtgataggaaagcattatttgtactggtacctgcagaggtcaggccagtctccgcagctccnatctatgtactttcttacaagtccgtcccttcgttcgtggtacgtcgaccctaagtacgttaggttccaaggtcggtaccgagggtccggggtacggggacaggttactttacaacgtacgttaagaaaacgttccgaaggtcccggggtagacgggtacgtaggtaggtagttacgggttaagtaacgttttacgtaccgtgtacctagtacggtacgaaagggtctaacgtttccgtaaccggtttccccggtaccgttaccgggaccgaaacgggtaccgtaagggtacggtaaactacgaaacgcgtaaacgtggtacgg

SEQ ID NO: 244527 - DNA, 630 bp, Homo sapiens
  misc_feature: GYAE6OF01EFKV8.44.45.E01.1.454.CMB.1.raw
  modified_base (323)..(323): a, c, t, g, unknown or other
  misc_feature (323)..(323): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggacagccggcctccatgtcctgcaagtctagtcagacgcctcctgcatagtgatggaaagacatatttgtactggtacctgcagaggtcaggccagtctccgcagctcctcatctatgtattcttcaagcnctctctggagtcgcctagtataggttcaggtcggcgagggcgggtacgggacgagtacttcgacacgtagaaacgtcgacgggtccgggtgggacggtcgtagggaagggtagttagggttaggttaagttttaagttacgttaggtacgtagtacggtacgtaacgggtaccttagtttacccgttaccggttttaccccccgggtaccgtttaccccggggtaacccggtaaccggggtaacccggtaacggggtaacgggtaaacgttacggaaaccggtacggtaaaccggtgggttaccggg

SEQ ID NO: 244528 - DNA, 679 bp, Homo sapiens
  misc_feature: GYAE6OF01AF5HI.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggacagccgcctccatcgtcctgcaagtctagtcagacgcctcctgcatagtgataggaaagactattatttgtactggtacctgcagaggtcaggccagtctccgcagcctctcatctatcgtatttcttacaacgtccgtccttcgtcgtgggacgttcgccctaagtacgtttaacggttccgaagggttcgggaccgtaggggtccggggtacggggaactaggtacgttttaccgaacgtaacgtaacggaaaaacttcggaacgggtccggggtagggacgggtaccggttagggaacgggtagtttagggtttaagggttaaactttttacgtaacgttgtacgtaagttcggacgtaaaggtctaagtttcccgtaaccggttttcccccgggacgtttaccgggaacccggtaaacggggtaacccgtaagggggtaacgtaaacgtacgtaaacggaccggtaaacggttggtacggg

SEQ ID NO: 244529 - DNA, 543 bp, Homo sapiens
  misc_feature: GYAE6OF01AN47N.44.45.E01.1.454.CMB.1.raw
  modified_base (173)..(173): a, c, t, g, unknown or other
  misc_feature (173)..(173): n is a, c, g, or t
  modified_base (299)..(299): a, c, t, g, unknown or other
  misc_feature (299)..(299): n is a, c, g, or t
tcagacagtatataacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctntctctgtccgtcacccatggacagccggcctccatgtcctgcaagtctagtcagagcctctgcatagtgatggaaagacatatttgtactggtacctgcagagtcaggccagtctcgcagctcctnatctatgtattcttcaagcgcctctctggagtcgaccagtataggttcaggtggcgaggcggggtcgggacagtactttcacactagaaaactcgaacggtccgggtaggaggcgtaggaggtagtcggtttaggtaatttacttacgtgtacagttgacgtaggctattcgtacgtttccccggacgttccggaccgaacgggaccgtacgggtacggtaaactacgaacgtcgtacgtacgg

SEQ ID NO: 244530 - DNA, 646 bp, Homo sapiens
  misc_feature: GYAE6OF01BJ6GF.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggacacgccggcctccatcgtcctgacaagtctagtccagacgcctcctgcatagtgataggaaagctatatttgtactggtacctgcaggaggtcacggccagtcctccgcagtcctcctctactctatgtactttcctttacgaacgtcctccttcgtcgtgggtaagtcgacctaaggtagttacggttcagggttcggacgtagggccggggttacgggaactagtactttacaacgtacgtaagaaactcgtagggtccgggtggaacggtcgtaggaggtagttaggttagtaacttttagtacgtgtacgtagtcgacgtaaacgtctaacgtttcccgttaacccgggttttcccccggaaccgtttcccggggaaccggtaaacggggtaccgtaaggggttaacgtaaacgttacccggaaaaggtccgtaaacgttgggtaccg

SEQ ID NO: 244531 - DNA, 716 bp, Homo sapiens
  misc_feature: GYAE6OF01BWADN.44.45.E01.1.454.CMB.1.raw
  modified_base (169)..(169): a, c, t, g, unknown or other
  misc_feature (169)..(169): n is a, c, g, or t
  modified_base (191)..(191): a, c, t, g, unknown or other
  misc_feature (191)..(191): n is a, c, g, or t
  modified_base (246)..(246): a, c, t, g, unknown or other
  misc_feature (246)..(246): n is a, c, g, or t
tcagacagtatatacacgaccggtgctcgatttagtgagtcagtaagggaaagggatcaggacttctcagttcatcttctcaccatgaggctccctgctcagctcctgggctgctaatgctctggatccctggacccagtgcagatgttgtgctgacccagactccctntctctgtccgtcaccctggacngccgcctcatgtcctgcaagtctagtcagctcctctgctatacgtgataggaaanactattatttgtactggtacctgactagacggtcaggccagtcctcgctacgtctcctcgaattctaacgttcgtacttttccgtttacgaacggtccgtaccgttcgttaccgttagggtaacgttcgaccctaaaggtacgttacgggttacctagggttcgggacgtacgggtaccggggtacggggtaacgtaacggttacgtttaccgaacgtaacgttaacggtaaaaacttcggtaacgggtaccggggttagggaacggtccgtaagggtacggttagttacggttacggttaacgtttaacgttacggtaacgttaccgtacgttacggtaacgtaggttacgttacgtttaccgtaaccgggttttaccccgggtaccgtttaccgggaaccggtaacgggacccgttaacgggttaacggtaaacgttaccgaacggtaccgtaacggttcggtacggg

SEQ ID NO: 244532 - DNA, 701 bp, Homo sapiens
  misc_feature: GYAE6OF01D29ZI.44.45.E01.1.454.CMB.1.raw
  modified_base (174)..(174): a, c, t, g, unknown or other
  misc_feature (174)..(174): n is a, c, g, or t
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
tcagacagtatatacacgaccggtgctcgatttagtgagtcagtaagggaaaggggatcaggacttctcagttcatcttctcaccatgaggctccctgctcagctcctgggctgctaatgctctggactccctggacccagtgcagtatgttgtgctgacccagacctcccctntctctcgtccgtccaccctggacncgccgcctcatcgtcctgctaagtctagtcagacncctcctgctatagtgaagtaggaaagtactatttagttgtacgtcggtacctgacgaggtaggtcacggcctagtccgtccgactacgccttcctacacttcttatcgtattcgttacgacgtccgtcccgttcgtcgtggtacgtcgacgtaagtagttacggttcgaaggttcgggaccggtaggggtcccgggggtaacgggtacgtaacgttacgtttaaccgaacgtaacgttaaggtaaaaccgtcgggaacgggtccggggtaacggtagggtaccgttagggtaaggttacgttagggtttaagttaaactttttacgtacgtaggtacctagttaccggacgttaaacgtccttaacgttccggttaacccgggtttcccccgaacggtttcccgggaacggtaaaccgggacggtaagggtaacgtaaactacggtaacgacggttagtcggtaccgg

SEQ ID NO: 244533 - DNA, 648 bp, Homo sapiens
  misc_feature: GYAE6OF01DE2RN.44.45.E01.1.454.CMB.1.raw
  modified_base (258)..(258): a, c, t, g, unknown or other
  misc_feature (258)..(258): n is a, c, g, or t
  modified_base (314)..(314): a, c, t, g, unknown or other
  misc_feature (314)..(314): n is a, c, g, or t
tcagacagtatatacacgaccggtgctcgatttagtgagtcagtaagggaaaggggatcaggacttctcagttcatcttctcaccatgaggctccctgctcagctccgtgggctgctaatgctctggactccctggacccagtgcagatgttgtgctgacccagacctcccctctctctcgtccgtccaccctggacacgcccgcctcatcgtcctgcaagtctagtcagacgcctctgcatagtgaagtaggaaaanactaatttatttcgtaacgtcggtacctgacaggacggtcaggccagtcctccgcncgctcctcaatctatgtattcttacaacgcctcctctcgtggacgtcgacccagtagttacggtcaggtggcgacggggtcggggtacgggacaagtactttcaacgtaactaagaaagtccgagggtccgggtaggagtcgtaggaggtattagggttagtaattttagtacgtgtactagtgaacgtaaggtccttaagttcccgttaaccgggtttccccccggtaacggtttacccggggaaccggtaaaaccgggggtacccggtaaagggggttaaaccgtaaaacggtacggtaaacggaaccggttaaccggttgggtaacccggg

SEQ ID NO: 244534 - DNA, 837 bp, Homo sapiens
  misc_feature: GYAE6OF01EQKE8.44.45.E01.1.454.CMB.1.raw
tcagacagtatatacacgaccggtgctcgatttagtgagtcagtaagggaaaggggatcaggacttctcagttcatcttctcacatgaggctccctgctcagctccgtgggctgactatgctgtgactccgtcggaccagtcgcagtagttggttgtcgtctacgaccctaacgtcccttccccttctcctcgttcgttcccgtcctacccgtggacaccggcccggtccctcgagttccgtcctcgtaacgtacgttcgtacgtacgaacggtccgtcccttcgtaggactaagttagtaggaagtaagggaaactactagttttagttacgtacgttaccgtacgtcgacgtaacgggtcgtacgacggaccgttacgttccgtcccgacgtacgtcccttcctacttacttacgttagtcgtttactttcctttaacgaccgtccgtcttccgtgtaggcgttcgacgtaggttgttacgtacgtaggtcgggacggtacggggtcgggacggtaatacgtttacgttacaaacgttaggttaaaaccgaacgtcgggtaaccggggtttccggggaaggtacggtacgggttaagggtacgggttttaagggtttacgggtttaaagttttaaacgttttacccggtaggtttacggaatttaccgggtacggtaaccggttacgtaccgttttaaccggtttcccgggtttaaccccccggtttacccggggtaacgtttaaccccgggaacggggtaaacggacccggggttaaaggggtaacccgtaaacgtacggtaaacccgggtttacgtacggtggttaaacccgg

SEQ ID NO: 244535 - DNA, 665 bp, Homo sapiens
  misc_feature: GYAE6OF01DDXJW.44.45.E01.1.454.CMB.1.raw
  modified_base (171)..(171): a, c, t, g, unknown or other
  misc_feature (171)..(171): n is a, c, g, or t
  modified_base (267)..(267): a, c, t, g, unknown or other
  misc_feature (267)..(267): n is a, c, g, or t
  modified_base (363)..(363): a, c, t, g, unknown or other
  misc_feature (363)..(363): n is a, c, g, or t
  modified_base (512)..(512): a, c, t, g, unknown or other
  misc_feature (512)..(512): n is a, c, g, or t
tcagacagtatatacacgaccggtgctcgatttagtgagtcagtaagggaaaggggatcaggacttctcagttcatcttctcaccatgagctcctgctcagctcctgggctgctaatgctctggatcccctggacccagtgcagatgttgtgctgacccagacctcccctntctcgtgtcccgtcaccccgtaggaccacgcccggccttccagtgtaccctgacaaagttctagcagacgcctctgcatagtcgaagtacggaaanactattatttacgtacgtcggtacctggctaggacggtacacggcctacggtcctccggactagcttacctcactctacgtcgttattccgtttanaacgtccgtaccttcgttcgtggtacgtcgacctaggtacttacggtacgtaggtacgggacgtacggggtaccggggacggtaacgtaggttacgttacgtaacctaaagttaacggaactcgggaaggtcccgggtaggacggtacngggtaacggtagtgggttaattaacgtttagtacgtgacgttagtacgtacggtaacgtacgttacgttccggttaccgttaccccggtaccgttacggaccggaaggtacccggtaagggtcgtaaactacggacgtaagccggttgtaccg

SEQ ID NO: 244536 - DNA, 694 bp, Homo sapiens
  misc_feature: GYAE6OF01D4RFW.44.45.E01.1.454.CMB.1.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggactccctggacccagtgcagatgttgtgctcgacccagacctcccctctctctcgtccgtccaccctggacncgcccggcctccatcgtcctgactaagtctagtcagacncctcctgactaagtagtagacgtaggaaaacactagtttatttcgtacgttaggtacctgacgaggtacggtcgacggtaccacgttccgtacccggctacgtccttcccgtacaacgttcttaagtacgttacttttaccgttacgaacggtccgtccttcgtacgtacggtagtccacgtagtacgtttgggtacagggtcggacggtacgggtccggggtacgggtaactagttacttacgaacgtaacgtaagtaaacgcggaacgggtccgggtaggacggtgtaggaggttagttaggtttaggttaaactttcgtaacgtcgtactagtacggtacgaacgtctaacggtttacccgtacccgggtttaccccggtaccggttaccggaaccggtaaccgggtaacggtaacgggtaagaaacgtcgaaacggacgtagtcggtacgg

SEQ ID NO: 244537 - DNA, 588 bp, Homo sapiens
  misc_feature: GYAE6OF01A0VP0.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggacagccggcctccatcgtcctgcaagtctagtcagacgcctcctgcagtagtgataggaaagactattatttgtaactggtacctggcaggaggtcacggccagtcctccgcacgtcctcctcatctatcgtatttccttacagtcctcctctcgtggatcgaccagtacttaggttcaggtggcgaggcggggtacggggactagtactttaccgaactacgtaagtaaacgtcgacgggccggggtaggaggcgtggaggtattggttaaggttaatttagttaccgtgtactagtcgagaacgtctacgtttccgaccgtttaccccggacgttccggaccgtaacgggtacccgagggtacgaaacgtacgaaacgcggtaagtggtacgg

SEQ ID NO: 244538 - DNA, 461 bp, Homo sapiens
  misc_feature: GYAE6OF01D70VH.44.45.E01.1.454.CMB.1.raw
  modified_base (245)..(245): a, c, t, g, unknown or other
  misc_feature (245)..(245): n is a, c, g, or t
  modified_base (449)..(461): a, c, t, g, unknown or other
  misc_feature (449)..(461): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctacgtggggccagggacnccctggtcaccgtctcctcacgcctccaccgaacgggcccagtccggtccttcccccgtggccgtcccctgtcctccgaggacgccaccgtccggagacgccacgacggccggtaccccgtgggctcggcccgtgggtaccaaacggtacctacttcctatacttacgtgtctggacggcgggtctggacaagggcacagtagnnnnnnnnnnnnn

SEQ ID NO: 244539 - DNA, 586 bp, Homo sapiens
  misc_feature: GYAE6OF01BFOQI.44.45.E01.1.454.CMB.1.raw
  modified_base (253)..(253): a, c, t, g, unknown or other
  misc_feature (253)..(253): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggacagccggcctccatcgtcctgcaagtctagtcagacgcctctgcatagtgataggaaanactattatttgtactggtacctgcagaggtcaggccaggtcctccgcagtcctcctcatctatgtatttcttacaagtccgcctctcgtggacgtcgaccagtagttaggttcaggtcggcgagggcggggtacgggactaggtactttacgaactacgtagaaaactcgacggtccggggtaggacggcgtaggaggtagttggttaggtaatttagtactggtactagtgacgagctagttccgtaaccggtttcccggtaccgttacggaccggaacgggtaccggtaacgggtacgtaaacgtacggaaacgtcgtaacggtggtacgg

SEQ ID NO: 244540 - DNA, 550 bp, Homo sapiens
  misc_feature: GYAE6OF01DJ1NA.44.45.E01.1.454.CMB.1.raw
  modified_base (247)..(247): a, c, t, g, unknown or other
  misc_feature (247)..(247): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
  modified_base (508)..(508): a, c, t, g, unknown or other
  misc_feature (508)..(508): n is a, c, g, or t
  modified_base (521)..(550): a, c, t, g, unknown or other
  misc_feature (521)..(550): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctacgttggggaccagggacnccccgtggtccaccgttccgtcctcgacgcctcccaaccgaaacggggccccatccgggtaccctttccccccgtggacccgcccctcggccttcccgagggacnccccaccgtccgacgacgtccgaccgnggacccgggccccgtgggccgtccggacccgttgggtacgaaaccgggtaccttaccttacccttaagttacttaacttcggtccgttacggacggtccggggtcgttacgggacgaacggggtccganaacgttaggcagnnnnnnnnnnnnnnnnnnnnnnnnnnnnnn

SEQ ID NO: 244541 - DNA, 654 bp, Homo sapiens
  misc_feature: GYAE6OF01CO99K.44.45.E01.1.454.CMB.1.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctcgtccgtccacccctggacacgccggcctccatcgtcctgacaagtctagcagacncctccngcatagtgataggaaanactattatttgtactggtacctgcagaggtcaggccagtcctccgctacgcctcctcattctatgtactttcctttacgaacgtcctaccttctcgtacggtacgtcgaccgtagtacgttacggttcgaggtcggcgacgggtccggggtacgggactacggtacttaccgaacgtacgtaaagaaacgtccgaacgggtccgggtaggcggtacgtagggaggtagttagggttaaggttaaattttacgttacgtggactaacgttacggacgtaaacggtcttaacgttcccggtaccggtttacccccgggactttacccggggaaccggtaacggggacccggtaaggggtaacgtaaacgtaccgaaggtaccggtaagttcgggtacgg

SEQ ID NO: 244542 - DNA, 529 bp, Homo sapiens
  misc_feature: GYAE6OF01DQ6C9.44.45.E01.1.454.CMB.1.raw
  modified_base (217)..(217): a, c, t, g, unknown or other
  misc_feature (217)..(217): n is a, c, g, or t
  modified_base (306)..(306): a, c, t, g, unknown or other
  misc_feature (306)..(306): n is a, c, g, or t
  modified_base (486)..(486): a, c, t, g, unknown or other
  misc_feature (486)..(486): n is a, c, g, or t
  modified_base (488)..(529): a, c, t, g, unknown or other
  misc_feature (488)..(529): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccattctccgtctccagagacaattccaagaacaccgtgtatctaacaaatgaaactaatttgagagccgaggactcggctctctattatgtacgngcccatcgttcacgtcggggccagggacgccctggtccacccgtctcctcacgcctccacccgaacgggcccagtccgtccttcccccnggccgcccctgccgtccacgggcgaccacccgtccggaggacgccacgacggccggccccgtgggcctggccctcgggtacaaacggtaccttaccgtttacctaatacttcgttcgtcttcggaacggtcggggtaccttggggaccctaaggggacccgtcaaagttaccggagcganannnnnnnnnnnnnnnnnnnnnnnnnnnnnnnnnnnnnnnnnn

SEQ ID NO: 244543 - DNA, 787 bp, Homo sapiens
  misc_feature: GYAE6OF01ESQCD.44.45.E01.1.454.CMB.1.raw
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (601)..(601): a, c, t, g, unknown or other
  misc_feature (601)..(601): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggactcccgtggacccagtgcagtatgttgtgctacgacccagtacccttcccctctccgtcttcgtcccgtccaccccgtggacacggccccgtcctccgattcgtccgtgactaagtcttagcagcncctcngactatagtganaggaaaacnctatttattcgtaacgttggtacctggacgaggtacggtacgaccggtacctcgtccgtccgacgtacgtcccttccctagacttccgttagtacgttcttttaccgttaagaccggttccctcctttcgtagttcggaacgtcgaccgtaagttacgttcggtttacgaggtacggccgggttacggggccgggtacgggtactaggttactttacccaacgtaacgtaaagtaaaccgtcgggtaagggtccgggtagggacgttaggtacgggtaggttaagttcgggtttaaagtttaaacgttttccgtacggtnttaacggtaggtaaccttacgggaaccggttacctttacccggtttacccggttaaacccccggggtttccccggttaacccggggttaaccccgggtaaacgggtaaacccggggacgggtttaaaagggaaacggttaacccggaacggttaaacggaccgggttaaccggttaacgggcccgg

SEQ ID NO: 244544 - DNA, 489 bp, Homo sapiens
  misc_feature: GYAE6OF01AY86C.44.45.E01.1.454.CMB.1.raw
  modified_base (303)..(303): a, c, t, g, unknown or other
  misc_feature (303)..(303): n is a, c, g, or t
  modified_base (329)..(329): a, c, t, g, unknown or other
  misc_feature (329)..(329): n is a, c, g, or t
  modified_base (447)..(447): a, c, t, g, unknown or other
  misc_feature (447)..(447): n is a, c, g, or t
  modified_base (450)..(451): a, c, t, g, unknown or other
  misc_feature (450)..(451): n is a, c, g, or t
  modified_base (453)..(489): a, c, t, g, unknown or other
  misc_feature (453)..(489): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaactaatttgagagccgaggactcggctctctattattgtacgagcccatcgttctacgtggggccagggcgccctggtccaccgtcctcctcacgcctccaccaacgggcccatcggtccttcccccgnggccgccctcgcctccgacggcgccncccgtccggagcgccacgacgccggcccgtgggctcgccgtggtacaggtacctcttccgtatactactcgtcgtagacggcgggcgtcggacgaagggcccgtacgaagttagctgncgnngnnnnnnnnnnnnnnnnnnnnnnnnnnnnnnnnnnnnn

SEQ ID NO: 244545 - DNA, 411 bp, Homo sapiens
  misc_feature: GYAE6OF01AS8R0.44.45.E01.1.454.CMB.1.raw
  modified_base (242)..(242): a, c, t, g, unknown or other
  misc_feature (242)..(242): n is a, c, g, or t
  modified_base (396)..(396): a, c, t, g, unknown or other
  misc_feature (396)..(396): n is a, c, g, or t
  modified_base (402)..(411): a, c, t, g, unknown or other
  misc_feature (402)..(411): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggngccctggtccaccgtctcctcagcctccaccagggcccatcggtcttcccctgcgccctgctccaggagccacctccgagacgcacagccggccctgggctgcctggcaacggactacttcctatactactgtctgagcgggctggcaagggcncatagnnnnnnnnnn

SEQ ID NO: 244546 - DNA, 935 bp, Homo sapiens
  misc_feature: GYAE6OF01D4GD2.44.45.E01.1.454.CMB.1.raw
  modified_base (172)..(172): a, c, t, g, unknown or other
  misc_feature (172)..(172): n is a, c, g, or t
  modified_base (194)..(194): a, c, t, g, unknown or other
  misc_feature (194)..(194): n is a, c, g, or t
  modified_base (257)..(257): a, c, t, g, unknown or other
  misc_feature (257)..(257): n is a, c, g, or t
tcagacagtatatacacgaccggtgctcgatttagtgagtcagtaagggaaaggggatcaggacttctcagttcatcttctcaccatgaggctccctgctcagctcctgggctgctaatgctctggactccctggacccagtgcagatgttgtgctgacccagactcccctntctctgtccgtcaccctgaccngccggcctcatcgtcctgactaagtctagtcagacgcctctgactagtagtgatagggaaaanacaatttatttacgtacgttacggttaacccttggaccgtaaggtaacgggtccgaaacgggggtcccctaacggggttcccttccccggaaccgacccggtccctttccccgttaccgtaaacgtttccctttaaaggttcggttttaacctttttaaccctttttaccgaaaaccggggttccccgttaaccctttacccgtttacgggtcggggttaaacggtttcccgaccccggtaaagggttaaccgtttaaacggggtttccgtaaggggtttacgggaccgggtaacggggtccggggggttacggggaacccgttaggtaaccttttaccgaacgtaacttaaacggtaaaccgttcggaacccggggtaccggggttagggaaccggggtacggtaacggggttaacgggtacggttttagggttttaaaacggttttaaacggtttttaagtttaccggttacggtaccgttaaggttaccgggaacccggtaaagggttcctttaaacggttacccggttaaccccgggttttaaccccccggtaaccggggttacccgggtaaaccccgggttaaaccggggtaaaccccgggtaaggggttaaaccggtaaaaccgtttaaccggaaaacgggttaccccgtaagggttaccgggttaaccggg

SEQ ID NO: 244547 - DNA, 511 bp, Homo sapiens
  misc_feature: GYAE6OF01EBC68.44.45.E01.1.454.CMB.1.raw
  modified_base (375)..(375): a, c, t, g, unknown or other
  misc_feature (375)..(375): n is a, c, g, or t
  modified_base (487)..(487): a, c, t, g, unknown or other
  misc_feature (487)..(487): n is a, c, g, or t
  modified_base (490)..(511): a, c, t, g, unknown or other
  misc_feature (490)..(511): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctacgtggggccagggacgccccgtggtccacccgtcctcctcacgccctcccaacccgaacgggcccctacgttcccgggttccctttccccccgtgggcccgtcccctcgcctcccgagggacgccacccgtccggacgacgccacncggccggcccgtgggcctcgccgttggtaccgaacggtaccttaccttccgtcgtactcggccgtcgtcggacggcgggtcgtcgggacgaacgggccgacgtaagtacggncgnnnnnnnnnnnnnnnnnnnnnn

SEQ ID NO: 244548 - DNA, 658 bp, Homo sapiens
  misc_feature: GYAE6OF01C04L9.44.45.E01.1.454.CMB.1.raw
  modified_base (172)..(172): a, c, t, g, unknown or other
  misc_feature (172)..(172): n is a, c, g, or t
tcagacagtatatacacgaccggtgctcgatttagtgagtcagtaagggaaaggggatcaggacttctcagttcatcttctcaccatgaggctccctgctcagctcctgggctgctaatgctctggatccctggacccagtgcagatgttgtgctgacccagacctcccctntctctcgtccgtccacccctggaccacgcccggcctccatcgtcctgcaagtctagtcagacgcctcctgcatagtgagtaggaaagacattatttagtactggtacctgacaggaggtcaggcctagtcctccgcacgcctcctacacgttcctagttcgtactttccgtttcaacgtccgtcccttccgtcgtagggtacgtcgacccgagttacgttagggttacagggttcgggcgtacggggtcgggggtacgggaactaggtactttaccgaactacgtaagaaacgtcgacgggccggggtaggagtcgtaggaggtagttggttaggttaatttagttacgtgacgtagtgacgaaggtcctaacgttaccgttaaccggtttcccccggtaccggtttaccggaacccgggtaaacggggaccggttaaggggtaacggtaaaactaccggaaggtaccggaaggttcgggtaccgg

SEQ ID NO: 244549 - DNA, 468 bp, Homo sapiens
  misc_feature: GYAE6OF01B3L5D.44.45.E01.1.454.CMB.1.raw
  modified_base (456)..(468): a, c, t, g, unknown or other
  misc_feature (456)..(468): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctaacaaatgaacaatttgagagccgaggactcggctctctattattgtacgagcccatcgttctacgtggggccagggacgccctggtcaccgtctcctcacgcctccaccgaacggcccagtccggttccttccccccgtggcccgcccctcgcctcccgacggacgccacccgtcgacgacgcacgacgccggcccgtgggcctcgccgtggtacgaacggtacttaccttaccgtaatacttacgttgtctaggacggcggtcgtacggacaacggtcggacaggtannnnnnnnnnnnn

SEQ ID NO: 244550 - DNA, 665 bp, Homo sapiens
  misc_feature: GYAE6OF01BHQ0V.44.45.E01.1.454.CMB.1.raw
  modified_base (263)..(263): a, c, t, g, unknown or other
  misc_feature (263)..(263): n is a, c, g, or t
  modified_base (334)..(334): a, c, t, g, unknown or other
  misc_feature (334)..(334): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatccctggacccagtgcagatgttgtgctgacccagacctcccctctctctgtcccgtcacccctggacacgcccggcctccatcgtcctgcaagtctaagtcagactcctcctgcagtagtgaagtaggaaaanactaattatttagtaacgtggtacctgacaaggaggtacacgggcccagtcctccgacacgccttccctanattactatgtattcttacgaagccgtctctcgtgggatcgaccgaagtaacgttagggttcaagggttcggcgagggtccggggttacggggacaaggtactttacgaacgtaacgtaagtaaaagtccgaagggaccgggtaggagccgtaggaaggtagtggttaggtaaatttacgttacgtagtactagtagacgaaacggtcttaaagttcccgtaaccggtttccccccggtaacgtttaccgggacccgggaaaacgggtaccggtaaacgggggttaacgtaaaaccggaacgtaaacggaccgtaaaccggtaggttaccgg

SEQ ID NO: 244551 - DNA, 784 bp, Homo sapiens
  misc_feature: GYAE6OF01C8UEO.44.45.E01.1.454.CMB.1.raw
  modified_base (180)..(180): a, c, t, g, unknown or other
  misc_feature (180)..(180): n is a, c, g, or t
tcagacagtatatacacgaccggtgctcgatttagtgagtcagtaagggaaaggggatcaggacttctcagttcatcttctcaccatgagctccctgctcagctccgtgggctgctaatgtctctggactccccgtggacccagtgacagtatgttgtgctcgacccagtacctcccctntctctcgtacccgtccaccccgtggacctacgcccgtcctccagtcgtcctgactaagtctagtcagtaccgtccgtccgtgaccagttacggtagaagtaaggaaaactactaatttagttacgtaccgtacggttacctgacgtaggacggttaccgaacgggcctacggtccctacccggagtacgtccccttacctagactttcttaaagttcttactttccttacgaccgccttacccgtcgttacggtacggtactcggtaaccctagggtacgttacggtgacgggttacggcggtaacggggtccggggtacggtaacgtacgttactttaaccgacgttaacgtaacgtaacggtccgtaacggggtccgggtaaggtcggtactagggtaagttacggtttacggttaagttaacttttacgtccggttagtaccgttaacgtacggaaccgtaggttacccgttaaccgtacccgggtttacccccgggtttaccccggtaccgttacccgggaaacccggtaacggggtacgggttaacggtaaacggttaaacgtaccggaacgggtacccggtaagttcggtaaaccggg

SEQ ID NO: 244552 - DNA, 644 bp, Homo sapiens
  misc_feature: GYAE6OF01E41IH.44.45.E01.1.454.CMB.1.raw
  modified_base (250)..(250): a, c, t, g, unknown or other
  misc_feature (250)..(250): n is a, c, g, or t
  modified_base (345)..(345): a, c, t, g, unknown or other
  misc_feature (345)..(345): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacagccggcctccatgtcctgcaagtctagtcagagcctcctgcatagtgatggaaanacattattgtactggtacctggactagaggtcacggccagtctccgcagtccttcctcagttcctagttcgtaacttttcctttacaacggtccncccttcgtcgtaggtacgtgacccagtaacgtttaggttactagggtcggacgacgggtaccgggggtacggggacctaaggtactttacgaaaccaacgttagaaaacttcggaacgggtccgggtagggaggtccgtaggaacggtagttaggttaggttaaatttattacgtagactagtgacgtaacggtctacgttccgtaccggtttaccccgggtaccgttacccggaaccggtaaacgggtaccgaaaggggttaacgtaaacgtacggaaacgccgtaacgtggtacggg

SEQ ID NO: 244553 - DNA, 681 bp, Homo sapiens
  misc_feature: GYAE6OF01ECLRC.44.45.E01.1.454.CMB.1.raw
  modified_base (231)..(231): a, c, t, g, unknown or other
  misc_feature (231)..(231): n is a, c, g, or t
  modified_base (285)..(285): a, c, t, g, unknown or other
  misc_feature (285)..(285): n is a, c, g, or t
tcagacagtatatacacgaccggtgctcgatttagtgagtcagtaagggaaaggggatcaggacttctcagttcatcttctcaccatgaggctccctgctcagctccgtgggctgctaatgctcgtggactcccgtggacccagtgcagtagttgttgtgctcgacccagtaccctcccctcttctcgtcgtcccgtccacccgtggacacggcccgcctcattccgtccncgactacgtctagtacagaccgtccctcgtgactagtagtagagtaagggaaanactaatttatttacgtacgttacggtaccgtgacgaggtaggtccgacggtcctaggtcccgtccgacgacgtccttcctactagttacttattacggttacttttaccgttacaacgtccgttacctcgttcggtaggacgtcgaccgagttagttacgtacgaggtcggcgacggggtcgggtacggagtagttcttacacgtaacgtaagtaacgtcggtacgggtcgggtaggtacgtcggtaggtaggttagtttaggtttaagttaattttacggttatacgtactagtacgagtaacgtcttaagttacccgttaccggttccccgtacgtacggaccggaacggtaccggagggtaaccgtagtaacgaggtacgtacggtgtaacgg

SEQ ID NO: 244554 - DNA, 740 bp, Homo sapiens
  misc_feature: GYAE6OF01C1V4Z.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctgggctgctaatgctctggatcccgtggacccagtgcagatgttgtgctgacccagacctcccctctctctgtcccgtccacccctggacacgcccggcctccatcgtcctgacaagtctagtcagacgcctctgacatagtgaataggaaagactattattagtacgtaggtacctgcagaggtcaggccacgtctccgcagcctctcatctatgtattcctttcaacgtccgtacctcttacgtggtaacgtcgaccgtaggtacttacggttcaggttcgggacggtaacggggtcccgggggtacggggaactaaggttaactttaccgaacgtaacgttaaacggaaaactccgggaacgggtccgggggttaggaacggtcgttaagggagggttaacgtttggttttaaacggttaatttttaacgttacgttcggaaccgttagtacgtaccggtaaggttaacccgttaacgtttccccgggttaacccggttttacccccgggttaacccggtttacccggggtaaacccgggaaacccgggggttaacccggttaaacggggggaacgttaaaaccggtacccggtaaaggtaacccggtaaacggttcgggtaacccgggg

SEQ ID NO: 244555 - DNA, 683 bp, Homo sapiens
  misc_feature: GYAE6OF01D3NBP.44.45.E01.1.454.CMB.1.raw
  modified_base (250)..(250): a, c, t, g, unknown or other
  misc_feature (250)..(250): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctcgtggactccctggacccagtgcagattgttgtgctgacccagtcctcccctctctctcgtccgtccaccctggaccacggcccggcctccagtcgtcctgacctaagtctagtcagacgccctcngctagtagtgaataggaaagactaattatttgtacgtcggtacctgacgaggacggtacgacgggcctaacgtccgtccgcgacgtccttacctacgacttcttaagttcgttaactttcctttacgaaccgtccgtacccttcgtcgtacggtacgtcggaccgtagtaggttacggtacgagggttacggacggacgggtccggggtacgggaactagttactttacgaacgtacgtaagaaacgtcggacgggtccgggtagggacggtcggtaggtaagtgttaggtttagttaagtttacgttagtcgtactacgtacgacgtaacgtacgttacgttacccggtaccgtttacccccggacggttaccggacggtaacgggtaccgtagggtaacgtaactaccggaagtaccgtacggtggtacgg

SEQ ID NO: 244556 - DNA, 1076 bp, Homo sapiens
  misc_feature: GYAE6OF01CW2UO.44.45.E01.1.454.CMB.1.raw
  modified_base (197)..(197): a, c, t, g, unknown or other
  misc_feature (197)..(197): n is a, c, g, or t
tcagacagtatatacacgaccggtgctcgatttagtgagtcagtaagggaaaggggatcaggacttctcagttcatcttctcaccatgaggctccctgctcagctccgtggggctgactaatgctcgtggactcccgtcggacccaggtgcgaagtagttggttgtggaccttacgacccacgtcccttcccccttnttccctcttcgtcccgtccctaccccgtggaaccgccggccccggtccctaccacgttccgtaccgtcgaccgtaacgttccgtacggtacaacggtccgtccccttccgtgacctagttaagggtacgtaaaggttaagggaaactaacgttaagttttaacgtttttaaccggttacggttaccggttaaccggtcggtaacggtaacgggtacgggtaaccggtaccggtacccgtaccggttaccccgacccggtacccttaaccggttccccttaccccttaacgttaacccgtttacgtttaaacgtttaccgttttaacctttttaccccgtaaacggaccccgggttaccccgttccccggttaccggtttacgggttaacggggtacccgtaccggtaaacccggttaagggttaacggtttaccggggtttaccggtacggggtacgggtaccggggtaccgggggggttaccccgggggttacggaacgtttaaacggttaaccggttaaccccaaccgtttaaacgggtaaaagttaacccgggtaccgggaaccgggggggttacgggttacggggacgtaccggggtttaagggtagggtttttacggtttaaagggttttaaggttaaaccgtttttaacggttttaaccggcgggtttaaacacgggttaacggtaccggttaacgttaccgggttaccccgtttttaaccccgggggttaacccgggttttcccccggtaacccgggggttaacccgggtaacggggtttaaaccccgggggaaaggggttaacccgggggtaaaacttaacgggaaccccgtaaaggggtttaccccggtaggttaaccgggggtaacccg

SEQ ID NO: 244557 - DNA, 709 bp, Homo sapiens
  misc_feature: GYAE6OF01E2LIL.44.45.E01.1.454.CMB.1.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatccctggacccagtgcagtatgttgtgctgacccagacctcccctctctctgtcccgtccaccccgtggaccncggcccggccctccagtcgtccgtgacaagtcctacgcagactcccgtctagcatacggtagagtaaggaaacgtactattagtttacgtaacgttcggtaaccgngtaccagggtacggtacgacggtcctacggtcctccgacgtacgtccctcctatacttctattcgttactttccgttacgagtcccgtaccttcgtcgtaggcgtacgcgtaagtacggttacggtcgtaggtcgggtaccggtacgggtccgggggtacgggaacgtaaggttacttacccgaaactaacgtaaacgtaaacgtcggaacggggtccgggtaggacggtcgtagggtaggtaggttaggtttagttaacgtttaactcggtacgtacagtcgacggtacgtacgtaccgttaccggttacccgttaccccggtacccgtacgggaacccggaaacggggtaccggtaagggtaacggtaaccgtacgtaacgtacgtacgtggtacccgg

SEQ ID NO: 244558 - DNA, 519 bp, Homo sapiens
  misc_feature: GYAE6OF01BC0GG.44.45.E01.1.454.CMB.1.raw
  modified_base (246)..(246): a, c, t, g, unknown or other
  misc_feature (246)..(246): n is a, c, g, or t
  modified_base (309)..(309): a, c, t, g, unknown or other
  misc_feature (309)..(309): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
  modified_base (485)..(488): a, c, t, g, unknown or other
  misc_feature (485)..(488): n is a, c, g, or t
  modified_base (490)..(519): a, c, t, g, unknown or other
  misc_feature (490)..(519): n is a, c, g, or t
tcagacagtatatacacgaccggtgctcgatttagtgagtcagtaagggaaagggggctggagtggggtggcagtcatctggtctgatggaagtaaagaatactatggaaactcgtgaagggccgattctccgtctccagagacaattccaagaacaccgtgtatctaacaaatgaaacaatttgagagccgaggactcgctctctattatgtacgagcccatcgttctacgtggggccagggacnccctggtccaccgtcctcctcagcctccaccgaaacggcccatccggtccttccccctggccnccctgcctccgacggtacgcacccgtccgagacgacaacgcggacccgccgtcggggcctcgccgtcggtacaaacggtacttaaccgttcctaatacgttacctgtaccgtaggacggtcggggaccttgggacgtaaacgggccganaacgttagactagnactgactnangannnnannnnnnnnnnnnnnnnnnnnnnnnnnnnnn

SEQ ID NO: 244559 - DNA, 777 bp, Homo sapiens
  misc_feature: GYAE6OF01EUVDJ.44.45.E01.1.454.CMB.1.raw
tcagacagtatatacacgaccggtgctcgatttagtgagtcagtaagggaaaggggatcaggacttctcagttcatcttctcaccatgagctccctgctcagctccgtgggctgctaatgctctggactccctggacccagtgcagtatgttgtgctcgaccagacctcccctctctctcgtccgtccaccccgtggacacgcccgcctccgattcgtcctgaccgtaagttccgtaagttccgaagtaccgtccccgttccgttgacctagttagtacgaagttaaggaaaacgtaccttagtttagtttacggttaaccgttggttaacccgtgaccgtaagggtacggtacgacggtaccgtacgttcccgtacccgcgtaccgtccttacctactactacttgtacttctttacctacgacgtccgtccttacgtcgttacggtcgtccgtacgtaagttacggttagttaccggtgggtaccgggaaccggtcgggggtccggggtaaggtaaccttagggttccttaacaacgtaaacgtagaaaccgtccgggtacgggggtgggtaaccggcggttagaacgggttaacggttgtttaacgggttattttaaccgttaacgttcgagttagttaaccggcgaacgttaccggtacgtttaccctttacccggttaaccccgggttaccccgtacccggtaaggaacccgggtaacgggttaacgggacgtttaaaccggactaaccggtacgaggttaccgttggtccg

SEQ ID NO: 244560 - DNA, 754 bp, Homo sapiens
  misc_feature: GYAE6OF01B8Z2C.44.45.E01.1.454.CMB.1.raw
  modified_base (204)..(204): a, c, t, g, unknown or other
  misc_feature (204)..(204): n is a, c, g, or t
  modified_base (245)..(245): a, c, t, g, unknown or other
  misc_feature (245)..(245): n is a, c, g, or t
  modified_base (324)..(324): a, c, t, g, unknown or other
  misc_feature (324)..(324): n is a, c, g, or t
tcagacagtatatacacgaccggtgctcgatttagtgagtcagtaagggaaaggggatcaggacttctcagttcatcttctcaccatgaggctccctgctcagctccgtgggctgctaatgctctggactcccgtggacccagtgcagtattgttgtgctcgacccagtacctcccctctctctcgtccgtccacccgtggacncgccgcctcagtcgtcctgacaagtctagtcagcgcctcgngctagtagtagaagaagaatactattagttacgtacgtacgtactgacgaggacgtcgacgacgtcgtccgcgacgtcncctacctagtactagtacgttacgttactttacctacgaccgttcctccgttcgtacggtacggtacgtacgacgtaggtacgttacggtagacgggtacggtacggggacgggggtcggggtaaacgtatacttacgtaacgaacgtaacggaaagtacggcgggtacggggtcgggtacgagtcggtaaggttagtttagtttaagggtaacttttaagtggttacgtacgtagtacgtaccggtaaagtaccggtttacctttaacccgggttaccccggttttaacccggggtcccccggtaaaacggggttacccggaaaacccgggggggttaaaccggttaacgggggttaaaggggttaaaccctaaaacccgggcgggtaaaaaccgggtttcccgggttaaggggttacccgtccccggg

SEQ ID NO: 244561 - DNA, 448 bp, Homo sapiens
  misc_feature: GYAE6OF01AOMZ6.44.45.E01.1.454.CMB.1.raw
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (422)..(448): a, c, t, g, unknown or other
  misc_feature (422)..(448): n is a, c, g, or t
tcagacagtatatacacgaccggtgctcgatttagtgagtcagtaaggggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagcccgtggtccaccgtctcccgtcagccctccaaccaaggggcccactcggtcttccccctggccgccctcgctccgaggagccaccctccgagagccacacggccggccctgggctgcctggtacaaggactaccgttccacggtctacngctgacgnggctggcgaagcgacatagnnnnnnnnnnnnnnnnnnnnnnnnnnn

SEQ ID NO: 244562 - DNA, 420 bp, Homo sapiens
  misc_feature: GYAE6OF01BETSU.44.45.E01.1.454.CMB.1.raw
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (409)..(420): a, c, t, g, unknown or other
  misc_feature (409)..(420): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagacaccgtgtatctacaaatgaacaatttgagagccgaggactcggctctctattattgtacgagcccatcgttctactggggccagggagccctggtcaccgtctcctcagcctcaccaaggcccatcggtcttcccctgccgtccctgtctccnggacgcacctcgagagcacngtcggccgtggctgccgtggtcaggtactacgttcctatactactgtcctggacgtcgggagtcggcgaacggcgacaatgnnnnnnnnnnnn

SEQ ID NO: 244563 - DNA, 621 bp, Homo sapiens
  misc_feature: GYAE6OF01AEO75.44.45.E01.1.454.CMB.1.raw
  modified_base (212)..(212): a, c, t, g, unknown or other
  misc_feature (212)..(212): n is a, c, g, or t
  modified_base (274)..(274): a, c, t, g, unknown or other
  misc_feature (274)..(274): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(586): a, c, t, g, unknown or other
  misc_feature (585)..(586): n is a, c, g, or t
  modified_base (589)..(589): a, c, t, g, unknown or other
  misc_feature (589)..(589): n is a, c, g, or t
  modified_base (591)..(593): a, c, t, g, unknown or other
  misc_feature (591)..(593): n is a, c, g, or t
  modified_base (595)..(602): a, c, t, g, unknown or other
  misc_feature (595)..(602): n is a, c, g, or t
  modified_base (604)..(611): a, c, t, g, unknown or other
  misc_feature (604)..(611): n is a, c, g, or t
  modified_base (613)..(621): a, c, t, g, unknown or other
  misc_feature (613)..(621): n is a, c, g, or t
tcagacagtatatacacgaccggtgctcgatttagtgagtcagtaagggaaaggggctggagtgggtggcagtcatctggtctgatggaagtaaagaatactatggaaactcgtgaagggccgattctccgtctccagagacaatccaagaccacgtgtatctacaatgaactatttgagagccgaggactcggctctctattactgtacgngccctagttcgttctacggtcggggcccgagggtaccgccgtcggtccaccgtcctccgtanacgtccctacccgaacccggacggtcccctacgttccccggttccctttcccccggtcgggccccgtccccctagggtccccctaccggaacccggccggtaccccgacccgttaccgaacgggtccgacgaacccgtcgggcccccggggtccctcgggggcctttacccggcggtaacccgggaacgttaaacccgggtacctttacccggttaccttacggtaacttaccgtgggttcgtggccgggtacggccttagggcctaacggggcttacgacgtgacgncgnacgncnagtcgcancngncnngcncnnncnnnnnnnncnnnnnnnngnnnnnnnnn

SEQ ID NO: 244564 - DNA, 667 bp, Homo sapiens
  misc_feature: GYAE6OF01A9AWU.44.45.E01.1.454.CMB.1.raw
  modified_base (176)..(176): a, c, t, g, unknown or other
  misc_feature (176)..(176): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagtattggttgtgctgacccagacctcccctntctctcgtcccgtccaccctggaccacgccgctcgatcgtcctgctaacgtctagcagctcctcngcatgagataggaacntattgttcnctggacctgnacgtggtcagcctagtccncgntactccgtactgacttgtattcgtaactttcgaacgtaccgtcctcccttctcgggttaggtaccgtcgaacggttaggtacgttaccgggtgtacgggtccggtacggtacgggtaccggggtacggggtaacgtacggttacgttaccgtaacgtaacgtaacgtaaccggtacggtaccgggtacgggtacgggtacggtacggtacggtacggttacggttagttacggtttaacgtttacgttacgttacgtacgttacgtacgtacgtacgtacgtacgttccgtacccggttcccggtcgtaccggtactacgggggggggggtactacgggtacgtacgacgacggtcgtacgtcggtcgg

SEQ ID NO: 244565 - DNA, 743 bp, Homo sapiens
  misc_feature: GYAE6OF01CYKIS.44.45.E01.1.454.CMB.1.raw
  modified_base (175)..(175): a, c, t, g, unknown or other
  misc_feature (175)..(175): n is a, c, g, or t
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatcccctggacccagtgcagatgttgtgctgacccagacctcccctntctctcgtccgtcacccctggacagcccggcctccatcgtcctgactaacgtctagtcagacgcctcngctatagtgataggaaanactattatttagtactcggtacctgacaggaggtccaggcctacgtccgtccggacacgtccttcctacaacgttctaattacgtacttttcctttacgaacgtcccgttaccttcgttcggtagggtacgtaccggacccgtaagggttaacgtttacgggtttaccagggttcgggaccgtaacgggggtccgggggtacgggtaactacgttaacgtttacccgaacgtaacgtaaagtaaacgtccggacggggtacccggggttagggcggtacggttaggagggttaagttgggttaacgtttaaattttaccgttaagtcggtattacggtacggtacgaaacggttcttacgttaaacccggttccggttttaaccccccggggaccgttttaccggggaccgggtaaacggggtaccccgtaagggggtacgtaaaacgtaccggtaggtaaccgtacggttcggtaaccggg

SEQ ID NO: 244566 - DNA, 572 bp, Homo sapiens
  misc_feature: GYAE6OF01CGOGG.44.45.E01.1.454.CMB.1.raw
  modified_base (509)..(509): a, c, t, g, unknown or other
  misc_feature (509)..(509): n is a, c, g, or t
  modified_base (535)..(536): a, c, t, g, unknown or other
  misc_feature (535)..(536): n is a, c, g, or t
  modified_base (538)..(542): a, c, t, g, unknown or other
  misc_feature (538)..(542): n is a, c, g, or t
  modified_base (544)..(572): a, c, t, g, unknown or other
  misc_feature (544)..(572): n is a, c, g, or t
tcagacagtatatacacgaccggtgctcgatttagtgagtcagtaagggaaaggggctggagtgggtggcagtcatctggtctgatggaagtaaagaatactatggaaactccgtggaagggccgattctccgtctccagagacaattccaagaacaccgtgtatctacaaatgaactaatttgagcgcgaggacgtcggctctctattattgtacgacgccctagttcgttctacgtcggggccagggacgtcccgtcggtccacccgttcctccgtcacgtccctacccgaacccgaacggggcccctagttcccggtccctttccccccgttgggccctccccgtcggtccctccggagggccgacccgcccgttaccggacgaccgaccgtaccgaccggtcccggcccccggtggggcccgttcggacccggttcgggtaccaaaccggggtacccttaccgtttacccttagttacttaccgttgttacgtcgacggtcgggngtacggaccgagggccacgtactagnngnnnnngnnnnnnnnnnnnnnnnnnnnnnnnnnnnn

SEQ ID NO: 244567 - DNA, 680 bp, Homo sapiens
  misc_feature: GYAE6OF01AP15P.44.45.E01.1.454.CMB.1.raw
  modified_base (341)..(341): a, c, t, g, unknown or other
  misc_feature (341)..(341): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagcctccctctctctgtccgtcacccctggacacgcccggcctccatcgtcctgcaagtctagtcagacgcctccgtgccagttagtgaagtagggaaaacactaatttatttacggtaacttcggtacctggacaggtaggtccaagggcccagttcccgtcccgacacgccttccctnaacttcttaatcgttactttccgtttaacaacggtccttcccttacgttcgtcgggtacgttcgacccgtaaggtacgtttacggttaccagggtttcgggaccgtagggccgggggtacgggaacgtacggtactttacgaactacgtaaggtaaaactcggaacgggtccgggtaggtaggtacggtggtaagggtattagggtttaagtaattttacgtaagtgtacgtacgtacgtacgaacgtcttacgttccgtacccggttacccggtacgttaccggacggaaccgggtaccgtaagggtacgaaactacggaagacgtacggtggtacgg

SEQ ID NO: 244568 - DNA, 721 bp, Homo sapiens
  misc_feature: GYAE6OF01AGBPB.44.45.E01.1.454.CMB.1.raw
  modified_base (119)..(119): a, c, t, g, unknown or other
  misc_feature (119)..(119): n is a, c, g, or t
  modified_base (185)..(185): a, c, t, g, unknown or other
  misc_feature (185)..(185): n is a, c, g, or t
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
  modified_base (347)..(347): a, c, t, g, unknown or other
  misc_feature (347)..(347): n is a, c, g, or t
  modified_base (397)..(397): a, c, t, g, unknown or other
  misc_feature (397)..(397): n is a, c, g, or t
  modified_base (574)..(574): a, c, t, g, unknown or other
  misc_feature (574)..(574): n is a, c, g, or t
  modified_base (698)..(698): a, c, t, g, unknown or other
  misc_feature (698)..(698): n is a, c, g, or t
tcagacagtatatacacgaccggtgctcgatttagtgagtcagtaagggaaagggatcaggacttctcagttcatcttctcaccatgaggctccctgctcagctccgtgggctgctaangctctggactcccgtggaccctagtcgcagtattggttgtcgctacgacccagcctcccctctctntcgtcctccacccgtggacncgccggtcctcatcgtcctgactaagtctagtcagactcctccgtncagtagtgataggaaatactattagtttgtaccgtggttaccnggacagggtacggtcgaggccctagttcccgtccggaactcgtcctctacgtnttacgtattcgttattcgttacaacggtccgttacttcgtcgtaaggtcncgtacgtaaggttacgtttaggctaacgggtcgacgggtacggggtccgggtaaccgggatacggtttacgtttaccaacggtacgttaaagaaagtcccgaggggtacgggtaggaccgtgtaaaggtgttaggtttacgtttaagttaactttaccggtgtacgcttaaacggtnaacccgggttattccgttaaccggtaccggtttccccgggtaccccggtttacgggtacccgggtaaaccctcgggggttaaacggtaaggttaaaccccgtaaggtacccgttaaaaccgggngttaaaccccgggttttgggccg

SEQ ID NO: 244569 - DNA, 685 bp, Homo sapiens
  misc_feature: GYAE6OF01D7047.44.45.E01.1.454.CMB.1.raw
  modified_base (174)..(174): a, c, t, g, unknown or other
  misc_feature (174)..(174): n is a, c, g, or t
  modified_base (200)..(200): a, c, t, g, unknown or other
  misc_feature (200)..(200): n is a, c, g, or t
  modified_base (662)..(662): a, c, t, g, unknown or other
  misc_feature (662)..(662): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatcccgtggacccagtgcagatgttgtgctgacccagacctcccctntcctctcgtcccgtccaccctggacncggtccgcctccatcgtcctgcaagttctagtcacgagccctctgcatagtgagtaggaaagctagttattgtactggtacctgacgagacgtcaggtccgagttccgtccgcagtcctctactactctatgtacttcttacaggtcctctctcgtggacgtcgctaaggtacgttagttaccgaggtcggacgacggggtccggggttcggggaacctgggttaacctttaccgaaccgtaacggtttaacgaaaacgtccggtacgggtaccgggttagggccgggttagtagggacgttaggttcggtttaaaggtacttttaacgcgttaacggcgtaacgtgaccggtaagttcccgttaaggtttcccttacccggggttttaccccggaaccgtttggggaaacccggtaaacccgggggtacaagggggtaaccgggtaaacctaccgggtaanacccgggtttagtcggggtaacg

SEQ ID NO: 244570 - DNA, 894 bp, Homo sapiens
  misc_feature: GYAE6OF01DY2JE.44.45.E01.1.454.CMB.1.raw
  modified_base (156)..(156): a, c, t, g, unknown or other
  misc_feature (156)..(156): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctcgtgatcccgtggacccagtgcagtattgttgngctacggacccagtacctccccttctccgttctcgtcccgtcctaccccgtggacctacggcccggccttccgagttccgtcctagaccgtaacgttctacggcacgtacgtccctaccgtgacctagttaggtaggtaacgtaacgggaaaactacgtaatttacgttttacgtacgttcggtaacctggtcgaaggtacggtcacgggtccctaggtccgtccgacgtacgtcctccgtatacgttacctagtgtactttccgttaacgaccgtaccgttctaccgttcgagggtactacccggtacggtaaggttaacggtttacgggtacacgggtcggggtaccgtacggggggttaccgggttacccggggaattaccgggtttaactttaacccgaaacgggttaacgttaaaccggtaaacgtccccgggggtacgggtacccggggttagtaccgggttaccggtaaggggacggtttaacgttagggtttaagtttaaccgtttaacggttgtacctaacgggtgttaaccggggtacgttaaacgggtccctttaaacgggtttccccgggttaaaccccgggttaccccgggttaaaccgggttacccgggaaaacccgggggtttaaacccggggaaccccgggggtttaaaagttacccggggtaaaaaaccggtaccccggtaaaggggttacccttaacggggtttaacggttaaccccggg

SEQ ID NO: 244571 - DNA, 676 bp, Homo sapiens
  misc_feature: GYAE6OF01A8L9M.44.45.E01.1.454.CMB.1.raw
  modified_base (574)..(574): a, c, t, g, unknown or other
  misc_feature (574)..(574): n is a, c, g, or t
  modified_base (584)..(584): a, c, t, g, unknown or other
  misc_feature (584)..(584): n is a, c, g, or t
  modified_base (593)..(593): a, c, t, g, unknown or other
  misc_feature (593)..(593): n is a, c, g, or t
  modified_base (639)..(639): a, c, t, g, unknown or other
  misc_feature (639)..(639): n is a, c, g, or t
tcagacagtatatacacgaccggtgctcgatttagtgagtcagtaaggggaaaggggctggagtgggtggcagtcatctggtctgatggaagtaaagaatactatggaaactccgtagaacgggccgattctccgtctccagagacaattccaagacaccgtgtatctaacaaatgaaactattgagacgccgaggacctcggctctctattagtcgacgacgccctagtccgttcacgggtcgggaccgagggacgtcccgtcggtccgtacccgttactccctcgacgcccgtaccaaccggtaacggccctagtccggttccctccccgcggtccgcccgtcgccctcggtaacggaccgtaccctaccgtaccgacgtacgcgtaaccgacggtccgggtaccctagggtccgtccggttaccgtaaggttaccgaaaccggttaaccgttaccgttcccgaaacgttccgtacgtcggtaccgtaggaccggggtccggacggttacggggactaaccgggacgtaacgacggtaacgtcgtagaccggacttggacagcaagcttcgngacgtcgacncacacgacnacgcgacgcgtacgtcgtacgacgcgtctacgcgacgacgctacgngtcgcgagtaggtacgacgagtacgtaggtacggacg

SEQ ID NO: 244572 - DNA, 759 bp, Homo sapiens
  misc_feature: GYAE6OF01BHCLI.44.45.E01.1.454.CMB.1.raw
  modified_base (125)..(125): a, c, t, g, unknown or other
  misc_feature (125)..(125): n is a, c, g, or t
  modified_base (208)..(208): a, c, t, g, unknown or other
  misc_feature (208)..(208): n is a, c, g, or t
  modified_base (406)..(406): a, c, t, g, unknown or other
  misc_feature (406)..(406): n is a, c, g, or t
  modified_base (583)..(583): a, c, t, g, unknown or other
  misc_feature (583)..(583): n is a, c, g, or t
  modified_base (640)..(640): a, c, t, g, unknown or other
  misc_feature (640)..(640): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctntggactccctgggacccagtgcgagagttggttgtgctcgacccagacccttccctctctcgtcgtccgtccacccgtggacncgcccggtcctcattcgtcctcgactaaggtctacgtcacgtaccgccttcgtcgactagttacgtaggtaacggtaaagggaaaactacttaagttttacgtttacgtaccgtttacggtaccgtaggacgaaggtacggttacgaccgggtaccgtacgttcccgccgacgtccgtcccttccgtactcttacttnttacgtttacctttcgtaaaccgtcgtcccttacccttcggtacggtacggacgttccggactaagggttacgtttaggtcgtagggtcgggaccggtcggggtccggggtaacggaacttacggttcttaccccgaaagtacgtaaagggtaacgccggggtaccgggtaacgggnggtaaccgtggaggtttaggtacggttttaggttaaactttgttaacgtcgtaggtnacggtacggtacgaacgttttcctggtttaaccccgtccgggtttacccggcgttaacgggaacggtacggtggtaaacgggacgtaacgcccggaaccgtaagggttccgtggtaccg

SEQ ID NO: 244573 - DNA, 698 bp, Homo sapiens
  misc_feature: GYAE6OF01BSYXU.44.45.E01.1.454.CMB.1.raw
  modified_base (268)..(268): a, c, t, g, unknown or other
  misc_feature (268)..(268): n is a, c, g, or t
  modified_base (542)..(542): a, c, t, g, unknown or other
  misc_feature (542)..(542): n is a, c, g, or t
  modified_base (579)..(579): a, c, t, g, unknown or other
  misc_feature (579)..(579): n is a, c, g, or t
  modified_base (679)..(679): a, c, t, g, unknown or other
  misc_feature (679)..(679): n is a, c, g, or t
tcagacagtatatacacgaccggtgctcgatttagtgagtcagtaagggaaagggatcaggacttctcagttcatcttctcaccatgaggctccctgctcagctcctggggctgctaatgctctggatccctggacccagtgcagattgttgtgctgacccagacctcccctctctctcgtccgtccaccccgtggacacgcccggcctccatcgtcctgacaagtctagtccagacgtcctcctgacagtagtagaagtagggaaanactattatttacgtaccgtaggtacctggacgtaaggacggtacgacgggacctacggttacccgtccgcgacgtcctccttctaacgttcttagttacgttacttttcctttaacgaaccgtcccttcgttaccgttggtacggtcggttacgaccgtaaggtacgtttacgggttcaacgggtcgggacgggtacgggtaccggggggttaccggaacttagttacttacgaactacgtaagaaacttccgggagggtccggggagtacggngtaaggtagtagttaggttaacgtaatttactaggtntacgtagtcgacgtagtcttaccttaccggtacccggtttccccgacggttaccggaccggtaacgggttacggaagggttacgaaaccgttacgggaanaccggttagtgggttaccg

SEQ ID NO: 244574 - DNA, 557 bp, Homo sapiens
  misc_feature: GYAE6OF01AP2BO.44.45.E01.1.454.CMB.1.raw
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (516)..(517): a, c, t, g, unknown or other
  misc_feature (516)..(517): n is a, c, g, or t
  modified_base (519)..(557): a, c, t, g, unknown or other
  misc_feature (519)..(557): n is a, c, g, or t
tcagacagtatatacacgaccggtgctcgatttagtgagtcagtaagggaaaggggctggagtgggtggcagtcatctggtctgatggaagtaaagatactatggaaactcgtgaagggccgattctccgtctccagagacaattccaaagaacaccgtgtatctacaaatgaacaatttgagagccgaggactcggctctctattatgtacgagcccatcgttctacgtggggccagggacgccctggtcaccgtctccctcacgtccctcccaccgaacgggccccacgtccgggtccttcccccgtggccgccccttcgcctccagggcgccacccgtccggagacgtccacgtacggcccggcccctggggcctcggcccgttggtaccgaacgggtaccttaccgtttacccctaagttacttaaccgtttcggttaccgttagggaacggtccggggtcgttacggggaccgaaacggggttcgaccgtaagtacggntacgngtnacgnncnnnnnnnnnnnnnnnnnnnnnnnnnnnnnnnnnnnnnnn

SEQ ID NO: 244575 - DNA, 465 bp, Homo sapiens
  misc_feature: GYAE6OF01AYPM9.44.45.E01.1.454.CMB.1.raw
  modified_base (249)..(249): a, c, t, g, unknown or other
  misc_feature (249)..(249): n is a, c, g, or t
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
  modified_base (436)..(465): a, c, t, g, unknown or other
  misc_feature (436)..(465): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagcgtaggactcggctctctattatgtacgacgcccaattcgttctacgtcggggtccagggacncccgtggtcctaccgtctcctcacgcctccaccgaacgggcccatccggtcctccccgtggccnccctcgctccgagcgtcacctcgancgcacgacgccgccgtaggctcgcctaggacaacggtactacgtccacgttctactcgctgacggccggtctcggacgacggcncgtaagtgcagncnnnnnnnnnnnnnnnnnnnnnnnnnnnnnn

SEQ ID NO: 244576 - DNA, 501 bp, Homo sapiens
  misc_feature: GYAE6OF01B1SXT.44.45.E01.1.454.CMB.1.raw
  modified_base (311)..(311): a, c, t, g, unknown or other
  misc_feature (311)..(311): n is a, c, g, or t
  modified_base (458)..(458): a, c, t, g, unknown or other
  misc_feature (458)..(458): n is a, c, g, or t
  modified_base (460)..(460): a, c, t, g, unknown or other
  misc_feature (460)..(460): n is a, c, g, or t
  modified_base (464)..(501): a, c, t, g, unknown or other
  misc_feature (464)..(501): n is a, c, g, or t
tcagacagtatatacacgaccggtgctcgatttagtgagtcagtaagggaaaggggctggagtgggtggcagtcatctggtctgatggaagtaaagaatactatggaaactccgtgaaggccgattctccgtctccagagacaattccaagaacaccgtgtatctacaaatgaactaatttgagagccgaggactcggcttctctattattgtacgagcccatcgttctacgtggggccagggacgccctggtcacccgtctcctcacgcctccaccaacgggcccacgtccggtccttccccgtggcccnccctcgcctccgagggacgccaccctccgagacgcaccacggccggcccgtgggcctcggcctgggtacaaccgggtacttaccttaccctatacctatcgtcttggcgtcggggtctcggacgtaacgggcgacgaacgttgatgnancagnnnnnnnnnnnnnnnnnnnnnnnnnnnnnnnnnnnnnn

SEQ ID NO: 244577 - DNA, 402 bp, Homo sapiens
  misc_feature: GYAE6OF02GLJ3J.44.45.E01.1.454.CMB.1.raw
  modified_base (398)..(402): a, c, t, g, unknown or other
  misc_feature (398)..(402): n is a, c, g, or t
tcagacagtatatacacgaccggtgctcgatttagtgagtcagtaagggaaagggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatagnnnnn

SEQ ID NO: 244578 - DNA, 402 bp, Homo sapiens
  misc_feature: GYAE6OF02JD60V.44.45.E01.1.454.CMB.1.raw
  modified_base (395)..(402): a, c, t, g, unknown or other
  misc_feature (395)..(402): n is a, c, g, or t
tcagacagtatatacacgaccggtgctcgatttagtgagtcagtaagggaaagggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccagggcccatcggtctcccctggcgccctgctccaggagcacctccgagacgcacagtggccctgggctgcctggtcaaggctacttcctatatactgtctgagcgggctggcaaggcgcatagnnnnnnnn

SEQ ID NO: 244579 - DNA, 579 bp, Homo sapiens
  misc_feature: GYAE6OF02I5SN8.44.45.E01.1.454.CMB.1.raw
  modified_base (172)..(172): a, c, t, g, unknown or other
  misc_feature (172)..(172): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctntctctgtccgtcacccctggacagccggcctccatgtccagcaagtctagtcagagcctcctgcatagtgatggaaagacatatttgtactggtacctgcagaggtcaggccagtctccgcagctcctcatctatgtattctttcaagtccgcctctctggagtcgaccagataggttcagtgcaggcgggtcgggacagatttcacactagaaatcaggccgggtggaggctgaggattggttaggtaaattttagttaacgtgtactagttgacgtaaaggtcctaagtttcgtaaccggttttcccccgggtaacctttccgggtaacccgtaaacggggtaacccgtaagggggttaacggaaacggttaccggaaaggtaccggtaaccgttaggtaccggg

SEQ ID NO: 244580 - DNA, 399 bp, Homo sapiens
  misc_feature: GYAE6OF02F0LWK.44.45.E01.1.454.CMB.1.raw
  modified_base (394)..(399): a, c, t, g, unknown or other
  misc_feature (394)..(399): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattatgtacgagcccatcgttctactggggccagggagccctggtcaccgtctcctcagcctccaccaagggcccatcggtcttccccctggctccctgctccaggagcacctccgagagcacagcggccctgggctgcctggtcaaggactacttcctatattctgagcgggctggcaaggcgcatagnnnnnn

SEQ ID NO: 244581 - DNA, 568 bp, Homo sapiens
  misc_feature: GYAE6OF02H6C9M.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacagccggcctccatgtcctgcaagtctagtcagagcctcctgcatagtgatggaaagacatatttgtactggtacctgcagaggtcaggccagtctccgcagctcctcatctatgtattctttcaagcgcctctctggagtgccagataggttcagtggcaggcgggtcggggacagtatttcacgactagaaactcgaggccgggtggaggcgtaggaggagtggttaggtaattttagttacgtgcgtattcggactaaacggctaagtttccgtaacggttttcccccggtaacgtttaccgggacccgtaaacggggtacccgaaggggttacggaaacgttaccgaacggtacggtaacgtggttacggg

SEQ ID NO: 244582 - DNA, 556 bp, Homo sapiens
  misc_feature: GYAE6OF02GSIY4.44.45.E01.1.454.CMB.1.raw
  modified_base (292)..(292): a, c, t, g, unknown or other
  misc_feature (292)..(292): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacagccgcctccatgtcctgcaagtctagtcagagcctcctgcatagtgatggaaagacatatttgtactggtacctgcagaggtcaggccagtctccgnagctcctcatctatgattctttacaagcgcctctctggagtcgccagataggttcaggtggcaggcgggtcgggacagtatttcactactagaaaatcgaggccgggtaggagcgtagaggtagtggttaggtaattttagttacgtggtactagtcgacgtaagggtctagtttaccgtacggtttacccccggaccgtttaccggaccggtaacgggtaaccgtagggtaacggaacgtacgaaggacgtaacggtgtacgg

SEQ ID NO: 244583 - DNA, 405 bp, Homo sapiens
  misc_feature: GYAE6OF02G107K.44.45.E01.1.454.CMB.1.raw
  modified_base (400)..(405): a, c, t, g, unknown or other
  misc_feature (400)..(405): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatacgnnnnnn

SEQ ID NO: 244584 - DNA, 682 bp, Homo sapiens
  misc_feature: GYAE6OF02ICAKR.44.45.E01.1.454.CMB.1.raw
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
tcagacagtatatacacgaccggtgctcgatttagtgagtcagtaagggaaagggatcaggacttctcagttcatcttctcaccatgaggctccctgctcagctcctggggctgctaatgctctggatccctggacccagtgcagatgttgtgctgacccagacctcccctctctctgtccgtcacccctggaccagcccggcctccatcgtcctgcaagtctagtcagacgcctcctgcattagtgataggaaaagactattatttgtaactggtacctgacagnggtcaggccagtcctccgcagcctcctnattctatgtatttcttacaacgtcgtccctcgttctggtacgtcgccaagtagttacgggttcagggttcgggactaggggtccgggggttacggggactaggtactttacgaaccgtacgtaagaaaactcggaagggcccggggttaggaacggtcgttagggaacgggttagtttacgggttttaaggttaaattttttacgtaacgttgaccgttagttcggaacgtaagggtcttaacgttttaccggttaacccggtttttacccccggaacgttttaccgggaacccggtaaaaccggggttaccgtaagggggttaacgaaacgttaccggaaacgggtaccggttaacgtggtaacggg

SEQ ID NO: 244585 - DNA, 404 bp, Homo sapiens
  misc_feature: GYAE6OF02HSOYK.44.45.E01.1.454.CMB.1.raw
  modified_base (398)..(404): a, c, t, g, unknown or other
  misc_feature (398)..(404): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggccccatcggtcttccccctggccgccctgctccaggagcacctccgagagcacagcggcctgggctgcctggtcaaggactacttcctatatactgtctgagcggctggcaggcgcatagnnnnnnn

SEQ ID NO: 244586 - DNA, 669 bp, Homo sapiens
  misc_feature: GYAE6OF02JNIC1.44.45.E01.1.454.CMB.1.raw
tcagacagtatatacacgaccggtgctcgatttagtgagtcagtaagggaaaggggagtacgaggacttctcagttcatcttctcaccatgaggctccctgctcagctcctgggctgctaatgctctggatccctggacccagtgcagatgttgtgctgacccagactccctctctctgtccgtcacccctggacagccggcctccatcgtcctgcaagtctagtcagacgcctcctgcactagtcgatggaaagacatattagtactggtacctgcgagaggtcaggccagtctccgcagctcctcatcctagtcgtatttccttacgaagtccgtcctcttccgtggacgttgcccaggtagtacggttcgaaggtcggactacgggtcggggtacggggatacggtacgttttcgaacgtacgttaaggaaacttaccgacgggtaccgggtgggaacggtcgtagggtacggtagttcgggtttaagggtaaactttttacgtaccgttaggtacgtaacgttaggttacgaaaagggtcccttaagtttcccgaacggttttttaccccccgggaaccgtttgggtaccccggtaaaggggtcccggttaacggggttacggtaacgttaacccgtaagggtacccggtaacgtggttacgggg

SEQ ID NO: 244587 - DNA, 404 bp, Homo sapiens
  misc_feature: GYAE6OF02GN5C3.44.45.E01.1.454.CMB.1.raw
  modified_base (243)..(243): a, c, t, g, unknown or other
  misc_feature (243)..(243): n is a, c, g, or t
  modified_base (398)..(404): a, c, t, g, unknown or other
  misc_feature (398)..(404): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccaggganccctggtcaccgtctcctcagcctccaccaagggcccatcggtcttcccctggcgccctgctccaggagcacctccgagagcacagcggccctgggctgcctggtcaaggctacttcctatatactgtctgagcgggctggcaagggcgcatagnnnnnnn

SEQ ID NO: 244588 - DNA, 420 bp, Homo sapiens
  misc_feature: GYAE6OF02JIJO2.44.45.E01.1.454.CMB.1.raw
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (398)..(398): a, c, t, g, unknown or other
  misc_feature (398)..(398): n is a, c, g, or t
  modified_base (404)..(420): a, c, t, g, unknown or other
  misc_feature (404)..(420): n is a, c, g, or t
tcagacagtatatacacgaccggtgctcgatttagtgagtcagtaagggaaagggggctggagtgggtggcagtcatctggtctggatggaagtaaagaatactatggaaacctccgtgaagggccgacttctccgtcttccagagacaattccaagaacaccgtgtatctacaaatgaacaatttgagagccgaggactcggctctctattatgtacgagcccatcgttctactggggccaggganccctggtcaccgtctcctnagcctccaccaagggcccatcggtcttcccctggcgccctgctccaggagcacctccgagagcacagcggccctgggctgcctggtcaaggctacttcctatactactgtctggagcgggctggcaagggcncatagnnnnnnnnnnnnnnnnn

SEQ ID NO: 244589 - DNA, 415 bp, Homo sapiens
  misc_feature: GYAE6OF02I314B.44.45.E01.1.454.CMB.1.raw
  modified_base (340)..(340): a, c, t, g, unknown or other
  misc_feature (340)..(340): n is a, c, g, or t
  modified_base (373)..(373): a, c, t, g, unknown or other
  misc_feature (373)..(373): n is a, c, g, or t
  modified_base (407)..(415): a, c, t, g, unknown or other
  misc_feature (407)..(415): n is a, c, g, or t
tcagacagtatatacacgaccggtgctcgatttagtgagtcagtaaggggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccccgtggtccaccgtctcctcacgccctccaccaagggcccatccggtccttccccctggccgccctgctccaggacgcacctccgagacgcacngcgccctgggctgcctggtcaaggctactctanatactgtctgagcgggctggcaagggcgcatagnnnnnnnnn

SEQ ID NO: 244590 - DNA, 408 bp, Homo sapiens
  misc_feature: GYAE6OF02IXA52.44.45.E01.1.454.CMB.1.raw
  modified_base (401)..(408): a, c, t, g, unknown or other
  misc_feature (401)..(408): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggccgccctgctccaggagccacctccgagacgcacagcggccctgggctgcctggtcaaggctactcctatatactgtctgagcgggctggcaagggcgcatagnnnnnnnn

SEQ ID NO: 244591 - DNA, 402 bp, Homo sapiens
  misc_feature: GYAE6OF02FI7X0.44.45.E01.1.454.CMB.1.raw
  modified_base (398)..(402): a, c, t, g, unknown or other
  misc_feature (398)..(402): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagcggccctgggctgcctggtcaaggctacttcctatatactgtctgagcgggctggcaaggcgcatagnnnnn

SEQ ID NO: 244592 - DNA, 531 bp, Homo sapiens
  misc_feature: GYAE6OF02G94HL.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacagccggcctccatgtcctgcaagtctagtcagagcctcctgcatagtgatggaaagacatatttgtactggtacctgcagaggtcaggccagtctccgcagctcctcatctatgattctttcaagcgcctctctggagtgccagataggttcagtggcagcgggtcgggacagatttcacactgaaaatcgaggccgggtggaggctaggaggattggttaggtaattttagttacgtgactatgcaaggctattcgtacgtttaccccggacgttccggaccgtaacgggtaccgtagggtacggtaaacgtcgaacggacggtacgtaggtacgg

SEQ ID NO: 244593 - DNA, 595 bp, Homo sapiens
  misc_feature: GYAE6OF02IX0YO.44.45.E01.1.454.CMB.1.raw
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcaccctggacagccggcctccatgtcctgcaagtctagtcagacgcctcctgcatagngatggaaancatatttgactggtacctgcagaggtcaggccagtcnccgnagcctcctcatctatgtatttcttacaagtccgtcctctctggatcgcctaaggattagggttccaggtggcgaccggcgggtacggggacgtagtatttacacgtactagaaaacgtcgtacgggtccgggtagggacgggagtcggtaggtagttcggttaggttaattttacgttacgttgactagtgacgaacggtcgtacttcgtaaccggtttccccggtaccggttccggaaccgtaacgggaaccggtacgggttaacggaacgtaaccgaacggtacggtaacgtcggtacggg

SEQ ID NO: 244594 - DNA, 402 bp, Homo sapiens
  misc_feature: GYAE6OF02G5XGR.44.45.E01.1.454.CMB.1.raw
  modified_base (397)..(402): a, c, t, g, unknown or other
  misc_feature (397)..(402): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggccgccctgctccaggagcacctccgagagcacagcggcctgggctgcctggtcaaggctactcctatatactgtctgagcgggctggcaaggcgcatagnnnnnn

SEQ ID NO: 244595 - DNA, 646 bp, Homo sapiens
  misc_feature: GYAE6OF02JB2XL.44.45.E01.1.454.CMB.1.raw
  modified_base (611)..(611): a, c, t, g, unknown or other
  misc_feature (611)..(611): n is a, c, g, or t
  modified_base (613)..(614): a, c, t, g, unknown or other
  misc_feature (613)..(614): n is a, c, g, or t
  modified_base (616)..(646): a, c, t, g, unknown or other
  misc_feature (616)..(646): n is a, c, g, or t
tcagacagtatatacacgaccggtgctcgatttagtgagtcagtaagggaaagggggcgtggagtgggtgggcgagtcatctggtctgatggaagtaaagaatactatggaaactaccgtgaagggccgagttctccgtctccagagacaattccaagaacaaccgtcgtatctacaaatagaacaatttagagagaccgaggactcggacgtctctattattgtacgtagcccgactcgttcttaaccgtcgggtccggacgggacggccgtcggtccgtacccgtccgtccgtccgacgcccgtcccacccgaaccgggacccgaccgtaccggttccccgttacccccgtcccggtcccggtcccccgtccggtcccgtccccgtacgggaccggtacccgtacccgtacccggaccggaaccggaccgaaccgaaccggacccgggaccccggtaccgggtccggtccggtccggtccggtaccggtaaccggtaaccgttaacccgttaccgttaaccgttaacgttaaccgttacgttacgttacggtacggtaccgggtaccggtacggtacggaacggtacggaccgtaacgtacgacgacgngnngnnnnnnnnnnnnnnnnnnnnnnnnnnnnnnn

SEQ ID NO: 244596 - DNA, 409 bp, Homo sapiens
  misc_feature: GYAE6OF02HZFIG.44.45.E01.1.454.CMB.1.raw
  modified_base (312)..(312): a, c, t, g, unknown or other
  misc_feature (312)..(312): n is a, c, g, or t
  modified_base (401)..(409): a, c, t, g, unknown or other
  misc_feature (401)..(409): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggngcacctccgagagcacagcggccctgggctgccctggtcaaggactacttccacgtctactgctgagcgggctgggcaaggcgcatagnnnnnnnnn

SEQ ID NO: 244597 - DNA, 548 bp, Homo sapiens
  misc_feature: GYAE6OF02GVQ4X.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacagccggcctcatgtcctgcaagtctagtcagagcctcctgcatagtgatggaaagacatatttgtactggtacctgcagaggtcaggccagtctccgcagctcctcatctatgattctttcaagcgcctctctggagtgaccagtattaggttcaggtggcaggcgggtcgggacagatttcacactagaaaatcgaggccgggtaggacggcgtggaggtagttggttaggtaatttagttacgtgtcagtgacgtaaggctacttcgtacggttttccccggacctttaccgggacccgtaaacgggtaccgtagggtacggtaacgtacgaacggacgtaacgtggtacgg

SEQ ID NO: 244598 - DNA, 587 bp, Homo sapiens
  misc_feature: GYAE6OF02HQ7FW.44.45.E01.1.454.CMB.1.raw
  modified_base (301)..(301): a, c, t, g, unknown or other
  misc_feature (301)..(301): n is a, c, g, or t
  modified_base (376)..(376): a, c, t, g, unknown or other
  misc_feature (376)..(376): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacagccggcctccatgtcctgcaagtctagtcagagcctcctgcatagtgataggaaagcatatttgtactggtacctgcagaggtcaggccagtctccgcagctcctnattcgtatgattcttacaagccgctctcgtggagtcgccaagtataggttcaaggtcggacaggcgggtcggganaggtactttcactactagaaatcgaggccgggtggaggcgtaggaggagttggttaggtaattttagttacgtgtactagttcggacgtaagggtacttacgtttaccgtaccggttttcccccggtaaccgtttacccgggaccgtaaacggggtacccgtaagggtacgggtaaactaccggaaacgggtaccgtaacgttggtacggg

SEQ ID NO: 244599 - DNA, 520 bp, Homo sapiens
  misc_feature: GYAE6OF02GTZGC.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggacagccggcctccatgtcctgcaagtctagtcagagcctcctgcatagtgatggaaagacattattgtactggtacctgcagaggtcaggccagtctccgcagctctcatctatgattctttcaagccgtcctctcgtggatcgactagataggtcaggtgcgaggcggggtcgggagtagtacttacacactagaaaatcgaggccgggtggagcgtagagtagtgttaggtaatttagtatgactagtgacaagctattcgtacgttacccggtactcggaccgtaacggaccgagggtacgaactacgaagcgtacgtgtacgg

SEQ ID NO: 244600 - DNA, 536 bp, Homo sapiens
  misc_feature: GYAE6OF02FO57F.44.45.E01.1.454.CMB.1.raw
  modified_base (302)..(302): a, c, t, g, unknown or other
  misc_feature (302)..(302): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacagccggcctccatgtcctgcaagtctagtcagagcctcctgcatagtgatggaaagacattatttgtactggtacctgcagaggtcaggccagtctccgcagctcctnatctatgattctttcaagcgcctctctggatgccagataggttcagtggcaggcgggtcggggacaggtatttcaacactagaaaatcgaaggccgggtggaggctggaggattggttggtaatttagttactgacagttgacaaggctatttcgacggtttccccggacctttcggcccgaacgggtaccgaaggggttacggaaacgtccgaaaggcggtaacgtggtacgg

SEQ ID NO: 244601 - DNA, 404 bp, Homo sapiens
  misc_feature: GYAE6OF02GDBL3.44.45.E01.1.454.CMB.1.raw
  modified_base (400)..(404): a, c, t, g, unknown or other
  misc_feature (400)..(404): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgcccctgctccaggagcacctccgagagcacagcggccctgggctgcctggtcaaggctacttcctatatactgtctgagcgggctgggcaaggcgcatagnnnnn

SEQ ID NO: 244602 - DNA, 431 bp, Homo sapiens
  misc_feature: GYAE6OF02G5SNR.44.45.E01.1.454.CMB.1.raw
  modified_base (414)..(431): a, c, t, g, unknown or other
  misc_feature (414)..(431): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggacgccctggtccaccgtctcctcacgcctccaccaagggcccatcggtcttcccccgtgccgcccctgctcccgaggacgcacctccgagcgcacgagcggccctggggctcggcctggtacaaggactacgtctatactactgtctgacgcggtctggcaagggcgcatagnnnnnnnnnnnnnnnnnn

SEQ ID NO: 244603 - DNA, 549 bp, Homo sapiens
  misc_feature: GYAE6OF02FXD39.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctgggctgctaatgctctggatccctggacccagtgcagatgttgtgctgacccagactcccctctctctgtccgtcacccctggacagccggcctccatcgtcctgcaagtctagtcagagcctcctgcatagtgatggaaagacatattgtactggtacctgcagaggtcaggccagtctcgcagctctcatctatgtattcttcaagcgctctctggagtgccagataggttcaggtggcaggcgggtcgggacagatttcactacgtagaaaatcgaaggtccgggtaggacgggcgtggagggtattggttacggtaattttagttacgtggtactagtgacgaaggcctagttcgtacgtttaccccggtaccgttccggtaccggaacggtaccgtaagggtacggtaacgtacgaacggacgtaacgtggtacgg

SEQ ID NO: 244604 - DNA, 645 bp, Homo sapiens
  misc_feature: GYAE6OF02G13UO.44.45.E01.1.454.CMB.1.raw
  modified_base (173)..(173): a, c, t, g, unknown or other
  misc_feature (173)..(173): n is a, c, g, or t
  modified_base (252)..(252): a, c, t, g, unknown or other
  misc_feature (252)..(252): n is a, c, g, or t
  modified_base (303)..(303): a, c, t, g, unknown or other
  misc_feature (303)..(303): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctntctctgtccgtcaccctggacacgccgcctcatcgtcctgcaagtctagtcagacgcctcctgcatagtgagtggaaanacattaagtttgtactggtacctgacaggtaggtcaggcctagtcctccgnacgtcctcctcattctaatgtacttctttacaaggtcctcctcttcgtggagtcgaccaagtacgttacggttcgagggttggacgtagggaccggggtacgggacaggtacgtttacgaacgtaacgtaagaaaacgtcgtaacgggaccggggtggacggtcgtaagggtagggtagttcgggttaaggtttaagtttacgtttacgtgttacgtagttcggacgaacggtctaacgtttccgtaccggtttaccccggtacgttcccggaaccggtaaccggtaccggtagggtaacggaaacgttaccggaaacggtaccggtaacgttggtaccggg

SEQ ID NO: 244605 - DNA, 577 bp, Homo sapiens
  misc_feature: GYAE6OF02GYIVG.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacagccggcctccatgtcctgcaagtctagtcagagcctcctgcatagtgatggaaagacatatttgtactggtacctgcagaggtcaggccagtctccgcagctcctcatctatgattctttcaagcgcctctctggatgccagataggttcagtggcaggcgggtcgggacagtatttcacactagaaatcgaggccgggtggaggcgtggaggtagttggttaggtaaattttagttacgtggtacctagttggactaaagggtctaagtttccgtacggttttcccccgggtaacctttaccgggacccgtaaacgggggtacccgtaagggggttacggtaaacgttaccgaaacggtaccggtaaccgttggtaccggg

SEQ ID NO: 244606 - DNA, 404 bp, Homo sapiens
  misc_feature: GYAE6OF02GO0SP.44.45.E01.1.454.CMB.1.raw
  modified_base (243)..(243): a, c, t, g, unknown or other
  misc_feature (243)..(243): n is a, c, g, or t
  modified_base (399)..(404): a, c, t, g, unknown or other
  misc_feature (399)..(404): n is a, c, g, or t
tcagacagtatatacacgaccggtgctcgatttagtgagtcagtaagggaaaggggctggagtgggtggcagtcatctggtctgatggaagtaaaggatactatggaaactccgtgaagggccgattctccgtctccagagacaattccaagaacaccgtgtatctacaaatgaacaatttgagagccgaggactcggctctctattattgtacgagcccatcgttctactggggccaggganccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcatagnnnnnn

SEQ ID NO: 244607 - DNA, 534 bp, Homo sapiens
  misc_feature: GYAE6OF02FHU2G.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctctctctgtccgtcacccctggacagccggcctccatgtcctgcaagtctagtcagagcctcctgcatagtgatggaaagacatatttgtactggtacctgcagagtcagccagtctccgcagctcctcatctatgattctttcaagcgcctctctggagtgccagtactaggttcagtggcgacggcgggtcggggacagatttcacactagaaaatcaggccgggtggaggctggaggattggttaggaattttagttactggctatgcaaggcagtttcacggtttccccggtacgttccggaccgtaacgggtaccgaagggttacggaaacgttaccgaacggcggtaacgtggtacgg

SEQ ID NO: 244608 - DNA, 415 bp, Homo sapiens
  misc_feature: GYAE6OF02GSMOV.44.45.E01.1.454.CMB.1.raw
  modified_base (244)..(244): a, c, t, g, unknown or other
  misc_feature (244)..(244): n is a, c, g, or t
  modified_base (405)..(415): a, c, t, g, unknown or other
  misc_feature (405)..(415): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctacgtggggccaggganccctggtcaccgtctcctcagcctccaccaagggcccatcggtcttccccctggccgcccctgcctccaggcgcacctccgagacgcacagccggccctgggctgcctggtcaaggacctacttccacgtctactgctgagcggctggcaggcgcagtagnnnnnnnnnnn

SEQ ID NO: 244609 - DNA, 763 bp, Homo sapiens
  misc_feature: GYAE6OF02IAIH8.44.45.E01.1.454.CMB.1.raw
  modified_base (192)..(192): a, c, t, g, unknown or other
  misc_feature (192)..(192): n is a, c, g, or t
  modified_base (351)..(351): a, c, t, g, unknown or other
  misc_feature (351)..(351): n is a, c, g, or t
tcagacagtatatacacgaccggtgctcgatttagtgagtcagtaagggaaaggggagtcaggacttctcagttcatcttctcaccatgaggctccctgctcagctctgggctgctaatgctctgactcctggacccagtgcagatgtgtgctgaccagacctccctctctctcgtccgtcacccctggacncgcccggcctcatcgtcctgactaacgtctaacgtcagacgccctctcgactaactgtacgataggaaaagctaatatttagtacgtacggtacctgacgaggtagtccgtacgggtccaaggttcctaccggacctaagggtcccctttacccgttanaccgttaccttaaggttacgttaacttttcccttttaaccgaaccggtccggttacccccttcgtttaccggttagggtaaccgttcgtaccccgtaaaggtacgtttaaccgggtttcaaggggtttcggacgtaacggggtccgggtacggggaactaacggtactttcgaaccgtacgtaacgtaaacgtcgaacgggtacccggggtagacggtacgttaggtaacgggagtttagggttaacggtttaaactttaggttacctagggtacctaagtttccggaaagtaacgttcgtacttacggtaccggttttccccggaaacggttcccggtacgggaaaccggttaacgggaccgggttaaggaaaccggttcgaaacggtacccggtagggtaggttaccggg

SEQ ID NO: 244610 - DNA, 708 bp, Homo sapiens
  misc_feature: GYAE6OF02H9F96.44.45.E01.1.454.CMB.1.raw
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatccctggacccagtgcagatgttgtgctgacccagactcccctctctctgtccgtcacccctggacacgccggcctcatcgtcctgccaagtctagtcagacgcctcctgcattagngatggaaaacanattattgtactggtacctgcagaggtcagcagtcncncagctcncatcatgatttctacaagtccgcctctcgtaggactggacccaagtacgttaaggttccagggttggaccgaagggcggggttacggggaacacgggttactttacgaacgtaacgtaaacggtaaaacttccgaacgggtacccggggtttaggaaaccgggggtacgttaaagggtagggtaacggtttagggtttaaacgggtttaaactttttaacgttacgtacggtacgttacgttaacgggaacgtaaacgggtctttaacccgttaccggtttaacccgggtttaacccccggtacggtttacccgggtaaccggtaaaaccgggtaaccgggtaacggggttaacgggtaaacggttaacccggtaaaggtaacccggtaaccggttaggtaacggg

SEQ ID NO: 244611 - DNA, 690 bp, Homo sapiens
  misc_feature: GYAE6OF02HP8NJ.44.45.E01.1.454.CMB.1.raw
  modified_base (326)..(326): a, c, t, g, unknown or other
  misc_feature (326)..(326): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtcccgtcaccccgtggacagcccggcctccatcgtcctgactaagtctagtacagacgccctctgcaataggtgataggaaaagactattatttgtactggtacctgcgagacggtcgaggccagtccctccgcacgtcctaccctnattctattgtactttcttacgacgccgtccttctacgtggacgtcgacctaggtaacgttacgggttcagggttcggacgtacggggtccgggggtacggggaacctaaggttatttaccgaacgtaacgtaaggtaaaacgtcggaacgggtaccggggtagggaacggtcgtaagggagggtaacgttggtttaaggttaacttttacgtacgtagtacttaagtccggaacgtaaacgggtcttaacgtttccgtaaccgggttttacccccggaacgtttcccgggaacgggtaaacccgggtaaccggtaacggggtaacgaaccggtaaccgaagggtaccgtaacggttggtaccgg

SEQ ID NO: 244612 - DNA, 692 bp, Homo sapiens
  misc_feature: GYAE6OF02GWB84.44.45.E01.1.454.CMB.1.raw
  modified_base (256)..(256): a, c, t, g, unknown or other
  misc_feature (256)..(256): n is a, c, g, or t
  modified_base (295)..(295): a, c, t, g, unknown or other
  misc_feature (295)..(295): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatcccctggacccagtgcagatgttgtgctgacccagacctcccctctctctgtccgtcacccctggacagccggcctccatcgtcctgccaagtctagtcagacgcctcctgcatagtgataggaaanactatatttgtactggtacctgcagaggtcaggcagtcnccgcacgtctcctcatctatgtatttcttacaacgtcgcctcgtctggatcgctagtagttaggttcagggtcggacgacgggtcggggtacggggaaccgtaggtaacgtttaccaacgtacgttaaagtaaaactcggaaccgggtaccggggtagggaacgggtacgtaggtaacgggtaggttaggtttaagggttaaacgtttttaagttacgttacggtaccgtaagttaacggaccgtaaacgggtacgttaacgtttacccgttaaccggttttacccccgggtacccggtttaacccgggtaacccggtaaaccggggtaaccggtaacgggttaacgggaaaccgttaaccgggtaacggtaaccggtaacggttccggttaacggg

SEQ ID NO: 244613 - DNA, 666 bp, Homo sapiens
  misc_feature: GYAE6OF02F5C1T.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtcccgtcacccctggacagcccggcctccatcgtcctgcaagtctagtcagacgcctcctgccatagtgataggaaaagacattatttgaactggtacctgcaggaggtcaggccagtcctccgcagcctcctcatctatgtatttctttcaagtccgtcctctcgtggtacgtcgacccgtaagtacgttacgggttacgtaacgggtcgggaccgtacggggtccgggggttacggggaaccgtaagggtaacttttccgaaaccgtaacgttaaggtaaaaacgtccggtaacgggtaccggggtagggacgggtaccgttaggaacgggtagttagggtttaaggttaacgttttaagttacgtagtacgtagtacgtacgaagtcctagttccgttacggtttacccggtaccgttaccgggaccgtaacgggaccgtagggtaacggtaacgtaccgaacggtaccgtaacggtggtacgg

SEQ ID NO: 244614 - DNA, 713 bp, Homo sapiens
  misc_feature: GYAE6OF02GSWFR.44.45.E01.1.454.CMB.1.raw
  modified_base (172)..(172): a, c, t, g, unknown or other
  misc_feature (172)..(172): n is a, c, g, or t
  modified_base (252)..(252): a, c, t, g, unknown or other
  misc_feature (252)..(252): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagactcccctntctctcgtccgtcacccctggacagccggcctcatgtcctgacaagtctagtcagacgcctctgcatagtgataggaaanactattattgtactaggtactgacaaggtacggtacgacggtcctagtcctaccgacacggtccttaccgtcactacttacgttgtactttccgtttacaacggtccgtccttgtacgtggtaacgtcggaccaaggttactaaggttcgaggtcggacgtacgggtcggggtcgggaactaaggttacgttacaacgtaacgttaacggtaaaacgtccggtaacggggtccggggtaggacggtacgtacgggaacggttgttaagggtttaggttaaacttttagtaaccgtaggttactaacgggttacgaacggtaacgttccgttaacggtttcccgtaaccggggttttaccccggtaaccggtttaccgggtaacccgggtaaacggtaacccgggtaggggttaaaccgtaaaggtcccggtaaagggaacccggttaggttcggtaacggg

SEQ ID NO: 244615 - DNA, 637 bp, Homo sapiens
  misc_feature: GYAE6OF02JDOT5.44.45.E01.1.454.CMB.1.raw
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (520)..(520): a, c, t, g, unknown or other
  misc_feature (520)..(520): n is a, c, g, or t
tcagacagtatatacacgaccggtgctcgatttagtgagtcagtaagggaaagggggatcaggacttctcagttcatcttctcaccatgaggctccctgctcagctcctggggctgctaatgctctggatccctggacccagtgcagatgttgtgctgacccagacctccctctctctgtccgtcaccctggacagccggcctcatgtcctgcaagtctagtcagacgcctcctgcataggtgatagggaaancattagtttcgactggtacctgcagaggtcaggccagtcnccgcagcctctcatctatgtatttcttacgaacgtcgtccttctcgtggacgttcgacctaagtagttacgggtttcgaaggttcgggacctagggggtccgggggtaccggggaataacggtactttaccgaacgtacgttaagaaaacgtccgagggtccgggtaggagggtactagggtacggtagttacgggttaagttaacgttttactacgtgtacgtagnggtaacgtaggtactacgtttaccgtaccggtttacccggtcggttacggacccgtaaacggggtacgtagggttaacgggaaactaccggtaaggaccggttacgtagggtaccgg

SEQ ID NO: 244616 - DNA, 613 bp, Homo sapiens
  misc_feature: GYAE6OF02GZR8K.44.45.E01.1.454.CMB.1.raw
  modified_base (254)..(254): a, c, t, g, unknown or other
  misc_feature (254)..(254): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtccacccctggacagcccggcctccatgtcctgctaagtctagtcagacgcctctgcatagtgatggaaanacattatttgtactggtacctgcaaggaggtcacggccagtcctccgcacgccttcctctattctatgtacttccttagacgtcctccttcgtacgtggactccgactaagtacgttaggtcgtaggtcgacgagggtccggggtagggactagtactttacgactaacgtagtaaactcggacggtcggagggacgtcgtagaggtgttaggttaagttaatttcgtactggtacttagtacggtacgaaggttctaaccgtttccggtacccggtttacccccggtacgttccgggaaccggtaagggtaccgtaggggtaaacgtaactacggtaacggtccggtagtggtaccgg

SEQ ID NO: 244617 - DNA, 711 bp, Homo sapiens
  misc_feature: GYAE6OF02G36EY.44.45.E01.1.454.CMB.1.raw
  modified_base (259)..(259): a, c, t, g, unknown or other
  misc_feature (259)..(259): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggaccagcccggcctccatcgtcctgcaagttctagtcagacgcctcctgcataggtgaataggaaanactattatttcgacttcggtaactgactaggaggtcaggtcctagtcctccgntacgcctcctnattctaagtgttactttccgtttacaacgtccgtacttccgtacggtcgggtacgttccgacctaaggttaaccgtttacgggttaccgtagggttcgggaccggtacggggtaccggggggtaccgggaaccgttaggttaactttaccgaaacgtaaccgttaaggtaaaaccgtccgggaacggggttccggggtagggtaacgggtacgtaagggtaggtacgttagggtttaggtaaactttttagtacttacggtactaggtacgacgtaacgggtactacgtttccggtaacccggtttccccggtaacggttaccggtaaccgggaacgggttacccgagggttaccgtaactaccggaaggtaccggtagtcggtacgg

SEQ ID NO: 244618 - DNA, 661 bp, Homo sapiens
  misc_feature: GYAE6OF02F9ONO.44.45.E01.1.454.CMB.1.raw
  modified_base (171)..(171): a, c, t, g, unknown or other
  misc_feature (171)..(171): n is a, c, g, or t
  modified_base (251)..(251): a, c, t, g, unknown or other
  misc_feature (251)..(251): n is a, c, g, or t
tcagacagtatatacacgaccggtgctcgatttagtgagtcagtaagggaaaggggatcaggacttctcagttcatcttctcaccatgaggctccctgctcagctcctgggctgctaatgctctggatccctggacccagtgcagatgttgtgctgacccagactcccctntctctgtccgtcacccctggacagccggcctccatgtcctgcaagtctagtcagacgcctcctgcatagtgatggaaaanactaattatttagtacttggtaacctgcaagtaggtcacggccagtcctccggcagcctcctcatctatgtattcctttacgaagtccgtccttacgtcgtagggacgttcgaccgtaagtattacgggttaccagggtcggacgtacgggcggggtacgggaacgtaggtactttccgaacgtacgtaagtaaaacgtcgaacgggtaccggggtgggaacggtccgttaaggtaggtaacgttaggttaggttaaacgttttagttaccgtggaactagtacgaacgtaacggacttagttaccgttaaccggtttccccggtaacccggttacggtacccggtaacgggaacccggtaagggttaacggtaaggtaccgaacggtacggtaccgttagggttaccgg

SEQ ID NO: 244619 - DNA, 622 bp, Homo sapiens
  misc_feature: GYAE6OF02IW27F.44.45.E01.1.454.CMB.1.raw
  modified_base (260)..(260): a, c, t, g, unknown or other
  misc_feature (260)..(260): n is a, c, g, or t
  modified_base (343)..(343): a, c, t, g, unknown or other
  misc_feature (343)..(343): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctcgtccgtccacccctggaccacggcccggcctccatcgtcctgacaagtctagtcagacgcctctgcatagtgataggaaanactattattgtactggtacctgcagacgtcgaggccagtcctccgcagcctcctcatctatgtactttcttacacgcctcctntcgtggactcgacctagtagttcggttacagggtcgcgtacgggtccggggtacgggaactagtactttacgaactaacgtaagaaaacgtccgaacgggtccggggtaggacggtcgtagggaggtagttaggttaggttaatttacgtagtcgatagtcgacgaacgtctacgtttaccgtaccggtttacccccggacggttcccggaaccggaaacgggttacccggaagggttaaccggaaactaccgaaacggtaccggtaacggtggtacgg

SEQ ID NO: 244620 - DNA, 651 bp, Homo sapiens
  misc_feature: GYAE6OF02F84Y5.44.45.E01.1.454.CMB.1.raw
  modified_base (347)..(347): a, c, t, g, unknown or other
  misc_feature (347)..(347): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtccgtcacccctggacagcccggcctccatcgtcctgcaagtctagtcagacgccctctgcatagtgataggaaagtacattatttgtactggtacctgcaggaggttcaggcctagtcctccgcacgcctcctcatctatgtactttcctttacaacgtcctccctnttcgtgggacgtcgaccgtaagtacttacgggttcagggttcgggccgtacggggcgggggtaccggggaactaggtactttaccgaacgtacgttaagaaaacgtcgaacgggtcccggggtaggacggtcgtagggaggtagttcgggttaaggtaatttttagttacgtgtacgtagttggaacgaaggtacctacgttaccgtaccgggtttaccccggtacggttaccgggaccggtaaaccgggtaccgtagggggtaacgtaacgtaccggaaacgggtccgtaacgtgggtaacgg

SEQ ID NO: 244621 - DNA, 709 bp, Homo sapiens
  misc_feature: GYAE6OF02JLV2Y.44.45.E01.1.454.CMB.1.raw
  modified_base (175)..(175): a, c, t, g, unknown or other
  misc_feature (175)..(175): n is a, c, g, or t
  modified_base (264)..(264): a, c, t, g, unknown or other
  misc_feature (264)..(264): n is a, c, g, or t
  modified_base (589)..(589): a, c, t, g, unknown or other
  misc_feature (589)..(589): n is a, c, g, or t
tcagacagtatatacacgaccggtgctcgatttagtgagtcagtaagggaaaggggatcaggacttctcagttcatcttctcaccatgaggctccctgctcagctccgtgggctgctaatgctctggatccctggacccagtgcagatgttgtgcctgacccagacctccccctntctctgtcccgtcaccccgtggcacgccggcctccatcgcctgcaacgtctagtcagtcgccctccgtgcatacggtgagtacggaaanactacttagtttgtacgtggttaccctgtacgaaggtacgggttaccaccggtaccggtaccgtccgtcccgacgacggtcctttcccgtaacgtacttcgttaacgttcgtaactttttccgtttaacaacgggcccgtttcccttacgttccggttaggccgttcgaacctagttaacggttcgggttaccgtagggtcgggacgtaccgggggtaccgggggttaccgggatacggttactttaccgagtaacttacgaaaccgtcggaacggtcggggtagacggttcgtaggtggtacgtttagggtcgtttaaagtttnttacgtacgggtatagttcgaacgttaggtactaccgtttcgtaacccggttcccgtaacgtcggaaccggtaaggtaccgtaggtaccgaacgtggtaacgtaccggtagtacggtacg

SEQ ID NO: 244622 - DNA, 435 bp, Homo sapiens
  misc_feature: GYAE6OF02HHQZI.44.45.E01.1.454.CMB.1.raw
  modified_base (416)..(416): a, c, t, g, unknown or other
  misc_feature (416)..(416): n is a, c, g, or t
  modified_base (418)..(435): a, c, t, g, unknown or other
  misc_feature (418)..(435): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggacgccctggtcaccgtctcctcacgcctccaccaagggcccatccggtccttccccctggccgccctgcctcccgaggacgccacctccgagacgcacacgccggccctgggctcgcctggcaaggactactccacgtctactgctggacgcgggctgggcaaggcgacagtagnannnnnnnnnnnnnnnnnn

SEQ ID NO: 244623 - DNA, 447 bp, Homo sapiens
  misc_feature: GYAE6OF02FOUKR.44.45.E01.1.454.CMB.1.raw
  modified_base (438)..(447): a, c, t, g, unknown or other
  misc_feature (438)..(447): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggacgcccctggtcaccgtctccctcacgcctcccaccgaacgggccccagtccggtccttccccccgtgggcccgcccctgcctcccgaggacgccaccctccgagacgccacgacggccggcccgtgggctcggccgtggtcaacggctacttcctatacgttactgtctgacgcgggctggcgaaggcgcgatagnnnnnnnnnn

SEQ ID NO: 244624 - DNA, 744 bp, Homo sapiens
  misc_feature: GYAE6OF02GTDAW.44.45.E01.1.454.CMB.1.raw
tcagacagtatatacacgaccggtgctcgatttagtgagtcagtaagggaaaggggatcaggacttctcagttcatcttctcaccatgaggctccctgctcagctccgtgggctgctaatgctctggactccctggacccagtgcagatgttgtgctgacccagacctccctctctctcgtccgtccacccgtggacagcccggcctcatcgtcctgacaagtctagtcagacgcctctgactaagtagtgagtaggaaaacgtactaagttagtttacgtaccgttacgggtacctggacctaagggtacgggttacgaacgggtaccctaacggttcccgtacccggaccgtacggtcccttacccgtacctaacttccgttaagtacgttacttttaccgtttacgaacgtcccgtaccttcgtcgtaggacgttcgaccgtaagtacgttacggttcaggtcggacgcgggtacggggtacggacgtaacggtactttccaacgtacgtaagtaaaccgtcggaacggggtcgggtacgggtacgcggtaggaacggttagttagggtttaaggttaacttttacggttacgtacgtacgttaacgtcggtaacgtaaggtccttacgtttaccggttacccggtttaccccgggtaacggttaccgggacccggaaacgggtaccggttaaggggtaacggtaacgtaccggtaaccgggtacgtaccggtggtaccgg

SEQ ID NO: 244625 - DNA, 752 bp, Homo sapiens
  misc_feature: GYAE6OF02HOL8H.44.45.E01.1.454.CMB.1.raw
  modified_base (469)..(469): a, c, t, g, unknown or other
  misc_feature (469)..(469): n is a, c, g, or t
tcagacagtatatacacgaccggtgctcgatttagtgagtcagtaagggaaaggggatcaggacttctcagttcatcttctcacatgaggctccctgctcagctcctgggctgctaatgctctggatccctggacccagtgcagatgttgtgctgacccagacctcccctctctctgtccgtccaccctggacacggccgcctccatcgtcctgacaagtctagtcagacgcctcctgctaataggtgattaggaaaagctaagtttatttacgtaacgttcgggttaacccttggacaacgggtacggtacgacgggtaccctacggtcccttccccggagtaccggtcccttacccgtactaatttacttacgttcgttaacttttccgtttacaacgtccgtccccttactcggtggacgttcgaaccgtagtaacggtttcggttaccaagggtttcgggaccgnggggtacccggggggttcgggaacgtaacggttaccttaccgaacggtaacttaaggtaaaaactccgggacgggtaccggggtaggacgggttaccgagggtaacggttagtttggttaacggtttaaacttttgtaacgtggtacgttagtcggaaacgtagggttctaacggtttcggttaacccggtttccccgggtaaccggtacccggtaaccggtaacgggaccggttaacggggtagtaaacgtcccgtaaagggacccttaagggtgtaaccgg

SEQ ID NO: 244626 - DNA, 722 bp, Homo sapiens
  misc_feature: GYAE6OF02I4AKN.44.45.E01.1.454.CMB.1.raw
  modified_base (216)..(216): a, c, t, g, unknown or other
  misc_feature (216)..(216): n is a, c, g, or t
  modified_base (290)..(290): a, c, t, g, unknown or other
  misc_feature (290)..(290): n is a, c, g, or t
  modified_base (429)..(429): a, c, t, g, unknown or other
  misc_feature (429)..(429): n is a, c, g, or t
tcagacagtatatacacgaccggtgctcgatttagtgagtcagtaagggaaaggggatcaggacttctcagttcatcttctcaccatgaggctccctgctcagctccgtgggctgctaatgctctggatccctggacccagtgcagatgttgtgctgacccagacctcccctctcctctcgtccgtccaccctggacacgcccgcctcatcgtccngactaagtctagtcagacgtcttcctgctatagtgagtagaaagactattattagtacgtggtactgacgtagngtaccgacggccgtacgtccgtacccgagtacgtcccttcctagacttcttatacgttacttttcttaacgacgtccgttacccttcgtacgtcggtacgtcgtaccgtaagtacgtttacggtagtaggtcggaccgnggggtaccggggtacggactaacggttacgtttacgaaccgttaagtagtaaaccgcggtaacggggtaccgggtagggacggtcgtacggtaaggtaggtttaaggttaagttacgttttagtaccgtgtaccgtaagttcgaaacgtaacggttcttaaccgttaccgggtttaccccgttaaccccgggcgttacccgggtaacccggtaaaccggggtaaccggttacgggtaaaaccggttaacgtacccggtaaacggtacccgggtttaaccggtcggttacccgg

SEQ ID NO: 244627 - DNA, 636 bp, Homo sapiens
  misc_feature: GYAE6OF02GGL8N.44.45.E01.1.454.CMB.1.raw
  modified_base (243)..(243): a, c, t, g, unknown or other
  misc_feature (243)..(243): n is a, c, g, or t
  modified_base (262)..(262): a, c, t, g, unknown or other
  misc_feature (262)..(262): n is a, c, g, or t
  modified_base (403)..(403): a, c, t, g, unknown or other
  misc_feature (403)..(403): n is a, c, g, or t
  modified_base (630)..(630): a, c, t, g, unknown or other
  misc_feature (630)..(630): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatccctggacccagtgcagattgttgtgctgacccagacctcccctctctctcgtccgtccaccctggacacggcccgcctcatcgtcctgacagtctagtcagacgtcctcctnactatagtgagtaggaaanactattagtttagtacgtaggtacctgacgtaggtacggtcacggacctacgtccgtccgacacgtcctaccgtctacttactagttcgtactttccgttacacgtccgtctcgtcgtagtgtcgactagtagttacgtgngtcgcggagggcgggtcggactaggttacttaccgactaacgtaagtaaacgtcggacgggtcgggtagggacggtcggtaggaacggttagttacggttaagttaacttttacgttctacgtacgtagtacgacgtaagtcttacgttccgtaccggttccccggtacgtacccgggtaaccgaacgggtacgtacgggtaagtaacgtacgacgtacggtaccgnggtacg

SEQ ID NO: 244628 - DNA, 775 bp, Homo sapiens
  misc_feature: GYAE6OF02IDPTL.44.45.E01.1.454.CMB.1.raw
tcagacagtatatacacgaccggtgctcgatttagtgagtcagtaagggaaaggggatcaggacttctcagttcatcttctcaccatgaggctccctgctcagctccgtggggctgctaatgctctgggtctcagggtccagtggagatattataatgactcagtcctccccctctcccgtggcccgtccaccccgtggacgacggcccggcctacccatccttcctggtaggtctagtggagtagttcgttagggaggtcaagaactatacttagtggtggtaccgttggttaccttgacgaaggaaacggaccggggcagtacctaccaacctaaccgttcctagtacttcgtttagttttcggttcctacggtccgggtccggttccgggttctcgtacggtactaggttaccgacggttcgaccgtaggtcgacctacgtacccgaacctaaccgtaacttacggttaactttaccgaaccgtaccgttacgaccctaactaccgtacacgggacgaaaggtacgggtacggacgggtcgtacggtaacggtacgttcgggttaggggttccttaacgtttacgtacgtacgttaaccgttacccgttaaacgtttaccctaaaccccgttaaacccccgtttaccgtaaccggtaaccgggtaaccgaacgggtaccctaacggttaacggttacggaacgttaacgttaaccggtaaccggtaacggttcgggtacggtacccgtacggtacctacccgttagtacccg

SEQ ID NO: 244629 - DNA, 697 bp, Homo sapiens
  misc_feature: GYAE6OF02F38N1.44.45.E01.1.454.CMB.1.raw
  modified_base (176)..(176): a, c, t, g, unknown or other
  misc_feature (176)..(176): n is a, c, g, or t
  modified_base (200)..(200): a, c, t, g, unknown or other
  misc_feature (200)..(200): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
tcagacagtatatacacgaccggtgctcgatttagtgagtcagtaagggaaaggggatcaggacttctcagttcatcttctcaccatgaggctccctgctcagctcctgggctgctaatgctctggactcccgtggacccagtgcagattgttgtgttcgacccagacctcccctntctctgtcccgtcacccgtggacncgccgcctcatcgtcctgctaagtctagtcagacgtccctctgactagtaggtgaagtaaggaaatactattagtttcgtactcggtactgcaaggnggtcacggctagtccnccgnaccgtctcctatacgttactagttacgtactttcgttacgacgtcccgtcctttgtcgtagggacgttcgaccgtaagttacgttcgggtacgaggtcgggacgacggggtccggggacggtactaggttacttcgaaccgtaataacggaacgttcggacgggtacggggtaggacggtacgttagggaagtttaggtttacgggtttaaacttaagttttaacgtaccggtgtaaaccggttggtaacgaaccgtacggttctttaaccgttacccggtttaccgggttaccccggacggtttaaacgggacccgttaaacggggtccggtaagggtactaaaccgtacggaacgtcggttaacgtcggtaacgtccg

SEQ ID NO: 244630 - DNA, 428 bp, Homo sapiens
  misc_feature: GYAE6OF02F2Z3Y.44.45.E01.1.454.CMB.1.raw
  modified_base (418)..(428): a, c, t, g, unknown or other
  misc_feature (418)..(428): n is a, c, g, or t
tcagacagtatatacacgaccggtgctcgatttagtgagtcagtaagggaaaggggctggagtgggtggcagtcatctggtctgatggaagtaaagaatactatggaaactccgtgaaggccgattctccgtctccagagacaattccaagaacaccgtgtatctacaaatgaacaatttgagagccgaggactcggctctctattattgtacgagcccatcgttctactgggccagggagccctggtcaccgtctccgtcacgcctccacctaagggcccaatccggtccttcccccgtcggccgcccctcgcctccaggtagccacctccgagagcacagcgccctgggcctgcctggtcaaacgggacctacttccacgtctactgcttagagcgggctggcaacggcgcatagnnnnnnnnnnn

SEQ ID NO: 244631 - DNA, 538 bp, Homo sapiens
  misc_feature: GYAE6OF02HL5Q4.44.45.E01.1.454.CMB.1.raw
  modified_base (250)..(250): a, c, t, g, unknown or other
  misc_feature (250)..(250): n is a, c, g, or t
  modified_base (315)..(315): a, c, t, g, unknown or other
  misc_feature (315)..(315): n is a, c, g, or t
  modified_base (496)..(496): a, c, t, g, unknown or other
  misc_feature (496)..(496): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (504)..(538): a, c, t, g, unknown or other
  misc_feature (504)..(538): n is a, c, g, or t
tcagacagtatatacacgaccggtgctcgatttagtgagtcagtaaggggaaaggggctggagtgggtggcagtcatctggtctgatggaagtaaagaatactatggaaactccgtgaagggccgattctccgtctccagagacaattccaaagaacaccgtgtatctaacaaatgaaactaatttgagagccgaggactcggctctctattattgacgagcccattcgttctacgtgggggccagggcncccgtggtccaccgtctccctcacgccctccaccgaacgggcccagttccggtccttccccccgnggcccgtcccctgcctccgaggacgcccaccctccggagacgccacgcggcccggcccgtcgggtcctcggcccggttcggtaccgaaacgggtcctttaccttccgtaattacgttacgtcggttcgtaggacgggtccggggtacgtcgggaccgtaaagggtccgacgtagtaacgcngangngtnnnnnnnnnnnnnnnnnnnnnnnnnnnnnnnnnnn

SEQ ID NO: 244632 - DNA, 669 bp, Homo sapiens
  misc_feature: GYAE6OF02IWYOO.44.45.E01.1.454.CMB.1.raw
  modified_base (532)..(532): a, c, t, g, unknown or other
  misc_feature (532)..(532): n is a, c, g, or t
  modified_base (614)..(614): a, c, t, g, unknown or other
  misc_feature (614)..(614): n is a, c, g, or t
  modified_base (634)..(634): a, c, t, g, unknown or other
  misc_feature (634)..(634): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagcgaggactcggctcttctattattgtacgagccctatcgttctacgtggggccagggacgccctggtccaccggtctcctcgacgccctccaccgaaacgggccccaattccggtaccttccccccgtaggtccccgcccgttgccctaccgtaacgggtacgccgtacccgtccgagaacggcctaccgaacggccggtccccgtcgggccttacggccgtacggttacaaacggggtccttaaccgttacccttattaacgtttaactcggttacctagggttaacggccggggttactacggggtaccgtaaacgggtccggtaacgtaaggtttaaaccggngtacgtcgactagcgacacgacgtacgtagacgacgctcgcgtacgtcacgacgacgtcacgcgacgagacgcgtacgtacncgacgacgtacgtacgtacncacgtacgcgtaccgacgtacgtacgaacgcagac

SEQ ID NO: 244633 - DNA, 767 bp, Homo sapiens
  misc_feature: GYAE6OF02G11VR.44.45.E01.1.454.CMB.1.raw
  modified_base (207)..(207): a, c, t, g, unknown or other
  misc_feature (207)..(207): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggactcccgtcggacccaggtgcagattgttgtgctacgaccagtacctccctctctcgtcgtccgtccacccgtggaccncggccgtcctcatcgtcctgactaagtctacgtcacgctccctctgactagtagtaggaagtaacggaaatactagtttagtttacgtaccgtagggtacctggactaagggtaacggtcggacggtaccgtacggttccgtaccggtacgaccggtccttacctactacgttaccgttaatcggtttacttttaccttaacggaccgtcccgttaccgttcgttacgggtacgggtactcgtaacgtaaggttacgtttaacgggttcggtagggtccgggtaacgggacgggggtccgggggtacgggtaactacgtacgttaccgtaaagaacgttaagtaaacgtcgggaaccgggttacgggacggtagggtcgtagggtagttacggtttaggttacgttaaacgttacgtagttacgtacgttaattcgggacttaaggttccttaacggtttccgtaacccgggttacccggttccggaaccggttaccggaacggggtacgtaaccgggtaaggtacggtacgtaacgggtaccgtgggttacggtaccgg

SEQ ID NO: 244634 - DNA, 413 bp, Homo sapiens
  misc_feature: GYAE6OF02I8CYF.44.45.E01.1.454.CMB.1.raw
  modified_base (402)..(413): a, c, t, g, unknown or other
  misc_feature (402)..(413): n is a, c, g, or t
tcagacagtatatacacgaccggtgctcgatttagtgagtcagtaagggaaggggctggagtgggtggcagtcatctggtctgatggaagtaaagaatactatggaaactccgtgaagggccgattctccgtctccagagacaattccaagacaccgtgtatctacaaatgaacaatttgagagccgaggactcggctctctattattgtacgagcccatcgttctactggggccagggacgcccctggtccaccgtctccctcagccctccaccaagggcccatcgtccttccccctggccgccctgcctcccaggacgccaccgtccgagacgcacacgcgccctgggctgcctggtcaggctactcatatctgtctgagcggctggcaggcgacatagnnnnnnnnnnnn

SEQ ID NO: 244635 - DNA, 747 bp, Homo sapiens
  misc_feature: GYAE6OF02IHP76.44.45.E01.1.454.CMB.1.raw
  modified_base (258)..(258): a, c, t, g, unknown or other
  misc_feature (258)..(258): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctctctctgtcccgtcacccctggacagcccggcctccatcgtcctgacaagtctagtccaagcgcctctgctatcgtgataggaaanctattattgtactcggtacctgcaggacggtcacggcctagtcccgtccgacacgtccttccgtactacttcgtaattcgttaacttttccgttcgaacgtccgtcccttcgtaccggttaggtaccgttccgtacccgtaaggtaagtttccgggttacacgggtttcgggaccgtaacgggggtccgggggttacgggaaccgtaaggtaccgtttaaccgaccgtaaacgttaacggtaaacgtccggacgggttaccgggggtaggtacgggacgtagggtaaggacgttttagggttaacggtttaaattttacgtacgtcgtacgaagttcggaaacggtaccgtattaccggtttaccggttaccccgggttttaccccggaacgttttaccccgggaaccgggttaaacgggtaacccggtagggggttaacggtaaccgttaaccgggaaaccgggtacggtacggttacgggttaccgg

SEQ ID NO: 244636 - DNA, 486 bp, Homo sapiens
  misc_feature: GYAE6OF02H23YU.44.45.E01.1.454.CMB.1.raw
  modified_base (441)..(441): a, c, t, g, unknown or other
  misc_feature (441)..(441): n is a, c, g, or t
  modified_base (445)..(445): a, c, t, g, unknown or other
  misc_feature (445)..(445): n is a, c, g, or t
  modified_base (449)..(486): a, c, t, g, unknown or other
  misc_feature (449)..(486): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgggcccatcgttctacgtggggccagggagcccgtggtccaccgtctcctcacgcctccaccaacgggcccatccggtccttcccccgtggccgcccctgcctccgaagggcgcccacctccggagacgccacgagccggccccgtggggcctgccttggtccaagggtacctacttcctatacttactgtctggacgcgggcgtggacgaaggccgataacgaggncgtnacgnnnnnnnnnnnnnnnnnnnnnnnnnnnnnnnnnnnnnn

SEQ ID NO: 244637 - DNA, 518 bp, Homo sapiens
  misc_feature: GYAE6OF02HMR1Z.44.45.E01.1.454.CMB.1.raw
  modified_base (312)..(312): a, c, t, g, unknown or other
  misc_feature (312)..(312): n is a, c, g, or t
  modified_base (343)..(343): a, c, t, g, unknown or other
  misc_feature (343)..(343): n is a, c, g, or t
  modified_base (484)..(518): a, c, t, g, unknown or other
  misc_feature (484)..(518): n is a, c, g, or t
tcagacagtatatacacgaccggtgctcgatttagtgagtcagtaagggaaaggggctggagtggggtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatccgttctactgggggcccaggggagcccctgggtccaccgtcctcctcagcctccaccgaaggcccatccggtccttcccccgtggccnccctgcctccacgcgcaccgtccgagacgcncacgccggccgcgggtcctcggtcccgtggtaccgaacgggtaccttaccgttaccttaatacttaaccgtttcgtcgttcggacgggtccggggtccttacgggaccgtaaacgggccgggtaccaagttaacggctagnnnnnnnnnnnnnnnnnnnnnnnnnnnnnnnnnnn

SEQ ID NO: 244638 - DNA, 772 bp, Homo sapiens
  misc_feature: GYAE6OF02GMSVB.44.45.E01.1.454.CMB.1.raw
  modified_base (173)..(173): a, c, t, g, unknown or other
  misc_feature (173)..(173): n is a, c, g, or t
  modified_base (255)..(255): a, c, t, g, unknown or other
  misc_feature (255)..(255): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctgacccagacctcccctntctctgtccgtcacccctggacagcccggcctccatcgtcctgcaagtctagtcagacgcctcctgcatagtgataggaaanactattatttgtactggtacctgcaggaggtcaggcctagtctccgcagcctcctacatctatgtatttctttacaacgtccgtacccttcgtcgtggacttcgaccgtaggtaattcgggttactagggttcggaccgaggggtccggggggtaccgggggtacgaacggttacttttaccgaaaccgtaacgttaaaggtaaaaaccgtccggtaacggggtacccgggggtaggggaacgggtaccgttagggtaaacgggttaggttaagggttttagggttaaacgtttttaagttaaccggttgtaacccggttaagttaccggtaacggtaaacgggttaccttaacgttttacccggttaaccgggttttacccccccgggtaacccggttttaacccggggaaccccgggttaaacgggggtaaccccggttaaacggggggttaacgggtaaaaccttaacccggggtaaacggtaacccgggttaacggttaccgggtaaccgggg

SEQ ID NO: 244639 - DNA, 793 bp, Homo sapiens
  misc_feature: GYAE6OF02J0WE7.44.45.E01.1.454.CMB.1.raw
  modified_base (149)..(149): a, c, t, g, unknown or other
  misc_feature (149)..(149): n is a, c, g, or t
  modified_base (173)..(173): a, c, t, g, unknown or other
  misc_feature (173)..(173): n is a, c, g, or t
  modified_base (417)..(417): a, c, t, g, unknown or other
  misc_feature (417)..(417): n is a, c, g, or t
  modified_base (657)..(657): a, c, t, g, unknown or other
  misc_feature (657)..(657): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggactccctggaccagtgacagnttgtgtgctcgaccagcctccctntctctcgtcctaccacccgtggaccacggcccggtccctccgacgttcgtccgtcgacgtaacgttcctaaggtccaacggccgtcccttcgtacgtcgtaagtagtagaagttacgggaaaactataagttttacgtttacggttaccgttacggttaaccgtgacgtaaggtacgggtaccgaacggtcccacgttcccggtccggaacgtcctacccgtccctaataacgttcttacggtntccttttcttaccgacgttcccgtccttacttggtacggtcgttcgaaccgtagttaccggtttagggttcacgggtccggtgggtaacccgggggtcggggtaacgggaccgttaaggttaaccgtttaccgaacgtaaaccttaaagggaaacccgttcggacggggttaccggggtcgggtaagttcccggtagggaaggttttcgtaagggttttacgttaacgtttagttaccgnggtactagggatacgttacggtcctttcggttaccgttacccggtttaccggacggttacccggtaacgggaaccgggttaacgtaccgggtaaagaccggttaacggaccgggtaacggttacggtaccggttgg

SEQ ID NO: 244640 - DNA, 656 bp, Homo sapiens
  misc_feature: GYAE6OF02G8DUW.44.45.E01.1.454.CMB.1.raw
tcagacagtatatacacgaccggtgctcgatttagtgagtcagtaagggaaaggggatcaggacttctcagttcatcttctcaccatgaggctccctgctcagctcctggggctgctaatgctctggatccctggacccagtgcagatgttgtgctcgacccagacctcccctctctctcgtccgtccaccctggacacgccggcctccatcgtcctgacagtctagtcagacgcctcctgctatagtgagtaggaaagactaattatttgtacgttacggtacctgacaggacggtcgacggcctagtccgtccgcgacgtccttcctctattactagtgttactttcctttacgaacgtccctccttccgttcgtaggtacgtacgaccgaagttagttacgggttcgacgggttcggacggtacggggtccgggggtaccgggtaactacggttacttacaacgtaacgtaaaggaaactcggacgggtccgggtaggacggtacggtaggtaggtagttaggtttaacgttaatttacgtacgtggactagtgaacgtagtactcgtttaccgtaccggtttccccggacgttccggaaccggtaacgggtaccgtagggtaactaacgtacgaaggtacgtagtggtacgg

SEQ ID NO: 244641 - DNA, 616 bp, Homo sapiens
  misc_feature: GYAE6OF02GM14Z.44.45.E01.1.454.CMB.1.raw
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
  modified_base (317)..(317): a, c, t, g, unknown or other
  misc_feature (317)..(317): n is a, c, g, or t
  modified_base (473)..(473): a, c, t, g, unknown or other
  misc_feature (473)..(473): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatccctggacccagtgcagtattgtgtgctgacccagacctccctctctctcgtccgtcaccctggacacgcccgcctcatcgtctgacaagtctagtcagcncctcctgactagtagngaagtaggaaacactatttattacgtacgtggtacctgactaggtacgtcgacggcctagtcctccgacncgtccctctactacttcgtacttacgtatttccttacgaacgtccgtaccttcgtcgtaggtactcgacctaagtagttacgtcgacgggtgcggacgggtccggggacggaagtagtaccttacaacgtacgttaagaacgtcgacggggtcggngagtgtaggagtagttaggtagttaacttcgcgtntacgnttacgaacgtagtctttacgtacgttcccggttacccgagttaccggaaccggtagggtacgtagggttaacgtaccgtagaaaccggcgttagtcggtacgg

SEQ ID NO: 244642 - DNA, 577 bp, Homo sapiens
  misc_feature: GYAE6OF02IOBT9.44.45.E01.1.454.CMB.1.raw
  modified_base (246)..(246): a, c, t, g, unknown or other
  misc_feature (246)..(246): n is a, c, g, or t
  modified_base (447)..(447): a, c, t, g, unknown or other
  misc_feature (447)..(447): n is a, c, g, or t
  modified_base (450)..(451): a, c, t, g, unknown or other
  misc_feature (450)..(451): n is a, c, g, or t
  modified_base (462)..(462): a, c, t, g, unknown or other
  misc_feature (462)..(462): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagacaccgtgtatctacaaatgaactaatttgagagccgaggactcggctctctattattgtacgagcccatcgttactacgtggggccagggacncccgtggtcctaccgtctcctcacgccctccaccgaacgggccctagtccggttccttcccccgtggccgtccctgccgtaccgaggacgcctacccgtccgagacgccacgacggccggtccgtcgggctcggcctggtcaaggccttacttcctatactactgtctgacgcggtctggacaagggtcacgtagtacgtncgnngtcagtcgacngtactgctagntctcgtacngtcgagtacgtacgntaacgngtacctgactcggtactcgtacttcgctagtcgtactcgagttcccgtcgtaaggttccaacttctcggatccg

SEQ ID NO: 244643 - DNA, 621 bp, Homo sapiens
  misc_feature: GYAE6OF02J1GQE.44.45.E01.1.454.CMB.1.raw
  modified_base (168)..(168): a, c, t, g, unknown or other
  misc_feature (168)..(168): n is a, c, g, or t
  modified_base (210)..(210): a, c, t, g, unknown or other
  misc_feature (210)..(210): n is a, c, g, or t
  modified_base (598)..(598): a, c, t, g, unknown or other
  misc_feature (598)..(598): n is a, c, g, or t
tcagacagtatatacacgaccggtgctcgatttagtgagtcagtaagggaaaggggatcaggacttctcagttcatcttctcaccatgagctccctgctcagctcgtgggctgctatgctctggatccctggacccagtgcagatgttgtgctgaccagacctccctntctctgtccgtcaccctggacacgccggcctccatcgtcctnactaacgtctacgtcagacgtcctacctgcagtagtacgatagggaaacactattatttgaacttggtacctgcaaggtaggtccaggtccaggtcctaccgctaggccttaccctgaacttcgttatagtactttcttacgagccgtacttacgtcgtggtaagtcgacccgaagttacgttcggtcaaggttcgacgaggcggggtcggtacgaagtcgttacacgacgttaagaactacgacgggtaaccggtgacggtcgtagtaggtagttggtacgttaagtttacgttcggtacgacgtagtaggactaaggcttaacttccggtacgtttccccggtaacgtttccggaccgtaacggtaccgtagggtacgtaaacganacggttaccggtatacggttacg

SEQ ID NO: 244644 - DNA, 708 bp, Homo sapiens
  misc_feature: GYAE6OF02HD5AZ.44.45.E01.1.454.CMB.1.raw
  modified_base (199)..(199): a, c, t, g, unknown or other
  misc_feature (199)..(199): n is a, c, g, or t
  modified_base (242)..(242): a, c, t, g, unknown or other
  misc_feature (242)..(242): n is a, c, g, or t
  modified_base (387)..(387): a, c, t, g, unknown or other
  misc_feature (387)..(387): n is a, c, g, or t
tcagacagtatatacacgaccggtgctcgatttagtgagtcagtaagggaaaggggatcaggacttctcagttcatcttctcaccatgaggctccctgctcagctccgtggggctgctaatgctctggatccctggacccagtgcagatgttgtgctgacccagacctcccctctctctcgtccctccacccctggacncggccgcctccatcgtcctgacaagtctagtcagacgcctccngcagtagtgagtaggaaatactattagtttagtacgttcggtactggacgaaggacgggtcacgggtcccaggttccctccgacgtaccgtcctcctcattccgttatgttacttttccttacgacgtcccgtccttcgttacgngggtagtaccgccgtaagtacgttaggtttcgaacgggtcggaccgtaggggtcccgggggtaccgggaacgttacggtactttacccaacgttaacgtaaagtaaacgtccggaacgggggttccgggtagggacggtacgaagggtaaggtagtttagggttaagtttaaacgttttgtaactggactagtacggatacgtacgttacgtttaccgttacccgggtttccccggttaacccggttccggaccgggaaaccgggttacggtaaggggtaaccgtaacgacgtaaccggtacccggtagttgggtacccgg

SEQ ID NO: 244645 - DNA, 630 bp, Homo sapiens
  misc_feature: GYAE6OF02IRM9V.44.45.E01.1.454.CMB.1.raw
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
  modified_base (520)..(520): a, c, t, g, unknown or other
  misc_feature (520)..(520): n is a, c, g, or t
tcagacagtatatacacgaccggtgctcgatttagtgagtcagtaagggaaagggctggagtgggtggcagtcatctggtctggatggaagtaaagatactatggaaactccgtgaaggccgattctccgtctccagagacaattccaagaacaccgtgtatctacaaatgaacaatttgagagccgaggactcggctctctattattgtacgagcccagtccgttctacgtggggccaagggcgcccgtggtcacccgtctcctcncgcctccaccaggccatcgtcttcccngcnccctgctccaggcgcacctccgagacgcctacaggccgtcccgtagggccctggtacctcggggtaccaacggggtccttaaccgttccgtaacttacgttaacttggtacctcgggtagccggggcttacgggaccgaaagggtccggacgtaaagtcggactacgtcgctcgtancctaggccanaggttccgattcgcttcgaaccgttcaaacggtttntacgtacgtacgtacgtacgtacgtacgacgtgtagtcgtacgtacgtacgtacgtacgtacggtaacgtacgtacgtacgtacgtaccgtacgtacgtacgtacgtacg

SEQ ID NO: 244646 - DNA, 741 bp, Homo sapiens
  misc_feature: GYAE6OF02FQIIZ.44.45.E01.1.454.CMB.1.raw
  modified_base (280)..(281): a, c, t, g, unknown or other
  misc_feature (280)..(281): n is a, c, g, or t
tcagacagtatatacacgaccggtgctcgatttagtgagtcagtaagggaaaggggatcaggacgttctcagttcatcttctcaccatgacggctccctgctcagctccgtgggctgctaatgctcgtggatccctggacccaggtcgcgagatgttgttgtcgttagaccctagacctcccctctctcgtcgtccgttccaccccgtggacacggccggacctccgagtcgtcctgcctaagtctagcagacgcctctcgacatagtagagtaggaaannaagtttatttcgtaacgtacggtaaccttggaacgaggtacggtacacggcctacggtccgtacccggctacgtcctccgtatatccgtaagtgttacttcttacaagtcgacttactcgttaggtatccgacgtaagtacttaggtacgagtcggggacgtacggggtacgggtacgggtaactacggttactttaccggaactaacgttaaacgaaacctccgggtaaaccgggtggaaccgttgtaaacggtaaggtatttaacggttagttaaaacgtttaacgttacgtacgttacgaacggttagtaaccggtaaacgttcgttaacgtttacccgttacccgggtttaacccggttacccgttaccggtaaccggaaaccggggttacgtaaacggggtaaccgttaacgtacccggtaaaggtacccggacgggtttagtaccggttaccgg

SEQ ID NO: 244647 - DNA, 605 bp, Homo sapiens
  misc_feature: GYAE6OF02GGXUV.44.45.E01.1.454.CMB.1.raw
  modified_base (246)..(246): a, c, t, g, unknown or other
  misc_feature (246)..(246): n is a, c, g, or t
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
  modified_base (507)..(507): a, c, t, g, unknown or other
  misc_feature (507)..(507): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (527)..(527): a, c, t, g, unknown or other
  misc_feature (527)..(527): n is a, c, g, or t
  modified_base (531)..(531): a, c, t, g, unknown or other
  misc_feature (531)..(531): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (576)..(576): a, c, t, g, unknown or other
  misc_feature (576)..(576): n is a, c, g, or t
tcagacagtatatacacgaccggtgctcgatttagtgagtcagtaagggaaaggggctggagtgggtggcagtcatctggtctgatggaagtaaagaatactaatggaaactccgtgaagggccgattctccgtctccagagacaattccaagaacaccgtgtatctacaaatgaaactaatttgagacgccgagactcggctctctattattgtacagccatcgttctacgtgggcctagggacncccgtggtcaccgttctcctacgacgcctccaacctaacgggcccaagttccggtacctttcccccgcggccgacccttgcctcgacggacgacctaccgtcccggagacgaccacgacggccggcctcgggacctccgccgttacgacgaaacggtactaccttccgtaattacgtacgtctcgtacgacggacgggtcccgtagggtaccgtaacgggaccgtacaaagttacggngacacgtagacacgtnagacganacgagacanacncacgacgngtanacactacgtactanatananacncgctactactacgctacagtanacgacgtacacgacgtacgactacgagac

SEQ ID NO: 244648 - DNA, 725 bp, Homo sapiens
  misc_feature: GYAE6OF02F2QE0.44.45.E01.1.454.CMB.1.raw
  modified_base (180)..(180): a, c, t, g, unknown or other
  misc_feature (180)..(180): n is a, c, g, or t
  modified_base (566)..(566): a, c, t, g, unknown or other
  misc_feature (566)..(566): n is a, c, g, or t
tcagacagtatatacacgaccggtgctcgatttagtgagtcagtaagggaaaggggatcaggacttctcagttcatcttctcaccatgagctccctgctcagctcctgggctgctaatgctctggctaccctggacccagtgcagattcgttagtgacctgaccctagaccttccccgtnttcctactcgtacccgttcaccccgtagaccgacgcccggtcctaccgattccgtcgtacgaccctaaggtctaacgtcgaacggtaccgtcctaccgtgacctagtacgtagaagttaggaacgtataacgtttactttcgtaaccgttaggttacctcggtacgaaggtacggttacgaaccgtaccgacgttccgtaacccgggctaacggtaccttacctacgttaacgttccttaggtacctttactttaccgttacggaactccgttactcgttacgtagtcgtaaccgcgtaagactttacggtaccaggttacggacggtacgggtaccggggttaacgataacgttacgtaacctaccgtaagtaactaacggtacngggttaaccgggtgtacgacgtacgtagttcgtagttacgtattaccgtatgtaccgattagaaccgtagtaccgttaagtccgtaccgtaccgttaacggaccgtaacggacgttaaccggtaaggaccgtaacgacgaacgtagtaccggagtcccg

SEQ ID NO: 244649 - DNA, 644 bp, Homo sapiens
  misc_feature: GYAE6OF02FSFAW.44.45.E01.1.454.CMB.1.raw
  modified_base (238)..(238): a, c, t, g, unknown or other
  misc_feature (238)..(238): n is a, c, g, or t
  modified_base (304)..(304): a, c, t, g, unknown or other
  misc_feature (304)..(304): n is a, c, g, or t
tcagacagtatatacacgaccggtgctcgatttagtgagtcagtaagggaaaggggatcaggacttctcagttcatcttctcaccatgagctccctgctcagctccgtggggctgctaatgctctggactccctggacccagtgcagatgttgtgctcgacccagacctccccctctctctcgtcccgtacaccccgtggacagcccgcctccatcgtctcgcaacgtctagtcagcncctctgcatagtgataggaaacgacattattgtacgtcggtactgacagcggtcaggtccagtccncgcacgccttcactattctagtgttactttcgttacaagtccgtccttcgtgtggagtccgaccttaagacggttggttcgtaagggtcggacgtacgggtacgggggttcggggaactacggttacgtttaccgaaccgtaacgttaacggtaaactcggacgggtaccgggtgggtacggcgtaggtaaggtagttagttagggttaatttaacgtgtacgtagttaagcgtacgtaagcttacgttaccgttaccggttacccccggtacgtaccggtaaccgtagggtaaccgtaagggacgttaacgaacggtaacggacggtacgtggtaacgg

SEQ ID NO: 244650 - DNA, 732 bp, Homo sapiens
  misc_feature: GYAE6OF02HBFVD.44.45.E01.1.454.CMB.1.raw
  modified_base (254)..(254): a, c, t, g, unknown or other
  misc_feature (254)..(254): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctctggactccctaggaccctagtgcagatgttgtgctgacccagacctccctctctctcgtccgtccaccctggacacgccggcctcactcgtcctacgacaagttacctagtacgacgtaccgtccttccngactaagtagtcgaagtaggaaaatacgtaattacgttagtacgtcggtaacctggacgtaacggtaaggtaccgacgggtaccctaggttcccgaccgcgtaacgtccttaccgtactaacgttactaagttacgttacttttcctaacggaacgtcccgttaccttcgttcgtacgggtacgttcgaaccgtaaggttaacgttaggtaccgtaggtacgggcggtaacgggtccgggggtaacgggaacttaggtactttacgaacgtaacgtaaacgtaaacggtccgtaggggcccgggttaagggacgtcgtaaggagttacggttaagttaggttaaactttcgtaacgtcgtaacgttatacggaaactaggtcttaacgttaccgttaaccggttcccggtaatcccgggaagaacccggtaacggtagtaacggtaacgtaacgtaacggtaaccgtagtacggtacg

SEQ ID NO: 244651 - DNA, 840 bp, Homo sapiens
  misc_feature: GYAE6OF02FOUU7.44.45.E01.1.454.CMB.1.raw
  modified_base (175)..(175): a, c, t, g, unknown or other
  misc_feature (175)..(175): n is a, c, g, or t
  modified_base (677)..(677): a, c, t, g, unknown or other
  misc_feature (677)..(677): n is a, c, g, or t
tcagacagtatatacacgaccggtgctcgatttagtgagtcagtaagggaaaggggatcaggacttctcagttcatcttctcaccatgaggctccctgctcagctcctggggctgctaatgctactggatccctggacccagtgcagatgttgtgctcgacccagacctcccctntctctcgtcccgtacaccccgtgacacgcccgcctccattcgtaccctgacgtaacgtctagtccaagtaccgccctccgtagacctattaggtacgaagttaacgggaaaactactaattttacgtttgtaaccgttcgggtaacctcggtaacgtaggacgggttaccaacgggtacccgtacgtttccgccgacggtacgtcccttaccgtactagttaccttagttaccgttagttttaccttaacgtaacgtcccgttacccgtcttacggttcggtacggtactaccggaagttaacggtttaacggttccgtaaggggtccgggaacggttaccggggaccgggggttacggggaacgttaaacggttaccgtttaaccggaacgttaaacgtaacggtaaacgttaccggtacgggggttaccgggtagggtacgttcggtaacgggtaggttacgttacgggtttaagttaaacgttttaacgtaccggttanacgttaaacggtacgtacgtaacggtactttaccggtttacccgttaacccgggtttaccccggttaacggtaaccgggtaacccgggttaacgggtaacccggttaagggttaacccggaacggttaccggtaaaggtacccggtaacggtcggtaacccgg

SEQ ID NO: 244652 - DNA, 612 bp, Homo sapiens
  misc_feature: GYAE6OF02GUENP.44.45.E01.1.454.CMB.1.raw
  modified_base (218)..(218): a, c, t, g, unknown or other
  misc_feature (218)..(218): n is a, c, g, or t
  modified_base (567)..(567): a, c, t, g, unknown or other
  misc_feature (567)..(567): n is a, c, g, or t
  modified_base (569)..(572): a, c, t, g, unknown or other
  misc_feature (569)..(572): n is a, c, g, or t
  modified_base (574)..(574): a, c, t, g, unknown or other
  misc_feature (574)..(574): n is a, c, g, or t
  modified_base (577)..(581): a, c, t, g, unknown or other
  misc_feature (577)..(581): n is a, c, g, or t
  modified_base (583)..(612): a, c, t, g, unknown or other
  misc_feature (583)..(612): n is a, c, g, or t
tcagacagtatatacacgaccggtgctcgatttagtgagtcagtaagggaaaggggctggagtgggtggcagtcatctggtctgatggaagtaaagaatactatggaaactccgtgaagggccgattctccgtctccagagacaattccaagaacaccgtgtatctacaaatgaactaatttgagagcgaggctcggtctctctattattgtacgacnccctattccgttctacgtcggggccgaggggtgtccgttcggtccaccccgttcctcctccgaccgcccctccccaaccgaaccggggccccaacgtcccggttcccctttcccccccgtgggccccgtcccccgttcggtccctccccgaacgggtaccgcccgtaacccccggttacccggaaggtaccggcccaaccggaccggtcccgggacccccgtggggcccgtcgccggtccggtaccgaacggtaacccttaccttaccgaccggttaccttacgtcgtccgtaggtacgggccgggtcggtacggaccggtaagggcccgtacgaacgttcgactgacncnnnngngcnnnnncnnnnnnnnnnnnnnnnnnnnnnnnnnnnnn

SEQ ID NO: 244653 - DNA, 848 bp, Homo sapiens
  misc_feature: GYAE6OF02GNR3U.44.45.E01.1.454.CMB.1.raw
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
tcagacagtatatacacgaccggtgctcgatttagtgagtcagtaagggaaaggggatcaggacttctcagttcatcttctcaccatgagctccctgctcgagctccgtgggctgctaatgctcgtggactcccgtcggaaccctagcgcagattgtttaggtacctcgaccacgaccctcccctctcgtccgttcgtacccgtcccacccgtgaccncggccccgcctaccgtntccgttccgtgaccgtaacgttccaacgttcgaacgccgtaccctcgtacgaccgtagttaggacgtaaggtaacggtaaacgtaccttaagtttacgtttacgtacgtaccggttaccctggtacgtaccggttaggacgaacccggtaccgtaccggtcccttccgacgttaaccgccgttaaccgtctaacgtttcttaacgttcgtttaacctttccgttaagaccccggttcctccgttacgtccgttaagggcccttagacccgtgttaaaccgggtgtacggtacgcggtacggacggggttcggggaaccgtagtaaccgtttaccgtagaacccgttaacgtaacgttaacgaaaccgggtcgggtaacggggtcggaacgttccgggagttagggttaacgtttaaggttaacggttaagtttaaccgttcggtacgttaaccgtaagtcgaaaggttacccgtagtttacccggttaccgtttaacccgggttaccccgggtttcccggtaaacccgggtccggtaaaaccgggtccgggtttaaccgggacttaaacccgggtccggtaaacgtacccgggttagtaccgggtaaccccgg

SEQ ID NO: 244654 - DNA, 118 bp, Homo sapiens
  misc_feature: GYAE6OF01EWI2G.51.61.F06.1.454.CMB.1.raw
  modified_base (118)..(118): a, c, t, g, unknown or other
  misc_feature (118)..(118): n is a, c, g, or t
tcagcgatcgtatacacgaccggtgctcgatttagctacgctctaagggaaagggcagcgtcactctgttcccaccctcctctcgtagcactctgagcgggctggcaaggcgcatagn

SEQ ID NO: 244655 - DNA, 118 bp, Homo sapiens
  misc_feature: GYAE6OF01BI0ZM.51.61.F06.1.454.CMB.1.raw
  modified_base (118)..(118): a, c, t, g, unknown or other
  misc_feature (118)..(118): n is a, c, g, or t
tcagcgatcgtatacacgaccggtgctcgatttagctacgctctaagggaaagggcagcgtcactctgttcccgccctcctctcgtagcactctgagcgggctggcaaggcgcatagn

SEQ ID NO: 244656 - DNA, 116 bp, Homo sapiens
  misc_feature: GYAE6OF01EQKBC.51.61.F06.1.454.CMB.1.raw
  modified_base (116)..(116): a, c, t, g, unknown or other
  misc_feature (116)..(116): n is a, c, g, or t
tcagcgatcgtatacacgaccggtgctcgatttagctacgctctaagggaaggcagcgtcactctgttcccaccctcctctcgtagcactctgagcgggctggcaaggcgcatagn

SEQ ID NO: 244657 - DNA, 157 bp, Homo sapiens
  misc_feature: GYAE6OF01CKRA7.51.61.F06.1.454.CMB.1.raw
  modified_base (157)..(157): a, c, t, g, unknown or other
  misc_feature (157)..(157): n is a, c, g, or t
tcagcgatcgtatacacgaccggtgctcgatttagctacgctctaagggaagggcacgaccggtgctcgatttagagtgctacgaagggaagggcagcgtcactctgttcccgccctcctctcgtagcactctgagcgggctggcaaggcgcatagn

SEQ ID NO: 244658 - DNA, 117 bp, Homo sapiens
  misc_feature: GYAE6OF01BIZ23.51.61.F06.1.454.CMB.1.raw
tcagcgatcgtatacacgaccggtgctcgatttagctacgctctaagggaaagggcagcgtcactctgttcccgccctcctctcgtagcactctgagcgggctggcaaggcgcatag

SEQ ID NO: 244659 - DNA, 117 bp, Homo sapiens
  misc_feature: GYAE6OF01C8L6F.51.61.F06.1.454.CMB.1.raw
  modified_base (116)..(117): a, c, t, g, unknown or other
  misc_feature (116)..(117): n is a, c, g, or t
tcagcgatcgtatacacgaccggtgctcgatttagctacgctctaagggaaaggcagcgtcactctgttcccgccctcctctcgtagcactctgagcggctggcaaggcgcatagnn

SEQ ID NO: 244660 - DNA, 138 bp, Homo sapiens
  misc_feature: GYAE6OF01ATMAQ.51.61.F06.1.454.CMB.1.raw
  modified_base (119)..(138): a, c, t, g, unknown or other
  misc_feature (119)..(138): n is a, c, g, or t
tcagcgatcgtatacacgaccggtgctcgatttagctacgctctaagggaaagggcgagcgtcactctgttcccgccctcctctcgtagcactctgagcgggctggcaaggcgcatagnnnnnnnnnnnnnnnnnnnn

SEQ ID NO: 244661 - DNA, 115 bp, Homo sapiens
  misc_feature: GYAE6OF01B9LMH.51.61.F06.1.454.CMB.1.raw
tcagcgatcgtatacacgaccggtgctcgatttagctacgctctaagggaaagggcagcgtcactctgttccgccctcctctcgtagcactctgagcggctggcaaggcgcatag

SEQ ID NO: 244662 - DNA, 117 bp, Homo sapiens
  misc_feature: GYAE6OF01BXNEG.51.61.F06.1.454.CMB.1.raw
  modified_base (117)..(117): a, c, t, g, unknown or other
  misc_feature (117)..(117): n is a, c, g, or t
tcagcgatcgtatacacgaccggtgctcgatttagctacgctctaagggaaaggcagcgtcactctgttcccgccctcctctcgtagcactctgagcgggctggcaaggcgcatagn

SEQ ID NO: 244663 - DNA, 120 bp, Homo sapiens
  misc_feature: GYAE6OF01DW1ID.51.61.F06.1.454.CMB.1.raw
  modified_base (118)..(120): a, c, t, g, unknown or other
  misc_feature (118)..(120): n is a, c, g, or t
tcagcgatcgtatacacgaccggtgctcgatttagctacgctctaagggaaagggcagcgtcactctgttcccgccctcctctcgtagcactctgagcgggctggcaaggcgcatagnnn

SEQ ID NO: 244664 - DNA, 120 bp, Homo sapiens; identical to SEQ ID NO: 244663
  misc_feature: GYAE6OF01CG2GK.51.61.F06.1.454.CMB.1.raw
  modified_base (118)..(120): a, c, t, g, unknown or other
  misc_feature (118)..(120): n is a, c, g, or t

SEQ ID NO: 244665 - DNA, 119 bp, Homo sapiens
  misc_feature: GYAE6OF01C1H5A.51.61.F06.1.454.CMB.1.raw
  modified_base (118)..(119): a, c, t, g, unknown or other
  misc_feature (118)..(119): n is a, c, g, or t
tcagcgatcgtatacacgaccggtgctcgatttagctacgctctaagggaaagggcagcgtcactctgttcccaccctcctctcgtagcactctgagcgggctggcaaggcgcatagnn

SEQ ID NO: 244666 - DNA, 117 bp, Homo sapiens
  misc_feature: GYAE6OF01BOYCH.51.61.F06.1.454.CMB.1.raw
  modified_base (117)..(117): a, c, t, g, unknown or other
  misc_feature (117)..(117): n is a, c, g, or t
tcagcgatcgtatacacgaccggtgctcgatttagctacgctctaagggaaagggcagcgtcactctgttcccgccctcctctcgtagcactctgagcggctggcaaggcgcatagn

SEQ ID NO: 244667 - DNA, 115 bp, Homo sapiens
  misc_feature: GYAE6OF02GXI9R.51.61.F06.1.454.CMB.1.raw
  modified_base (115)..(115): a, c, t, g, unknown or other
  misc_feature (115)..(115): n is a, c, g, or t
tcagcgatcgtatacacgaccggtgctcgatttagctacgctctaagggaaggcagcgtcactctgttcccaccctcctctcgtagcactctgagcggctggcaaggcgcatagn

SEQ ID NO: 244668 - DNA, 116 bp, Homo sapiens; identical to SEQ ID NO: 244656
  misc_feature: GYAE6OF02GLYJI.51.61.F06.1.454.CMB.1.raw
  modified_base (116)..(116): a, c, t, g, unknown or other
  misc_feature (116)..(116): n is a, c, g, or t

SEQ ID NO: 244669 - DNA, 119 bp, Homo sapiens
  misc_feature: GYAE6OF02HNDUT.51.61.F06.1.454.CMB.1.raw
  modified_base (118)..(119): a, c, t, g, unknown or other
  misc_feature (118)..(119): n is a, c, g, or t
tcagcgatcgtatacacgaccggtgctcgatttagctacgctctaagggaaagggcagcgtcactctgttcccgccctcctctcgtagcactctgagcgggctggcaaggcgcatagnn

SEQ ID NO: 244670 - DNA, 115 bp, Homo sapiens
  misc_feature: GYAE6OF02HLMU4.51.61.F06.1.454.CMB.1.raw
  modified_base (114)..(115): a, c, t, g, unknown or other
  misc_feature (114)..(115): n is a, c, g, or t
tcagcgatcgtatacacgaccggtgctcgatttagctacgctctaaggaaggcagcgtcactctgttcccacctcctctcgtagcactctgagcgggctggcaaggcgcatagnn

SEQ ID NO: 244671 - DNA, 118 bp, Homo sapiens
  misc_feature: GYAE6OF02HRYV8.51.61.F06.1.454.CMB.1.raw
  modified_base (117)..(118): a, c, t, g, unknown or other
  misc_feature (117)..(118): n is a, c, g, or t
tcagcgatcgtatacacgaccggtgctcgatttagctacgctctaagggaagggcagcgtcactctgttcccgccctcctctcgtagcactctgagcgggctggcaaggcgcatagnn

SEQ ID NO: 244672 - DNA, 117 bp, Homo sapiens
  misc_feature: GYAE6OF02FKQON.51.61.F06.1.454.CMB.1.raw
  modified_base (117)..(117): a, c, t, g, unknown or other
  misc_feature (117)..(117): n is a, c, g, or t
tcagcgatcgtatacacgaccggtgctcgatttagctacgctctaagggaagggcagcgtcactctgttcccaccctcctctcgtagcactctgagcgggctggcaaggcgcatagn

SEQ ID NO: 244673 - DNA, 132 bp, Homo sapiens
  misc_feature: GYAE6OF02FEQ3W.51.61.F06.1.454.CMB.1.raw
  modified_base (115)..(132): a, c, t, g, unknown or other
  misc_feature (115)..(132): n is a, c, g, or t
tcagcgatcgtatacacgaccggtgctcgatttagctacgctctaagggaagggcagcgtcactctgttcccgccctctctcgtagcactctgagcggctggcaaggcgcatagnnnnnnnnnnnnnnnnnn

SEQ ID NO: 244674 - DNA, 121 bp, Homo sapiens
  misc_feature: GYAE6OF02GNA0V.51.61.F06.1.454.CMB.1.raw
  modified_base (117)..(121): a, c, t, g, unknown or other
  misc_feature (117)..(121): n is a, c, g, or t
tcagcgatcgtatacacgaccggtgctcgatttagctacgctctaagggaagggcagcgtcactctgttcccgccctcctctcgtagcactctgagcgggctggcaaggcgcatagnnnnn

SEQ ID NO: 244675 - DNA, 124 bp, Homo sapiens
  misc_feature: GYAE6OF02IIE8N.51.61.F06.1.454.CMB.1.raw
  modified_base (118)..(124): a, c, t, g, unknown or other
  misc_feature (118)..(124): n is a, c, g, or t
tcagcgatcgtatacacgaccggtgctcgatttagctacgctctaagggaaagggcgagcgtcactctgttcccgcctcctctcgtagcactctgagcgggctggcaaggcgcatagnnnnnnn

SEQ ID NO: 244676 - DNA, 159 bp, Homo sapiens
  misc_feature: GYAE6OF02F2EPR.51.61.F06.1.454.CMB.1.raw
  modified_base (159)..(159): a, c, t, g, unknown or other
  misc_feature (159)..(159): n is a, c, g, or t
tcagcgatcgtatacacgaccggtgctcgatttagctacgctctaagggaaagggcacgaccggtgctcgatttagagtgctacgaagggaaagggcagcgtcactctgttcccgccctcctctcgtagcactctgagcgggctggcaaggcgcatagn

SEQ ID NO: 244677 - DNA, 116 bp, Homo sapiens
  misc_feature: GYAE6OF02FGAH2.51.61.F06.1.454.CMB.1.raw
tcagcgatcgtatacacgaccggtgctcgatttagctacgctctaagggaagggcagcgtcactctgttcccaccctcctctcgtagcactctgagcgggctggcaaggcgcatag

SEQ ID NO: 244678 - DNA, 159 bp, Homo sapiens
  misc_feature: GYAE6OF02HFD8Y.51.61.F06.1.454.CMB.1.raw
  modified_base (159)..(159): a, c, t, g, unknown or other
  misc_feature (159)..(159): n is a, c, g, or t
tcagcgatcgtatacacgaccggtgctcgatttagctacgctctaagggaaagggcacgaccggtgctcgatttagagtgctacgaagggaaagggcagcgtcactctgttcccaccctcctctcgtagcactctgagcgggctggcaaggcgcatagn

SEQ ID NO: 244679 - DNA, 145 bp, Homo sapiens
  misc_feature: GYAE6OF02JF26U.51.61.F06.1.454.CMB.1.raw
  modified_base (117)..(145): a, c, t, g, unknown or other
  misc_feature (117)..(145): n is a, c, g, or t
tcagcgatcgtatacacgaccggtgctcgatttagctacgctctaagggaaagggcagcgtcactctgttcccgcctcctctcgtagcactctgagcgggctggcaaggcgcatagnnnnnnnnnnnnnnnnnnnnnnnnnnnnn

SEQ ID NO: 244680 - DNA, 132 bp, Homo sapiens
  misc_feature: GYAE6OF02HFESU.51.61.F06.1.454.CMB.1.raw
  modified_base (118)..(132): a, c, t, g, unknown or other
  misc_feature (118)..(132): n is a, c, g, or t
tcagcgatcgtatacacgaccggtgctcgatttagctacgctctaagggaaagggcagcgtcactctgttcccaccctcctctcgtagcactctgagcgggctggcaaggcgcatagnnnnnnnnnnnnnnn

SEQ ID NO: 244681 - DNA, 126 bp, Homo sapiens
  misc_feature: GYAE6OF02HVXVD.51.61.F06.1.454.CMB.1.raw
  modified_base (126)..(126): a, c, t, g, unknown or other
  misc_feature (126)..(126): n is a, c, g, or t
tcagcgatcgtatacacgaccggtgctcgatttagctacgctctaagggaaaggggctggccctagcgtgttcctgttcccaccctcctctcgtagcactctgagcgggctggcaaggcgcatagn

SEQ ID NO: 244682 - DNA, 128 bp, Homo sapiens
  misc_feature: GYAE6OF01DAE7T.5.59.F04.1.454.CMB.1.raw
  modified_base (128)..(128): a, c, t, g, unknown or other
  misc_feature (128)..(128): n is a, c, g, or t
tcagatcagacacgcacgaccggtgctcgatttagtacacacacttagggattgggcacagcggccctgggctgcctggtcaaggactacttccgtgtctgatctgagcggctggcaaggcgcatagn

SEQ ID NO: 244683 - DNA, 522 bp, Homo sapiens
  misc_feature: GYAE6OF01DG72K.5.59.F04.1.454.CMB.1.raw
  modified_base (196)..(196): a, c, t, g, unknown or other
  misc_feature (196)..(196): n is a, c, g, or t
  modified_base (497)..(497): a, c, t, g, unknown or other
  misc_feature (497)..(497): n is a, c, g, or t
  modified_base (519)..(519): a, c, t, g, unknown or other
  misc_feature (519)..(519): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccacaggccactggcatcccagacaggttcagtgcagcggtctgggacagacttcactctcacatcagcagactggagcctagaagtattttgctagtgtattatgtcagctagtatggtagtctcgtacggacgttcggaccgaagggaccaagggtaggaagtacgaaacgaacgtgtggacgtgacacattttcngttcttcacttccttcccgctntcg

SEQ ID NO: 244684 - DNA, 522 bp, Homo sapiens
  misc_feature: GYAE6OF01BDWKO.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaanaggttcgtagcctggtaccagcagaacctggccaggttcccagcctcctcatctatggtatatccaccagggccactggcatcccagacaggttcagtggcagcgggtctgggacagacttcactctcaccatcagcagactggagcctagaagtatttgctagtgtattactgtcagctagtatggtagctcgacggtacgttcggaccgtaagggaccgaaggtaggaaagtacgaaacgaacgtgtaggcgtgacacatctgtcttcatccttcccncctntcg

SEQ ID NO: 244685 - DNA, 522 bp, Homo sapiens
  misc_feature: GYAE6OF01DUBON.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctcctcatctatggtatatccaccagggccactggcatcccagacaggttcagtggcaggcggtctgggacagacttcactctcaccatcagcagactggagcctgaagtattttgctagtgtattactgtcagcagtagttggtagctcgacggtacgttcggaccgaagggaccgaaggtaggaaatacgaaacgaacgtgtggcgtcgacaccatctgtcttcatcttcccgctctcg

SEQ ID NO: 244686 - DNA, 532 bp, Homo sapiens
  misc_feature: GYAE6OF01BYPPZ.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggacgcctgaagtatttgctagtgtattactgtcagtcagtatggtagctcgacggtacgttcggaccgtaagggaccgtaaagggtacggaaactacgaaaacgtacgtaggtaggcgtgacacctatctgttcttcattcttctcgtcctac

SEQ ID NO: 244687 - DNA, 522 bp, Homo sapiens
  misc_feature: GYAE6OF01A6G8Y.5.59.F04.1.454.CMB.1.raw
  modified_base (196)..(196): a, c, t, g, unknown or other
  misc_feature (196)..(196): n is a, c, g, or t
  modified_base (519)..(519): a, c, t, g, unknown or other
  misc_feature (519)..(519): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacttggccaggttcccagcctcctcatctatggtatatccaccagggccactggcatcccagacaggttcagtggcagcgggtctgggacagacttcactctcaccatcagcagactggagcctgaagtatttgctagtgtattactgtcagctagtagtggtagctcgacggtacgttcggaccgtaagggaccgaagggtaggaagtacgaaacgacgtagtaggcgtgacacatctgtcttcactcttcccgctntcg

SEQ ID NO: 244688 - DNA, 551 bp, Homo sapiens
  misc_feature: GYAE6OF01DHTKV.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcaagaaacctggccaggttcccagcctcctcatctatggtatatccaccagggccactggcatcccagacaggttcagtggcaggcggtctgggacagacttcactctcacatcagcagactgagcctgagatttgcagtgtattactgtcagcagtatggtagctcgacggacgttcggaccgaacgggaaccgaaggtaacggaaagtaacgaaaacgaacgtacggtaggacgtcgacaccctagttactcgttcgttactacttaccgtttccccgtcccgtacttaccg

SEQ ID NO: 244689 - DNA, 520 bp, Homo sapiens
  misc_feature: GYAE6OF01BMUOA.5.59.F04.1.454.CMB.1.raw
  modified_base (195)..(195): a, c, t, g, unknown or other
  misc_feature (195)..(195): n is a, c, g, or t
  modified_base (426)..(426): a, c, t, g, unknown or other
  misc_feature (426)..(426): n is a, c, g, or t
  modified_base (517)..(517): a, c, t, g, unknown or other
  misc_feature (517)..(517): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtgcagcgggtctggggacagacttcactctcaccatcagcagactggagcctagaagtatttgctagttgtattactgtcagctagtatggtancgtcgacggacgttcggacgaacgggaccgaaggtggaatacgaaacgacgtagtaggcgtgacacgtatctgtcttcactcttcccgctntcg

SEQ ID NO: 244690 - DNA, 610 bp, Homo sapiens
  misc_feature: GYAE6OF01D3X3W.5.59.F04.1.454.CMB.1.raw
  modified_base (197)..(197): a, c, t, g, unknown or other
  misc_feature (197)..(197): n is a, c, g, or t
  modified_base (237)..(237): a, c, t, g, unknown or other
  misc_feature (237)..(237): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgttaaccaanaggttcgtagcctggtaccagcaagaaacctggaccaggttcccagtcctcctcatctagtggtatactccacgagggccacgtggcactcccagacaggttcagtggcaggcggtcagggacagtacttcactctcaccatcagcagactggacgcctagtaagtagttttgacgtagttagttattacgtgtacgagtctaagttagtaggtacgtctacgtacggtacggttccggaccgtaacgggaaccgtaagggtaacggaaacgtaacgaaaacggtaacgtacggtacggtacgtcgaccgtaaccgtaacttccgttacgttacccttactacgtttacccgttaccccgtccctacgttacg

SEQ ID NO: 244691 - DNA, 516 bp, Homo sapiens
  misc_feature: GYAE6OF01BSV2D.5.59.F04.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaccaanggttcagcctggtaccngcagaaacctggccaggttcccagcctctcatctatggtatatccaccaggccactggcatcccagacaggttcagtgcagcgggtctgggacagacttcactctcaccatcagcagactgagctgaagatttgcagtgtattactgtcagcagtatggtagctcgacggtacgttcggacctaagggactaaggtaggaatacgaaacgaactgtacggcgtcgacaccgatcgtagttcttacattctttcccgcctacttcg

SEQ ID NO: 244692 - DNA, 520 bp, Homo sapiens
  misc_feature: GYAE6OF01CT0GJ.5.59.F04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (363)..(363): a, c, t, g, unknown or other
  misc_feature (363)..(363): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctntcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactcncaccatcagcagactggagcctgaagtatttgctagtgtattactgtcagcagtatggtagctcgacggacgttcggaccgaagggaccgaaggtaggaatacgaaacgaacgtgtaggcgtcgacaccatctgtcttcactcttcccgtcctatcg

SEQ ID NO: 244693 - DNA, 537 bp, Homo sapiens
  misc_feature: GYAE6OF01AFYTN.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttcccagcctcctcatctatggtatatccaccagggccactggcatcccagacaggttcagtggcagcggtctgggacagacttcactctcaccatcagcagactggagcctgaagattttgctagtgtattactgtcagcagtatggtagctcgacggtacgttcggaccgaagggaccgaagggtaggaaagtacgaaacgaacgtaggtggtacgtcggacaccgacttcgtgttcttctacttccttcccgtcctactcg

SEQ ID NO: 244694 - DNA, 544 bp, Homo sapiens
  misc_feature: GYAE6OF01AU7UR.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcgactctcaccatcagcagactggagctgaagtatttgctagtgtattactgtcagctagtagtggtagcgtcgacggtacggttcggaccgtaacgggtaccgaagggtaggaagtacgaaacgtaacgtaggtacggacgtcgacaccgtactacgtcgttacttctactccttcccgctacgtcg

SEQ ID NO: 244695 - DNA, 568 bp, Homo sapiens
  misc_feature: GYAE6OF01EAT4T.5.59.F04.1.454.CMB.1.raw
  modified_base (196)..(196): a, c, t, g, unknown or other
  misc_feature (196)..(196): n is a, c, g, or t
  modified_base (424)..(424): a, c, t, g, unknown or other
  misc_feature (424)..(424): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctctcatctatggtatatccacaggccactggcatcccagacaggttcagtgcagcggtctggacagacttcactctcacatcagcagactggacgcctagaagtatttgactagttgtattactgtacagctagtatggtanctcgacggtacgttcggaccgtaaggggaccaaagggtacggaaatacgaaaacggtaacgttggtacgggtaccgtcggaccaaccgtagttaccgttagttaccctttacgaacctttcccttccccggtcctacttaccgg

SEQ ID NO: 244696 - DNA, 526 bp, Homo sapiens
  misc_feature: GYAE6OF01D6GZR.5.59.F04.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (390)..(390): a, c, t, g, unknown or other
  misc_feature (390)..(390): n is a, c, g, or t
  modified_base (523)..(523): a, c, t, g, unknown or other
  misc_feature (523)..(523): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctntcctgcagggccagtcagaatgttaccaacaggttcgtagcctggtaccagcagaaacctggccaggttcccagcctcctcatctatggtatatccaccagggccatggcatcccagacaggttcagtggcagcgggtctgggacagacttcactctcacatcagcagactggagcctgaagtnttttgctagtgtattactgtcagcagtagtggtagctcgacgggtacgttcggaccgaagggaccaagggtaggaatacgaaacgtaactgtaggcgtcgcaccgtatctgttcttcacttccttcccgcctntcg

SEQ ID NO: 244697 - DNA, 565 bp, Homo sapiens
  misc_feature: GYAE6OF01B52PD.5.59.F04.1.454.CMB.1.raw
  modified_base (196)..(196): a, c, t, g, unknown or other
  misc_feature (196)..(196): n is a, c, g, or t
  modified_base (239)..(239): a, c, t, g, unknown or other
  misc_feature (239)..(239): n is a, c, g, or t
  modified_base (286)..(286): a, c, t, g, unknown or other
  misc_feature (286)..(286): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
  modified_base (494)..(494): a, c, t, g, unknown or other
  misc_feature (494)..(494): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaaancgccaccctctcctgcgagggccagtcaagaatgttaaccaanaggttcagcctggaccagcaagaaacctggccaggttcccagctccnatctatggtatactccacaggccatgcatcccagacaggttcagtggcaggcgggtctaggggacaggtacttcactcctacacctatcagctagactggacncctaggaatntttagctaaggttcttaattcgtagtnaggtacagttagtgttaagccgttacgacgggtacgttcgaaccgaagggacccaagggttagaaacncgtaaaacgaacgtggtagacgtggacacctagttctacggttcttacgaacttcctttcgccgtcctaag

SEQ ID NO: 244698 - DNA, 563 bp, Homo sapiens
  misc_feature: GYAE6OF01CPD0C.5.59.F04.1.454.CMB.1.raw
  modified_base (164)..(164): a, c, t, g, unknown or other
  misc_feature (164)..(164): n is a, c, g, or t
  modified_base (196)..(196): a, c, t, g, unknown or other
  misc_feature (196)..(196): n is a, c, g, or t
  modified_base (343)..(343): a, c, t, g, unknown or other
  misc_feature (343)..(343): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtcnccaggcaccctgtctttgtctccaggggaaangccaccctctcctgcagggccagtcagaatgtaaccaagtaggttcagcctggtaccagcaagaacctggccaggttccagcctcctcatctatggtatactccacgaggccacgtggcatcccagacaggttcagtgcaggcggtntggacagactcactctcaccatcagcagaccgtggacgccgtgaagtatttgctagtagtattacgtgtacagctagttagtggtagtacgtcgtacggtacgttcggaccgaagggaaccgtaaggtacggaactaacgaaacgtaacgtaggtacgacgtacgacgacctacgttccttcgttacttacctacttccttaccccggtcctagttaccg

SEQ ID NO: 244699 - DNA, 522 bp, Homo sapiens
  misc_feature: GYAE6OF01CCAFD.5.59.F04.1.454.CMB.1.raw
  modified_base (196)..(196): a, c, t, g, unknown or other
  misc_feature (196)..(196): n is a, c, g, or t
  modified_base (426)..(426): a, c, t, g, unknown or other
  misc_feature (426)..(426): n is a, c, g, or t
  modified_base (494)..(494): a, c, t, g, unknown or other
  misc_feature (494)..(494): n is a, c, g, or t
  modified_base (519)..(519): a, c, t, g, unknown or other
  misc_feature (519)..(519): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcaggcgggtctgggacaggacttcactctcacatcagcagactggagcctgaagtatttgctagtgtattactgtcagtcagtatggtanctcgacggtacgttcggaccgaagggaccgaaggtaggaataccgaaacgaactagtaggcgtgcacntctgtcttcacttccttcccgcctntcg

SEQ ID NO: 244700 - DNA, 527 bp, Homo sapiens
  misc_feature: GYAE6OF01C0N23.5.59.F04.1.454.CMB.1.raw
  modified_base (196)..(196): a, c, t, g, unknown or other
  misc_feature (196)..(196): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgtaccacaggttcgagcctggtaccagcagaacctggccaggttcccagcctcctcatctatggtatatccaccagggccactggcatcccagacaggttcagtggcaggcgggtctgggacagacttcactctcaccatcagcagactggacgcctgaagtatttgactagttagttattactgtcagcagtagtggtagtccgttacgacggtacgttaccggaccgtaagggaccgaagggtaggaatacgaaacgacgtgtggacgtgacacatctgtacttcactctcccntntcg

SEQ ID NO: 244701 - DNA, 526 bp, Homo sapiens
  misc_feature: GYAE6OF01B01QP.5.59.F04.1.454.CMB.1.raw
  modified_base (196)..(196): a, c, t, g, unknown or other
  misc_feature (196)..(196): n is a, c, g, or t
  modified_base (499)..(499): a, c, t, g, unknown or other
  misc_feature (499)..(499): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacaggacttcactctcaccatcagcagactggagcctgaagtattttgctagttgtatttactgtcagctagtatggtagtcgtcgacggtacgttcggaccgtaagggaccgaaggtaggaatacgaaacgtaacgtagtggctgcacntcgtgtcttcactccttcccgctgtcg

SEQ ID NO: 244702 - DNA, 549 bp, Homo sapiens
  misc_feature: GYAE6OF01A19GH.5.59.F04.1.454.CMB.1.raw
  modified_base (196)..(196): a, c, t, g, unknown or other
  misc_feature (196)..(196): n is a, c, g, or t
  modified_base (544)..(544): a, c, t, g, unknown or other
  misc_feature (544)..(544): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcaggcgggtctggggacagacttcactctcaccatcagcagactggagcctagaacgtattttgctagtgtattactgtcagtcagtatggtagtctcgacggtacgttcggaccgtaagggaccgaagggtaggaaacgtacgaaacgtaacgtaggtaggacgtcggacacctagtccgtgttccttcacttcccttcccgtcctnttccg

SEQ ID NO: 244703 - DNA, 548 bp, Homo sapiens
  misc_feature: GYAE6OF01D9BIL.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaanaggttcgtagcctggtaccagcagaacctggccaggttcccagcctcctcatctatggtatactccaccagggccacgtggcatcccagacaggttcagtggcaggcgggtctgggacagacttcactctcaccatcagcagactggacgcgtagaagtatttgctagtgttattacgtgtctagctagtatggtagtctcgacggtacgttcggaccgtaacgggaccgtaagggtaggaacgtacgaaacgtaacgtggtaggcgtcgacactctacgttcgtacttctacttccttcccgtcctcgttcg

SEQ ID NO: 244704 - DNA, 529 bp, Homo sapiens
  misc_feature: GYAE6OF01CTI0L.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcaagaaacctggaccaggttcccagcctcctcatctatggtatatccaccagggccactggcactccagacaggttcagtggcagcggtctgggacagacttcactctcacatcagcagactggagctgaagtatttgctagtgtattactgtcagcagtatggtagctcgacggtacgttcggacaacgggaaccgtaagggtaggaatacgaaacgaactggtagacgtacgacaccatctgttacttcacttccgttcccgcctattacg

SEQ ID NO: 244705 - DNA, 511 bp, Homo sapiens
  misc_feature: GYAE6OF01E5QQC.5.59.F04.1.454.CMB.1.raw
  modified_base (196)..(196): a, c, t, g, unknown or other
  misc_feature (196)..(196): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctagagtatttgctagtgtattactgtcagcagtatggtagctcacggacgttcggccgaagggaccaaggtaggaatacgaaacgaactgtaggcgtgcaccatctgtcttcatccttcccncntcg

SEQ ID NO: 244706 - DNA, 537 bp, Homo sapiens
  misc_feature: GYAE6OF01A9J2M.5.59.F04.1.454.CMB.1.raw
  modified_base (506)..(506): a, c, t, g, unknown or other
  misc_feature (506)..(506): n is a, c, g, or t
  modified_base (534)..(534): a, c, t, g, unknown or other
  misc_feature (534)..(534): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaacctggccaggttcccagcctcctcatctatggtatatccaccagggccactggcatcccagacaggttcagtggcaggcgggtctgggacagcttcactctcaccatcagcagactggacgcctgaagtattttgctagttgtatttactgtcagctagtatggtagtctcgacggtacgttcggaccgtaacgggaccgaagggtaggaaactacgaaacgtaacgtggtggcgtcgacaccntctgttccttcacttccttcccgtcctntcg

SEQ ID NO: 244707 - DNA, 527 bp, Homo sapiens
  misc_feature: GYAE6OF01EMWSH.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctntcctgcagggccagtcagaatgttaccaanaggttctagcctggtaccagcagaaacctggccaggttcccagcctctcatctatggtatatccacaggccactggcatcccagacaggttcagtggcagcggtctgggacagacttcactctcacatcagcagactggagcctagaagtattttgactagtgttattactgtcagctagtatggtagctacacggacgttcggacgtaacgggaaccaagggtagaaacgtacgaaaacgaacgtagtaggacgtgacaccatactgtcttacacttcttcccgtccactcg

SEQ ID NO: 244708 - DNA, 576 bp, Homo sapiens
  misc_feature: GYAE6OF01BK1DG.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagccctcctcatctatggtatactccaccgagggcccacgtggccactcccaagacctagggttcaggtggcaggccgggtctgggacagccttcactctcaccatcagcagactggacgcctagaagtagtttgctagtgttattactgtcagctagtagtggtagcctcgacggtacgttccggaccgaacgggaccgaaagggtacggaaacgtacgaaacgtaacgtggtacggtacgtcgaccacctacgttccgttagttccttactacttcccgttccccgccgtacgtccg

SEQ ID NO: 244709 - DNA, 523 bp, Homo sapiens
  misc_feature: GYAE6OF01DYWUC.5.59.F04.1.454.CMB.1.raw
  modified_base (196)..(196): a, c, t, g, unknown or other
  misc_feature (196)..(196): n is a, c, g, or t
  modified_base (519)..(519): a, c, t, g, unknown or other
  misc_feature (519)..(519): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttccagcctctcatctatggtatatccaccagggccactggcatcccagacaggttcagtggcaggcggtctgggacagacttcactctcaccatcagcagactggagcctgaagtattttgctagtgtattactgtcagcagtatggtagctcgacggtacgttcggaccgtaagggaccgaaggtaggaactacgaaacgaacgtgtaggcgtcgacacatctgtcttcactccttcccgcctntccg

SEQ ID NO: 244710 - DNA, 551 bp, Homo sapiens
  misc_feature: GYAE6OF01DPOAG.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaanaggttcgtagcctggtaccagcagaaacctggccaggttcccagcctcctcatctatggtatatccaccagggccactggcatcccagacaggttcagtggcagcgggtctgggacagacttcactctcacatcagcagactggagctgaagtattttgctagtgtattactgtcagctagtagtgtagctcgacggtacgttcggaccgaagggaccgtaagggtaggaaactaccgaaaacggtaacgtaggtacggacgttcgacaaccgtatccgttgtaccttacctattccctttacccgcctagttccg

SEQ ID NO: 244711 - DNA, 549 bp, Homo sapiens
  misc_feature: GYAE6OF01B4RDL.5.59.F04.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (283)..(283): a, c, t, g, unknown or other
  misc_feature (283)..(283): n is a, c, g, or t
  modified_base (390)..(390): a, c, t, g, unknown or other
  misc_feature (390)..(390): n is a, c, g, or t
  modified_base (427)..(427): a, c, t, g, unknown or other
  misc_feature (427)..(427): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctntcctgcagggccagtcagaatgttaccaacaggttcagcctggtaccagcagaacctggccaggttcccagcctccncatctatggtatatccaccgagggtccactggcatcccagacaggttcagtggcaggcggtctgggacagacttcactctcacatcagcagtactgagcctagagtntttgctagttgtattactgtcagtcaggttatggtancgtacgacggtacggttcggaccgtaagggaccaagggtacgaatacgtaaacggtacgtagtaggccgtagaccactacgtctgttaccttacgtacttacccttcccgaccttagtaccg

SEQ ID NO: 244712 - DNA, 568 bp, Homo sapiens
  misc_feature: GYAE6OF01C81P9.5.59.F04.1.454.CMB.1.raw
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccgaaggggaaanagccaccctctcctgcagggccagtcagaatgtaaccaanaggttcgtagcctggtaccagcaagaacctggccaggtcccagcctcctcatctatggtatactccaccgaggccactggccatcccagacaggttcaggtggcaggcgggtctgggacagacttcactctcaccatcagcagacgtggacgctagaagtatttgactagttagtattactgtcagcgtagtagtaggtagtctacgacggtacggtccggaccgaacgggaaccgaagggtaggaaactacgaaacgtacgtaggtacggcgtacggaccaactacgttactcgttaccttactacttacccttcccgcctacttccg

SEQ ID NO: 244713 - DNA, 591 bp, Homo sapiens
  misc_feature: GYAE6OF01CVVOF.5.59.F04.1.454.CMB.1.raw
  modified_base (191)..(191): a, c, t, g, unknown or other
  misc_feature (191)..(191): n is a, c, g, or t
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (260)..(260): a, c, t, g, unknown or other
  misc_feature (260)..(260): n is a, c, g, or t
  modified_base (263)..(264): a, c, t, g, unknown or other
  misc_feature (263)..(264): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcacctgtctttgctcaggggaangccacctctcctgcaggccagtcagatgtacangtcgtanctgacagcagaactggcaggtccagctcnatnntgtatactcacaggccagtgcatcccagactacggtcaggtcggcagggcggtcagggacagtacttcactctcacctagtacagacgtaacgagtcgggactcgtagtaagttcttttagacgtagttagttacttacgtgtactagactaagtcgtagtacgtactacgtacgggtacggttccggaaccgtaacggggtaaccgtaacgggtaaggtaaacgtaaccgaaaaggtaccgtacgggtagaccgtacgacccaaccgtagttccgttacgttaccttacctacgtttacccgtttaccccgccgtaacttaccggg

SEQ ID NO: 244714 - DNA, 550 bp, Homo sapiens
  misc_feature: GYAE6OF01EFUXW.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctcctcatctatggtatatccaccagggccactggcactcccagacaggttcagtggcaggcggtctgggacagacttcactctcaccatcagcagactggagcctagaagtattttgctagtgttattactgtcagcagtatggtagctcgacggtacgttccggaccgtaacgggaccgtaagggtaggaaacgtacgaaacgaacgtggtaggtcgtacgacaccgtatcgtgttccttactacttaccttcccgtcctacgtccg

SEQ ID NO: 244715 - DNA, 554 bp, Homo sapiens
  misc_feature: GYAE6OF01B883C.5.59.F04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctntcctgcagggccagtcagaatgtaccaanaggttctagcctggaccagcagaacctgccaggttcccagcctcctcatctatggtatactccaccgagggccacgtggcactccagacaggttcagtggcaggcggtctgggacagacttcactctacacatcagcagactggacgtctaggaagttatttgactagttagttaattacgtgtacagtcgtagttagtggtatctacgacggtacgttcggaccgtaagggacgaagggtagaacgtaacgaaacgtacgtggtacgcgtacgacacctagtccttcgttcttacacttcccgttccctcgtagttccg

SEQ ID NO: 244716 - DNA, 543 bp, Homo sapiens
  misc_feature: GYAE6OF01CUN2U.5.59.F04.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaccaanaggttcgagcctggtaccagcagaaacctggccaggttccagcctcctcatctatggtatatccaccagggccactggcatccagacaggttcagtggcaggcggtctgggacaggacttcgactctcaccatcagcagactggagcctgaagtatttgacgtagtgttattactgtcagctagtatggtagctcgaacggtacgttcggaccgtaacgggaccgtaaggtacggaacgtacgaaacgtaacgtaggtacggacgtcgacaccgtatcttgtcttacacttaccttcccgcctagtccg

SEQ ID NO: 244717 - DNA, 551 bp, Homo sapiens
  misc_feature: GYAE6OF01DBM6D.5.59.F04.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (378)..(378): a, c, t, g, unknown or other
  misc_feature (378)..(378): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaaggggaaanagccaccctctcctgcagggccagtcagaatgtaccanaggtctagcctggaccagcagaaacctggccaggttcccagcctctcatctatggtatatccacagggccactggcactcccagacaggttcagtggcaggcggtctgggacagacttcactctcaccatcagcagactggancctgaagtatttgactagttgtaattactgtacagcagttagtggtagctacgacggtacgttacggaccgtaagggacccgaagggtaggaactacgaaacgtaacgtgtaggacgttcggacaccgtattaccgttgttaccttctaacttccctttccccgctcgtaccg

SEQ ID NO: 244718 - DNA, 543 bp, Homo sapiens
  misc_feature: GYAE6OF01DDNAE.5.59.F04.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagatgtaccanagttcgagcctggtaccngcaagaacctggccaggtcccagcctcctcatctatggtatatccacagggccatggcactcccagacaggttcagtggcaggcggggtctggggacagaccttcactctcaccatcagcagacgtggacgcctagaagtattttgactagttagttatttactgtacagtctagtagtggtacgtcgtcgaacgggtacggttcgggaccgtaacgggacgaagggtagtaagtacgaaacggacgtggtggcgtgacacctntctnttcgttcacttccctccgctgtcg

SEQ ID NO: 244719 - DNA, 528 bp, Homo sapiens
  misc_feature: GYAE6OF01B2CHR.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccacagggccactggcatcccagacaggttcagtggcagcgggtctgggacagacttcactctcaccatcagcagactggagcctagaagtattttgctagtgtattactgtcagcagtatggtagctcgacggtacgttcggaccgtaagggaccgaagggtaggaaagtacgaaacgaagtacggtaggctggcaccgatcgtgtcttcactccttcccgtccatcg

SEQ ID NO: 244720 - DNA, 525 bp, Homo sapiens
  misc_feature: GYAE6OF01BRTLM.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (497)..(497): a, c, t, g, unknown or other
  misc_feature (497)..(497): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaanaggttcgtagcctggtaccagcaagaaacctggccaggttcccagcctcctcatctatggtatatccaccagggccactggcatcccagacaggttcagtggcagcgggtctggggacagacttcactctcaccatcagcagactggagcctagaagtagttttgctagtgtattactgtcagctagtatggtagctcacggtacgttcggaccgtaagggaccaagggtggaaagtacaaacgacgttgtggctgcacctntctgttccttcactccttcccgctatcg

SEQ ID NO: 244721 - DNA, 578 bp, Homo sapiens
  misc_feature: GYAE6OF01BZD90.5.59.F04.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (273)..(273): a, c, t, g, unknown or other
  misc_feature (273)..(273): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctcgagggaaangccaccctntcctgcaggccagtcagaatgtaccaanaggttcagcctggaccagcagaacctggccaggtccagcctcncatctatggtatactccacaggccactggcatccagacaggttcagtgcaggcggtctgggacagacttcactctcaccatcgagcagacgtggacgaccgtagaacgtagttttagacgtaggttagttaacttacgtcgtacgtagtcgtagttaagtcggtacgctacgacgggtacgttcggaccgtaacgggaccgtaaaggtaggtaaacgtaacgaaacggtaacgttcggtaggtacgtcgaccaaccgtacttccgttagttccgttaccacgttacctccccgtcgtacgtaccg

SEQ ID NO: 244722 - DNA, 520 bp, Homo sapiens
  misc_feature: GYAE6OF01D6JDG.5.59.F04.1.454.CMB.1.raw
  modified_base (197)..(197): a, c, t, g, unknown or other
  misc_feature (197)..(197): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
  modified_base (420)..(420): a, c, t, g, unknown or other
  misc_feature (420)..(420): n is a, c, g, or t
  modified_base (515)..(515): a, c, t, g, unknown or other
  misc_feature (515)..(515): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaacctggccaggttcccagcctctcatctatggtatatccaccagggccactggcatcccagacaggttcagtggcagcgggtctgggacagacttcactctcacatcagcagactggancctgaagtntttgagtgtattacngtcagcagtatggtanctcgacggtacgttcggaccgaaggggaccaagggtggaaactcgaaaacgacgtgtcggcttaggctaccagtctgtcttcattcctcccgctntctcg

SEQ ID NO: 244723 - DNA, 544 bp, Homo sapiens
  misc_feature: GYAE6OF01EBQQV.5.59.F04.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaangccaccctctcctgcagggccagtcagaatgttaccaacnggttctagcctggtaccagcagaacctggccaggttcccagcctcctcatctatggtatactccaccgagggccacgtggcactcccagacaggttcagtggcaggcgggtctgggacagacttcactctcaccatcagcagactggacgcctgaagtattttgactagtagttattacgtgtcagcgtagtagtggtagcgtcgacggtacggttcggaccgaacgggacgtaaggtaggaacgtacgaaacgaacgtgtaggtcgtcgacaccactctacgtcttctacttccttcccgccgtctcg

SEQ ID NO: 244724 - DNA, 548 bp, Homo sapiens
  misc_feature: GYAE6OF01DISWV.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (542)..(542): a, c, t, g, unknown or other
  misc_feature (542)..(542): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccagggaaangccaccctntcctgcagggccagtcagaatgttaccaanaggttctagcctggtaccagcagaacctggccaggttcccagcctcctcatctatggtatactccaccgagggccacgtcggccatcccaagactaggttcagtggcaggcgggtctggggacagaccttcactctacacatcagcagactggacgcctagaagtattttgacgtagtgttaattagtgtacagcgtagtagtggtagctacgacggtacggttcgaccgtaaggaccgtaaggtagtaatacgaacgacgtaggtaggtacgtcgacacagtctgttcttactactccttcccgtcncgttcg

SEQ ID NO: 244725 - DNA, 500 bp, Homo sapiens
  misc_feature: GYAE6OF01CY8O0.5.59.F04.1.454.CMB.1.raw
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
  modified_base (406)..(406): a, c, t, g, unknown or other
  misc_feature (406)..(406): n is a, c, g, or t
  modified_base (474)..(474): a, c, t, g, unknown or other
  misc_feature (474)..(474): n is a, c, g, or t
  modified_base (493)..(493): a, c, t, g, unknown or other
  misc_feature (493)..(493): n is a, c, g, or t
  modified_base (496)..(496): a, c, t, g, unknown or other
  misc_feature (496)..(496): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagatgtacanggtcagctggacngcagaactgcaggtccagctcctnatctatggtatatccaccagggccactggcatcccagacaggttcagtggcagcgggtctgggacagacttcactctcacatcagcagactggagcctgaagtatttgctagtgtattactgtcagtctagtatggtanctcgacggtacgttcggacgaagggacaagggtaggaatacgaaacgaacgtggtaggacgtgcaccntctgtcttcatccttcccnctntccg

SEQ ID NO: 244726 - DNA, 535 bp, Homo sapiens
  misc_feature: GYAE6OF01EVZVM.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgttaaccaacaggttcgtagcctggtaccagcagaaacctggccaggttcccagcctctcatctatggtatatccaccagggccactggcatcccagacaggttcagtggcagcgggtctgggacagactcactctcacatcagcagactggagcctagaagtattttgctagtgtattactgtcagctagtagtggtagcgtcgacggtacgttcggccgtaagggaccgaaggtaggaaagtacgaaacgtaacgtgtaggcgtcgacacctatacgtgtaccttcacttccttcccgctagtccg

SEQ ID NO: 244727 - DNA, 589 bp, Homo sapiens
  misc_feature: GYAE6OF01DSLYA.5.59.F04.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (307)..(307): a, c, t, g, unknown or other
  misc_feature (307)..(307): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangcccaccctntcctgcagggccagtcagaatgttaccaacaggttcgtagcctggtaccagcaagaaacctggccaggttcccagcctctcatctatggtatactccaaccngggccacgtggcactcccagactaggttcaggtggcaggcggtctggggacaggtaccttcacgtctcaaccgatcagcagtactggagcctaggaagtnttttagactagtagtatttacgtagtnacgngtaagttatggtactcgtacgacggtacgttacggacgtaacgggaccgtaaggtaggaaactacgaaacgtaacgtaggtaggtacgtacgacgactacgtacttacggttactttaccgtacttacccgttccccggcctacgttaccg

SEQ ID NO: 244728 - DNA, 630 bp, Homo sapiens
  misc_feature: GYAE6OF01DI2MK.5.59.F04.1.454.CMB.1.raw
  modified_base (195)..(195): a, c, t, g, unknown or other
  misc_feature (195)..(195): n is a, c, g, or t
  modified_base (425)..(425): a, c, t, g, unknown or other
  misc_feature (425)..(425): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctcgaggggaaangccaccctctcctgcagggccagtcagaatcgttaccaacgtaggttcgagcctggtaccagccaagaaaccctggcctacggttcccagtcccttcctcactctagtggtatactcccacgagggcccacgtggcctactcccagacgtaggttcaggtcgcgaggccgggtctaggggacacggtaccttcactcacaccatcagcacgacgtggacgctagaacgtntttgctagttgttacttacgtgtacgtagtcgtaagttagtacggtagtccgttacgtaacgggtaccggttaccggaccggtaaacgggtaccgtaagggtaacggaacgtaacggaaacgtacgttacggtaggtacgtacgaccaaccgtcttacgttcgttccttaccgtacctttacccgttccccgtacctcgttaccg

SEQ ID NO: 244729 - DNA, 571 bp, Homo sapiens
  misc_feature: GYAE6OF01ARJS5.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctntcctgcagggccagtcagaatgttaccaacaggttcgtagcctggtaccagcagaacctggccaggttcccagcctcctcatctatggtatatccaccagggccactggcatcccagacaggttcagtggcaggcgggtctgggacagacttcactctcaccatcagcagactggagcctagagtattttgcgtagtgttattactgtacagtctagtagtggtagcgtacgtacggtacgttcgggaccgtaacgggaccgaaagggtaggaaacgtaacgaaacggtaacgtaggtacggtacgtcgtacaaccgtattccgtagttaccttacgtacttcccttacccggtccctagttacccg

SEQ ID NO: 244730 - DNA, 595 bp, Homo sapiens
  misc_feature: GYAE6OF01D9X15.5.59.F04.1.454.CMB.1.raw
  modified_base (198)..(198): a, c, t, g, unknown or other
  misc_feature (198)..(198): n is a, c, g, or t
  modified_base (405)..(405): a, c, t, g, unknown or other
  misc_feature (405)..(405): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccaccctctcctgcagggccagtcagaatgttaccaacaggttcgtagcctggtaccagcagaacttggccaggttcccagccctctcatctatggtatactccaccgagggccacgtggccatccccagacaggttcaggtggcaggcgggtctggggacaggtacttcactctcaccatcagcagacgtggagcctagaagtnttttgcgtagttgttaattacgtgtcagtctagttagtggtagccgtacgaacgggtacgttaccggaccgtaacgggtaccgaagggtagaaacgtaccgaaacggtaacgtcggtaggtaccgtcggtaccaaccgtacttaccgttgttacccttactaccttacccttccccgtctaacgttcccg

SEQ ID NO: 244731 - DNA, 629 bp, Homo sapiens
  misc_feature: GYAE6OF01B4K08.5.59.F04.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (284)..(284): a, c, t, g, unknown or other
  misc_feature (284)..(284): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccaccctctcctgcgagggccagtcagaatgttaccaanaggttcagcctggaccagcaagaacctgccaggttcccagcctccnatctatggtatactccacgaggccacgtgcatcccagactaggttcaggtggcaggcggtcgtagggactaggacttcacgtctacactatcgagcagactggacgctagaagtagtttgacgtagtagtattacgtgtacgagtctagttagtcggtacgacgttacgaccgggtacgttaccggaccggtaacgggaaccgtaaacggtacggtaacgtaaccgtaaacggtaaaccgttacggtacggtaccggtacggtacccgtaaccgtacgttaccgttcgtttacccgtttaccgtaccttaccccgtttacccccgtaccgttacgtttacccggg

SEQ ID NO: 244732 - DNA, 576 bp, Homo sapiens
  misc_feature: GYAE6OF01EAEC6.5.59.F04.1.454.CMB.1.raw
  modified_base (195)..(195): a, c, t, g, unknown or other
  misc_feature (195)..(195): n is a, c, g, or t
  modified_base (399)..(399): a, c, t, g, unknown or other
  misc_feature (399)..(399): n is a, c, g, or t
  modified_base (455)..(455): a, c, t, g, unknown or other
  misc_feature (455)..(455): n is a, c, g, or t
  modified_base (541)..(541): a, c, t, g, unknown or other
  misc_feature (541)..(541): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctcgaggggaanagccaccctctcctgcagggccagtcagaatgttaccaacaggttcagcctggtaccagcagaaacctggccaggttcccagcctcctcatctatggtatactccaccgagggccacgtggcactcccgagactaggtacagtggcgacggcggtcgtgggacaggtacttcactctacaccatacgagcgagtacgtaggacnccgtagaagttatttgactagttagttacgttactgtacagtctagttagtggtancgtacgacgggtaccgttcggaccggtaacgggaacgtagggtagtaacgtaacgaaacgtacgtaggtacggtagcgacaacgtntccttagtcttactacttccgttcccgctcgtccg

SEQ ID NO: 244733 - DNA, 533 bp, Homo sapiens
  misc_feature: GYAE6OF01DW1DA.5.59.F04.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
  modified_base (372)..(372): a, c, t, g, unknown or other
  misc_feature (372)..(372): n is a, c, g, or t
  modified_base (503)..(503): a, c, t, g, unknown or other
  misc_feature (503)..(503): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccgaggggaaangcccaccctctcctgcagggccagtcagaatgttaccaanaggttcgagcctggtaccagcagaaacctggccaggttcccagccctcctcatctatggtatactccaccgagggcccacgtggcatcccagacaggttcagtggcaggcgggtctgggacagacttcactctcacntcagcagactggagcctagaagtatttgactagtgttattacgtgtcagtctagtagtggtagtctcgacggtacgtcggaccgaaggacgaaggtaggaactacgaaacgacgtggtagcgtcgacactntcgtgtcttctactaccttcccgctcgtcg

SEQ ID NO: 244734 - DNA, 541 bp, Homo sapiens
  misc_feature: GYAE6OF01BLDTP.5.59.F04.1.454.CMB.1.raw
  modified_base (196)..(196): a, c, t, g, unknown or other
  misc_feature (196)..(196): n is a, c, g, or t
  modified_base (517)..(517): a, c, t, g, unknown or other
  misc_feature (517)..(517): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaacctggccaggttcccagcctctcatctatggtatatccacagggccactggcatcccagacaggttcagtgcagcgggtctgggacaggtaccttcactcctcacctatcagcagactggacgccgtgaagtattttgacgtagttgtactttactgtctagctagtagtggtagctcgaacggtacgttacggccgaacgggaccgaaggtaggaaactacgaaacgtacgtaggtacggcgtagcaccatctntcgttcactcctccgtcctgtccg

SEQ ID NO: 244735 - DNA, 528 bp, Homo sapiens
  misc_feature: GYAE6OF01AMV8O.5.59.F04.1.454.CMB.1.raw
  modified_base (196)..(196): a, c, t, g, unknown or other
  misc_feature (196)..(196): n is a, c, g, or t
  modified_base (425)..(425): a, c, t, g, unknown or other
  misc_feature (425)..(425): n is a, c, g, or t
  modified_base (496)..(496): a, c, t, g, unknown or other
  misc_feature (496)..(496): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcggtctgggacagacttcactctcaccatcagcagactggagcctgaagtattttgctagtgtattactgtcagctagtatggtanctcgacggtacgttcggacgaagggaccaagggtacggaatacgaaacgacgtagtacggcgtcgacactntctgtcttctacttccttccgtcctagttccg

SEQ ID NO: 244736 - DNA, 539 bp, Homo sapiens
  misc_feature: GYAE6OF01EGEEH.5.59.F04.1.454.CMB.1.raw
  modified_base (196)..(196): a, c, t, g, unknown or other
  misc_feature (196)..(196): n is a, c, g, or t
  modified_base (428)..(428): a, c, t, g, unknown or other
  misc_feature (428)..(428): n is a, c, g, or t
  modified_base (535)..(535): a, c, t, g, unknown or other
  misc_feature (535)..(535): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaacctggccaggttcccagcctcctcatctatggtatactccaccagggccactggcactcccagacaggttcagtggcaggcggtctgggacagacttcactctcaccatcagcagactggacgcctgaagtattttgctagtgttattactgtcagcagtatggtanctcgacggtacgttcggccgtaagggaccgaaggtaggaaactacgaaacgtaacgtaggtacggtacgtcgacaccagtactgtcttacacttaccttcccgcctntccg

SEQ ID NO: 244737 - DNA, 608 bp, Homo sapiens
  misc_feature: GYAE6OF01AZCGK.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgttaccaacaggttcgtagcctggtaccagcagaacctggccaggttcccagcctcctcatctatggtatactccaccgagggccacgtcggcactcccagacagggttcaggtcggcaggtccggggtctggggaacaggtaccttcactcctacacctatcagcagacgtggacgtccgtagaagtatttgacgtagtagttattacgtgtacgagtcgtagttagtggtacgtcgtacgtacggtacggttcggaccgtaacgggaaccgtaagggtacggtaaacgtaccgaaacggtaacgtaggtacggtacgtcgacctaccgtacgttacgtacgttaccgttactacttcccgtcccgtaccgtcgttaccg

SEQ ID NO: 244738 - DNA, 799 bp, Homo sapiens
  misc_feature: GYAE6OF01CPDJF.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaanagccaccctctcctgcagggccagtcagaatgttaaccaagaggttcgtagcctggtaccagcaagaaacctggaccaggttcccagcctcctcatctatggtataactccaaccgagggcccaacgtggcctatccccaagacctagggttccaaggttcggacagggtccggggtactggggaaacctaggaactttccaacctcctacaacccgtaatcccgaagaccaggtaaccttggggaacgtcctaggaaacgttagtttttaggaccgttaaggttaggttaaactttacgacggttaccgaaggtaccgtaaggtttaacgtacgggttaacgacccgttaaccggtaacccggggtaacccggtttacccggggaaccccgttaaaaacggggggaacccggttaaaacggggtaaccggggtaaaaacttaaacccggaaaaaaccgggtaaccggtttaaaccgggttacggggaaccgtttccgggaacccgtaaacccgttaacgttacccgtttaccggtttaccctttaacccgttacctttaccccggtttaaccccccggtacccgtaaccgtttaaccccgg

SEQ ID NO: 244739 - DNA, 638 bp, Homo sapiens
  misc_feature: GYAE6OF01BW60B.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgtgacgcagtctccaggcaccctgtcttgtctccgaggggaaanacgccaccctctcctgcgagggccagtcaagaatgttaaccaagtaggttcgtagcctggtaccagcaacgaaccgtggacctacggttcccagccctcctcatctagtggtatactcccacgacggccacgtggcactcccagacaggttcaggtggcaggtccggggtcgtaggggacacggacttcgacctctaccacatcgaagcgagacgtggacgtccgtaggaagttgtttgacgtagttacgttaacttacgtgtctagtcgtagttagtggtagtccgtacgaccgggtacggttaccggacgaaacgggaccgtaagggtacgaaacgtaaccgaaacggtacgtacggtaggacccgtacggtacccaaccgtacgttacgttaccgtttacttaccttaccttacccgtccccgttaccgtaccgttccgg

SEQ ID NO: 244740 - DNA, 582 bp, Homo sapiens
  misc_feature: GYAE6OF01BJ1QP.5.59.F04.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (349)..(349): a, c, t, g, unknown or other
  misc_feature (349)..(349): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaccaacaggttcgtagcctggtaccnggcagaaacctggccaggttcccagcctcctcatctatggtaatactccacgagggccactggccatcccagacaggttcagtggcaggcggtcngggacagtacttcactcncaccatcagcagactggacncctagaagtatttgactagtgttaattacgtgtacgagtcgtagttagtggtacgcgttcgaacggtacggttacggaccgtaacgggaaccgtaaggtacggaaactacggaaacgtaacgtaggtaggtacgtcgacgtacctagttccgttacgttaccttctaccttaccgttcccctccgtacgttaccg

SEQ ID NO: 244741 - DNA, 525 bp, Homo sapiens
  misc_feature: GYAE6OF01DC1HA.5.59.F04.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (494)..(494): a, c, t, g, unknown or other
  misc_feature (494)..(494): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctcncctgcagggccagtcagatgtacanagtcagcctggaccngcagaacctgccaggtcccagccctctcatctatggtatatccaccagggccacgtggcactcccagactaggttcagtggcaggcgggtctgggacagacttcactctcaccatcagcagactggacgcctgaagtatttgctagtgttattactgtcagcagtagtggtagtcgtcgacgggtacgttcgggaccgaagggaccgaaggtagaactacgaaacgtacgtggtaggcgtacgacacntcgtcgttcttacacttccttcccgctgtcg

SEQ ID NO: 244742 - DNA, 524 bp, Homo sapiens
  misc_feature: GYAE6OF01A2V1E.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaacctggccaggttcccagcctcctcatctatggtatatccaccagggccactggcatcccagacaggttcagtggcagcggtctgggacagacttcactctcacatcagcagactggagcctgaagtatttgctagtgtattactgtcagctagtatggtagctcgacggtacgttcggaccgtaagggaccgaagggtaggaaactacgaaacgacgtaggtggcgtgcacctatctgttcttcacttccttcccgtctctcg

SEQ ID NO: 244743 - DNA, 535 bp, Homo sapiens
  misc_feature: GYAE6OF01DXXN3.5.59.F04.1.454.CMB.1.raw
  modified_base (195)..(195): a, c, t, g, unknown or other
  misc_feature (195)..(195): n is a, c, g, or t
  modified_base (236)..(236): a, c, t, g, unknown or other
  misc_feature (236)..(236): n is a, c, g, or t
  modified_base (439)..(439): a, c, t, g, unknown or other
  misc_feature (439)..(439): n is a, c, g, or t
  modified_base (532)..(532): a, c, t, g, unknown or other
  misc_feature (532)..(532): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaangccaccctctcctgcagggccagtcaagaatgttaaccaanaggttcgtagcctggtaccagcaagaaacctggaccaggttcccagcctcctcatctatggtatatccacgagggccactggcactccagacaggttcagtggcaggcggtctgggacagacttcgactctcaccatcagacagacgtggacgtctagaagtattttgctagtgttattacgtgtcagcgtagttagtggtanctcgacggtacgtcggacgaagggacaagggtagaactacgaaacgacgtagtgacgtcgacactctcgtgtcttctacttccttccccgctntcg

SEQ ID NO: 244744 - DNA, 581 bp, Homo sapiens
  misc_feature: GYAE6OF01C8UMG.5.59.F04.1.454.CMB.1.raw
  modified_base (197)..(197): a, c, t, g, unknown or other
  misc_feature (197)..(197): n is a, c, g, or t
  modified_base (369)..(369): a, c, t, g, unknown or other
  misc_feature (369)..(369): n is a, c, g, or t
  modified_base (392)..(392): a, c, t, g, unknown or other
  misc_feature (392)..(392): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttccagcctcctcatctatggtatatccaccagggccacgtggcactcccagacaggttcagtggcaggcggtctgggacagacttcactctcacntcagcagactggagcctgaagtntttgctagtagtattacgtgtcagtctagtattggtacgtctcgaacggtacggttccggtaccgaaggggaaccgtaaggtaacggaacgttaacgaaaaccggtaacgtcggttaggaccgttacgaccaaccctagttaccctaggtttccttactacttcccctttaccccggcctagttacccg

SEQ ID NO: 244745 - DNA, 569 bp, Homo sapiens
  misc_feature: GYAE6OF01BKEWW.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgtctccaggggaaangccaccctctcctgcagggccagtcagaatgttaccaacaggttcgtagcctggtaccagcagaaacctggccaggttcccagcctcctcatctatggtatactccaccagggcccacgtggcatcccagacaggttcagtggcagcgggtctgggacaggacttcactctcacctatcagcagactggagcctagaagtatttgctagtgtattacgtgtcagctagtagtggtacgtcgtcgacggtacgttcggaccgtaacgggaccgtaaagggtaggaaacgtacgaaacggtaacgtaggtacggtacgtcgacaaccgtactacgttcgttacttactacttaccgttcccgtccgtacgttaccg

SEQ ID NO: 244746 - DNA, 646 bp, Homo sapiens
  misc_feature: GYAE6OF01CVHLI.5.59.F04.1.454.CMB.1.raw
  modified_base (196)..(196): a, c, t, g, unknown or other
  misc_feature (196)..(196): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (399)..(399): a, c, t, g, unknown or other
  misc_feature (399)..(399): n is a, c, g, or t
  modified_base (405)..(405): a, c, t, g, unknown or other
  misc_feature (405)..(405): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangcccaccctctcctgcagggccagtcagaatgttaccaactaggttcgtagcctggtaccagcaagaacctggccaggttcccagcctcctcatctatggtatactccaccagggcccacgtggccactcccagacaggttcagtggcagcggtcgtggacagacttcactcncacatcagcagactggacnccgtagaagtntttcgngtacgtagttacttattgtcgtacgacgtacgtaggttacgtaggtacctcgtaacgggtacggttacccgggtacccggtaacgggtaaccgggtaacgggtaagggtaacgtaaaacgtaaaccggtaaaccggtaccggttagggtacccggtacggtaccgtaaccctaaccgtttacgttccgtttaccgttaccttaccgtttacccctttccccggttacccgtacttacccgg

SEQ ID NO: 244747 - DNA, 536 bp, Homo sapiens
  misc_feature: GYAE6OF01DBQP9.5.59.F04.1.454.CMB.1.raw
  modified_base (196)..(196): a, c, t, g, unknown or other
  misc_feature (196)..(196): n is a, c, g, or t
  modified_base (364)..(364): a, c, t, g, unknown or other
  misc_feature (364)..(364): n is a, c, g, or t
  modified_base (425)..(425): a, c, t, g, unknown or other
  misc_feature (425)..(425): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgagcctggtaccagcagaaacctggccaggttcccagcctcctcatctatggtatatccaccagggccatggcatcccagacaggttcagtggcagcggtctgggacagacttcactctcacntcagcagacgtggacgcctagaagtattttgctagtgttattactgtcagcagtatggtanctcgacggtacgttcggaccgaagggaccgaagggtaggaatacgaaaacgtaacgtggtaggcgtcgacaccgtattctgttcttactacttccttccccgcctattccg

SEQ ID NO: 244748 - DNA, 557 bp, Homo sapiens
  misc_feature: GYAE6OF01CMJPO.5.59.F04.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
tcagatcagacacgcacgaccggtgctcgatttagtacacacacttagggattggggtgctcagttaggacccagagggaaccatggaaaccccagcgcagcttctcttcctcctgctactctggcggtcccagatgccaccggaaagctgtgttgacgcagtctccaggcacctgtctttgctccgaggggaaangccaccctctcctgcagggccagtcagatgtaccaanggttcagcctggaccngcagaactgccaggtccagcctctcatctatggtatactcccgacgacggccacgtcggcactcccgagactggttcagtcggacaggtcggtctgggacagtactcactctcacatacgagcagcgtggacgcgtagaagtagtttgctagttgtattacgtgtacagtacagttagtggtacgtcgtacggacggtaccggttcggaccgaagggaccgtaaaggtagtaaacgtacgaaacgtacgtggtacgacgcgtaccactgttcgtcttccgttactacgtcccttcccgactcgtaccg

SEQ ID NO: 244749 - DNA, 639 bp, Homo sapiens
  misc_feature: GYAE6OF01DKGZZ.5.59.F04.1.454.CMB.1.raw
  modified_base (199)..(199): a, c, t, g, unknown or other
  misc_feature (199)..(199): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggccaccctgtctttgtctccgaggggaaancgccaccctctcctgcaggccagtcagaatgtaaccaacgtaggttcgtagcctggtaccagcaagaaaccgtggcctacggttccagcctcctcatctagtggtatactccaccgagggccacgtgctactccagactaggttcaggtggacgaggtccgggtcgtacggggactacggacttcacgtcctacgaacctactcgaacgcaagacgtcggacgtccgtagtaacgttagtttacgacgttaggttacgttaactttacgttacgtacgaagtacgtagttagtacggtacgtcgtacggtaccggtacggttccggaccggtaacgggtaaccgtaaggtaaggaacgtaacgtaaacggaacgtaggtacgacgtcgtacaacgttcgtacgtagttaccttactactcccgttacccgtctgttaccg

SEQ ID NO: 244750 - DNA, 628 bp, Homo sapiens
  misc_feature: GYAE6OF01D3LI5.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctcgaggggaaangccaccctctcctgcgaggccagtcagaatgttaaccaatggttcgagcctggtaccagcagaacctggaccaggttcccagcctcctcatctagtggtatactcccgaacgacgggccacgttcggcctaactccccgaagtaccgtacgggtttcaaggttcggactagggtccggggttactggggaaccaggtaacctttcaacgttcctaccaaccatccgaagtcgaaggtaccgtggacgccgtaggtaagttattttacgacgtagttagttatttacgtagtactagtcgtagtagtggtagtcgtacgaccggtacgtcggaccgtaacggacgtaaggtacggaaagtacgaaacgtacgtagtacggtacgtcgacacgtacgtcgtacgtacttacgtacttccttcccgtcctcgtaccg

SEQ ID NO: 244751 - DNA, 567 bp, Homo sapiens
  misc_feature: GYAE6OF01BWRD9.5.59.F04.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (346)..(346): a, c, t, g, unknown or other
  misc_feature (346)..(346): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (433)..(433): a, c, t, g, unknown or other
  misc_feature (433)..(433): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctccaggggaaangccaccctctcctgcagggccagtcagaatgttaccaanaggttcgagcctggtaccagcaagaaacctggccaggttcccagccctcctcatctatggtatactccacaggccacgtggacatcccagacaggttcagtggcaggcggtntgggacagacttcactctcaacctatcagcagactggacgcgtagaagtatttgctagtgtattagtgtanagtntagtagtggtancgtacgacggtacgttaccggaccgtaacgggaccgtaagggtaagaacgtacgaaacgacgtaggtacggacgtacgacaccgtagttccgttacgttaccttacctacttacccgttccccgactcgtaccg

SEQ ID NO: 244752 - DNA, 571 bp, Homo sapiens
  misc_feature: GYAE6OF01EG6JD.5.59.F04.1.454.CMB.1.raw
  modified_base (195)..(195): a, c, t, g, unknown or other
  misc_feature (195)..(195): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (381)..(381): a, c, t, g, unknown or other
  misc_feature (381)..(381): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaccaacaggttcgtagcctggtaccagcagaaacctggccaggttcccagcctcctcatctatggtatatccaccgagggccactggcactcccagacaggttcagtggnagcggtcnggacagacttcactctcaccatcagcagactgganccgtgaagtattttgctagtagttattacgtgtacagacgtagtagtggtagcgtcgaacggtacgttaccggaccgaacgggaaccgtaagggtaggaacgtaacgaaacggaaacgtaggtacggtacgtcgtacacccgtacttacgtgttaccgttactacttacccttcccgtacctcgttaccg

SEQ ID NO: 244753 - DNA, 562 bp, Homo sapiens
  misc_feature: GYAE6OF01B7KWO.5.59.F04.1.454.CMB.1.raw
  modified_base (196)..(196): a, c, t, g, unknown or other
  misc_feature (196)..(196): n is a, c, g, or t
  modified_base (417)..(417): a, c, t, g, unknown or other
  misc_feature (417)..(417): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagccctctcatctatggtatatccaaccgagggccactggcactcccagacaggttcagtggcaggcggtctgggacaggacttcactctacacatcagcagacgtggagcctagtaagtatttgctagttgtaattacngttacagtcgaagttatggtagtctacgacgggtacgttcggaccgtaacgggaacgtaacgggtacggaataccgaaaacggtaacgtggtaggtactacggacaaccgtatcgttgttccttacacttaccttcccgctctcg

SEQ ID NO: 244754 - DNA, 618 bp, Homo sapiens
  misc_feature: GYAE6OF01ELDMR.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgtctccaggggaaagagccaccctctcctgcgagggccagtcagaatgttaccaacaggttcgtagcctggtaccagcagaaacctggccaggttcccagcctcctcatctatggtatatccacgagggccacgtggcactcccagacaggttcaggtggcaggcgggtctgggacagcttcactctcacatcagcagacgtggagccgtagaagtatttgacgtagtagttattacgtgttacgagtacgtagttagtgggtacgtcgtacgaacgggtaccggttacggaccgtaaacgggaaccgtaaagggtaacgggaaacgttaacgaaaaccggtaaacgtacggtacgggtacgtacggaccaacccgtacgttaccgttagttacccgtttaccgtaccttacccgtttccccgcccttacgttaccgg

SEQ ID NO: 244755 - DNA, 546 bp, Homo sapiens
  misc_feature: GYAE6OF01BRM28.5.59.F04.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaanggttcgagcctggtaccagcagaaacctggccaggttcccagcctcctcatctatggtatatccacagggccactggcatcccagacaggttcagtgcagcggtctgggacagacttcactctcaccatcagcagactggacgcctgaagtatttgcagtgtattactgtcagctagtatggtagctcgaccggtacgttcggaccgtaacgggaccgaacggtaggaaactacgaaacgtaacgtgtacggtacgtgaccaccgtattccgtacgttacttcgacttacccgttcccgcctacgttccg

SEQ ID NO: 244756 - DNA, 611 bp, Homo sapiens
  misc_feature: GYAE6OF01AD3MY.5.59.F04.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
tcagatcagacacgcacgaccggtgctcgatttagtacacacacttagggattggggtggctcagttaggacccagagggaaccatggaaaccccagcgcagcttctcttcctcctgctactctggctcccagatgccaccggaaagactgtgttgacgcagtctccaggccaccctgtctttgtctccgaggggaangccaccctctcctgcagggccagtcagaatgttaccanaggttcgtagcctggtaccngcagaacctggaccaggttcccagtccctcctcatctatggtactactacccaccgagggcccaacgtggacctactccccgaaggtaccgagggtttcacggtcggacagggtccgggtctggggactagtaccttcacctcctacacctagtccacgccaggtacctggacgtccgtagaacgtatttcgacgtaggttacgttattacgtgtacgtagtcgtagttagtggtacgcgtacgacggtacgttcggaccgtaacgggactaaggtacggaactacgaaacgtacgtggtacggcgtcggacacgtcgttaccgtcgtcgttacacgttccttcccgctcgtccg

SEQ ID NO: 244757 - DNA, 521 bp, Homo sapiens
  misc_feature: GYAE6OF01BRNDM.5.59.F04.1.454.CMB.1.raw
  modified_base (196)..(196): a, c, t, g, unknown or other
  misc_feature (196)..(196): n is a, c, g, or t
  modified_base (507)..(507): a, c, t, g, unknown or other
  misc_feature (507)..(507): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttctagcctggtaccagcagaaacctggccagcctccagactcctcatttatcgttcatccaccagggccactgatcgtcccaaccagattcagtggcaggaggtctgggacagacttcagtctcaccatcagcagcgtacagtctgaagtcttggctagtttacttactgtacaactaatgtaggtcagtgcctcgaacgttcggcccagggaccacgagtggatagtcgaggtcgaatggtcggctggccaccattcctgtcttacncttccttcccgtcc

SEQ ID NO: 244758 - DNA, 577 bp, Homo sapiens
  misc_feature: GYAE6OF01B5ULP.5.59.F04.1.454.CMB.1.raw
  modified_base (197)..(197): a, c, t, g, unknown or other
  misc_feature (197)..(197): n is a, c, g, or t
  modified_base (351)..(351): a, c, t, g, unknown or other
  misc_feature (351)..(351): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccaccctctcctgcagggccagtcagaatgttaccaacaggttcgtagcctggtaccagcagaaacctggccaggttcccagcctcctcatctatggtatactccacgagggccacgtggcactcccagactaggttcagtgcaggcgggtntgggactaggacttcacgtctcacatcagcagacgtggacgccgtagaagtagttttgacgtagtgttattactgtactagatagtagtggtacgcgttacgacggtacgttcggacgaacgggaacgtaagggtaggaactacgaaacgtacgtaggtacgacggtcgacacctacgttctacgttacgttacgttacttacccttcccggtcctacgttaccgg

SEQ ID NO: 244759 - DNA, 596 bp, Homo sapiens
  misc_feature: GYAE6OF01ER3UA.5.59.F04.1.454.CMB.1.raw
  modified_base (194)..(194): a, c, t, g, unknown or other
  misc_feature (194)..(194): n is a, c, g, or t
  modified_base (230)..(230): a, c, t, g, unknown or other
  misc_feature (230)..(230): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctcgaggggaaangccaccctctcctgcaggccagtcagatgtaccaanggttcgagcctggtaccagcagaacctggcctaggtcccagccctctcatctatggtatactccaccgagggcccacgtggaccactccccaagtacctaggttcaggttcggacagggccggggttactggggaacaggtacttcactctaccacatcagcagtcgtgacgccgtagaagtatttgagtagttagttattacgtgtacgagtcgtagtagtggtacgtctacggtaacggtaccggttacggaaccgtaacgggaaccgtaagggtaacgaaacgtacgaaacggtacgtacggtaggacgtacgacactacgtcgttgtaccttactacgttacccttcccgtctacgttaccg

SEQ ID NO: 244760 - DNA, 556 bp, Homo sapiens
  misc_feature: GYAE6OF01B9W01.5.59.F04.1.454.CMB.1.raw
  modified_base (195)..(195): a, c, t, g, unknown or other
  misc_feature (195)..(195): n is a, c, g, or t
  modified_base (236)..(236): a, c, t, g, unknown or other
  misc_feature (236)..(236): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaanagccaccctctcctgcagggccagtcagaatgttaccaacnggttcgtagcctggtaccagcagaaacctggccaggttcccagcctcctcatctatggtatatccaccagggccactggcatcccagacaggttcagtgcagcggtntgggacngacttcactctcacatcagcagactggagcctagaagtatttgactagtgttattactgtcagtcagtagtggtagctcgaccggtacgttcggaccgtaacgggaccgtaagggtacggaagtaccgaaacgtacgtaggtacggtacgtgaccgacgtacttaccgtcgttaccttctacttcccgttcccgtcctacgttccg

SEQ ID NO: 244761 - DNA, 560 bp, Homo sapiens
  misc_feature: GYAE6OF01AV7BG.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccgaggggaaangcccaccctctcctgcgagggccagtcagatgttaccaacaggttcgtagcctggtaccagcagaacctggccacggttccccgctcctcatctatggtatactcccaccgagggcccacgtggccactcccagactaggttcaggtcggcaggcgggtctagggacagacttcactcctcaccatcagcagtacgtggacgcctagagtagtttgctagttgtacttactgtacagctagtagtggtagctacgacggtacgttcggacgaacgggaccaagggtagaactacgaacgtacgtggtcgactacgcctacacgtcgtcgtccttacgtacttcccgtaccccgctcgtcgtacgg

SEQ ID NO: 244762 - DNA, 572 bp, Homo sapiens
  misc_feature: GYAE6OF01CNXEO.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaangcccaccctctcctgcagggccagtcagaatgtaccaacaggttctagcctggaccagcaagaacctggccaggttcccagcctcctcatctatggtatatccacgagggccacgtggcatcccagacaggttcagtggcaggtcgggtctgggacaggacttcactctcacatcagctagactggacgcctagaagtatttgctagtgtaattactgtacgtagtctagttagtggtagcgttacgacggtacgttccggaccggtaagggaccgaagggttaaggaactaaccgaaacgtaacgtggtcggtacgtagaccgtaacctcttacgttcgtccttactacgttccttaccccgcttacgttccg

SEQ ID NO: 244763 - DNA, 678 bp, Homo sapiens
  misc_feature: GYAE6OF01C6HX4.5.59.F04.1.454.CMB.1.raw
  modified_base (196)..(196): a, c, t, g, unknown or other
  misc_feature (196)..(196): n is a, c, g, or t
  modified_base (434)..(434): a, c, t, g, unknown or other
  misc_feature (434)..(434): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgtctccgaggggaaanacgccaccctctcctgcgacgggccagtcagtaatcgttaaccaagtaggttacgtagccgtaggtaccaggacaagaaacctgggacctacggttcccagtcctcctcactctagtggtatactccaccgacggccacgtgccactcccgagacctaggttcagtcggcaggtcgggtacgtagggacacgtaccgttcaacgttccgacacctatcgaggcaggtacgtcgggacnccgtagtaagttagtttacgacgttagttagttacgttactcgtacgatacgtaaggttacgtagggtatcgtacggacgggtaccggtcggtaccgaaagggtaccgaagggttaaggaaaccgttaacgaaaacgggtcgtaagggtcggaccgttacggaccctaacggtactttcccggttacgtttacccgtttaccgtaacgtttccccgtttccccgggtaccttaacgtttcccgg

SEQ ID NO: 244764 - DNA, 554 bp, Homo sapiens
  misc_feature: GYAE6OF01BTQ5N.5.59.F04.1.454.CMB.1.raw
  modified_base (197)..(197): a, c, t, g, unknown or other
  misc_feature (197)..(197): n is a, c, g, or t
  modified_base (237)..(237): a, c, t, g, unknown or other
  misc_feature (237)..(237): n is a, c, g, or t
  modified_base (385)..(385): a, c, t, g, unknown or other
  misc_feature (385)..(385): n is a, c, g, or t
  modified_base (404)..(404): a, c, t, g, unknown or other
  misc_feature (404)..(404): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccaccctctcctgcagggccagtcagaatgttaccaanggttcgagcctggtaccagcagaacctggccaggttcccagcctcctcatctatggtatactccacgagggccactggccatcccagacaggttcagtggcaggcgggtctgggacagacttcactctcaccatcagcagactggacnctagaagtatttgctagtnttattactgtacgagtctagtgtggtacgcgtcgacgggtacgtccggaccgtaacgggaacgtaagggtacgaaacgtaccgaaacgtacgtacggtacgtcgtcgaccactacgttcgtgttccttacacttccgtccctccgtatcg

SEQ ID NO: 244765 - DNA, 536 bp, Homo sapiens
  misc_feature: GYAE6OF01CPSQ0.5.59.F04.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (526)..(526): a, c, t, g, unknown or other
  misc_feature (526)..(526): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccaggggaaangccaccctntcctgcagggccagtcagaatgttaaccanggttcancctggacngcagaactgccagtccagcctcnatctatggtatactcccaccgagggccaagtggcacgtcccagacgaggtttcagtggcaggccgggtntgggacngacttcactcncacntcagcagacgtggacgcctagagtatttgctagtagttatacgtgtacgagcagtagtggtagctcgaacggtcgtacggaccgaaggacaaggtaggaatacgaaacgtagtaggtgacgtcgacgaccgtatctacggttcttactacttccgttaccccgntacgttccgg

SEQ ID NO: 244766 - DNA, 535 bp, Homo sapiens
  misc_feature: GYAE6OF01BFGX9.5.59.F04.1.454.CMB.1.raw
  modified_base (196)..(196): a, c, t, g, unknown or other
  misc_feature (196)..(196): n is a, c, g, or t
  modified_base (371)..(371): a, c, t, g, unknown or other
  misc_feature (371)..(371): n is a, c, g, or t
  modified_base (389)..(389): a, c, t, g, unknown or other
  misc_feature (389)..(389): n is a, c, g, or t
  modified_base (498)..(498): a, c, t, g, unknown or other
  misc_feature (498)..(498): n is a, c, g, or t
  modified_base (531)..(531): a, c, t, g, unknown or other
  misc_feature (531)..(531): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaaccaacaggttcgtagcctggtaccagcaagaacctggccaggttcccagcctctcatctatggtatactccacaggccactggcactccagacaggttcagtgcagcggtctgggacagacttcactctcaccatcgancagactgagctagaagtntttagactagtagtattatgtcagtcagtagtggtagcgtcgaacggtacgttcggacgaagggaccgaaggtagaacgtacaaacgtacgtagtaggacgtcgacacncgttctacgtacttactacttccttacccgctntacg

SEQ ID NO: 244767 - DNA, 648 bp, Homo sapiens
  misc_feature: GYAE6OF01BR3R0.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctgactcccagatgccaaccggaaagactgtgttgacgcagtctccaggcacctgtctttgtctccgaagggaaangccacctctcctgcgagggccagtcaagaatcgttaaccaacgaggttcgagcctaggtaccagacaagaacgccgtggcctaggttcccagtccctcctcactctatggtatactccaccgacggcctacgtggcactcccgagacgtacgggttcaggtcggacgtacggcgggtactggggacagtacttcacgtctacacatcgagcgagtacgtggacgaccgtagtaagtattttacgacgttaggtagttaattacgtaggtactacgacgtaggttagttaggtacgtcgtacggaaccggtaccggttaccgggtaccggaaacgggtaaccggtaagggtaacggtaaaacgtaaccgtaaacgtaaaccgtaggtacgggtcgtacgaccgtaccgtactcgttacgttacgttacgtacttccgttcccgtccgttacg

SEQ ID NO: 244768 - DNA, 542 bp, Homo sapiens
  misc_feature: GYAE6OF01BR52X.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcggtctgggacagacttcactctcaccatcagcagactggagcctagaatattttgctagttgtatttacgtgttacagtcagtatggtagctcgacggtacgttcggaccgaacgggaccgaaggtaggaagtacgaaacgtaacgtgtaggcgtcgacacgacttcgtgttacttcacgttcccttcccgtctcgttaccg

SEQ ID NO: 244769 - DNA, 541 bp, Homo sapiens
  misc_feature: GYAE6OF01BWYXT.5.59.F04.1.454.CMB.1.raw
  modified_base (197)..(197): a, c, t, g, unknown or other
  misc_feature (197)..(197): n is a, c, g, or t
  modified_base (354)..(354): a, c, t, g, unknown or other
  misc_feature (354)..(354): n is a, c, g, or t
  modified_base (426)..(426): a, c, t, g, unknown or other
  misc_feature (426)..(426): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaancgcccaccctctcctgcagggccagtcagaatgttaccaacaggttcgtagcctggtaccagcagaaacctggccaggttcccagcctcctcatctatggtatactccaccgagggccactggcactcccagactaggttcagtcgcaggcgggtcngggacagacttcactctcactatcagcagactgacgcctagatatttgctagtgtattctgtatagctagtntggtagctacgacggtacgttcggaccgtaacggacgaagggtagaaactacgaaacgtagtaggtggcgtacgacgacctagtctagttcttactacttacctcccgctattcg

SEQ ID NO: 244770 - DNA, 553 bp, Homo sapiens
  misc_feature: GYAE6OF01BPE2T.5.59.F04.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (372)..(372): a, c, t, g, unknown or other
  misc_feature (372)..(372): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctntcctgcagggccagtcagaatgttaaccaactaggttcgagcctggtaccagcaagaacctggccaggttcccagcctctcatctatggtatactccaccgagggccacgtggcactcccagacgaggttcagtcggcaggcgggtctgggacagtacttcactcncaccatcagcagacgtggacgtcctagtaagtagtttgacgtagttagtattacgtgtacagctagtagtggtagtctcgacgtacggttacggacgtaacgggacgaaggtagaacgtaacgaaacgtaacgtggtacgacgtacgacactctactgtcttctactacctcccgctgtcg

SEQ ID NO: 244771 - DNA, 632 bp, Homo sapiens
  misc_feature: GYAE6OF01DOFFX.5.59.F04.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagctgtgttgacgcagtctccaggccaccctgttctttgtctccgaaggggaaancgcccaccctctcctgcgagggccagtcagaatcgtaccaagtggttcgagccgtggaccngcagaacctggccaggtcccagcctcctacatctagtggtactactcccacgacgggtccacgtggccactccccgaagacgtaggttcaggtggcgagggccggttcgtaggggaacctacggtacctttcgaaccttccgtaccaacatcgacgactaacggacgtggacgtcgtagtaagttatttcgacgttagtgttacttacgtcgtactagtctagttagttggtagtccgtacgacggtaccgttccggaccgtaacggaaccgtaaggttaacgaacgtaacgaaacgtagtacgtagtccgtcgacgtaccgtattccgtagttaccttactaccgttcccgttaccccgcgtacgttccg

SEQ ID NO: 244772 - DNA, 662 bp, Homo sapiens
  misc_feature: GYAE6OF01BUJ4G.5.59.F04.1.454.CMB.1.raw
  modified_base (193)..(193): a, c, t, g, unknown or other
  misc_feature (193)..(193): n is a, c, g, or t
  modified_base (229)..(229): a, c, t, g, unknown or other
  misc_feature (229)..(229): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccaggggaangccaccctctcctgcagggccagtcagatgtaccanggttcagcctggtaccagcagaaacctggccaggttcccagcctcctcatctatggtatatccacgaggccactggcactcccagacaggttcagtggcaggcgggtctaggggacaggtaccttcgaccttcgtcacctatcagccagtacgtgggacgccctaggaacgttacgttttcgacctaaggtttgttaactttaaccgtgttaccgaaggtcctaaggttagtacgggttaacgtccgttacgaacccgggtaccggtttccggggaacccgtaaacggggtaacccgtaaggggttacgggaaactaccggaaaaccggtaacgttcgggtacggtaccgtacggtaccccaaccgttacgttccgttacgttaccctttacctacgtttccccgtttacccccggtccttaaccgttcccgg

SEQ ID NO: 244773 - DNA, 574 bp, Homo sapiens
  misc_feature: GYAE6OF01CDK3W.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
  modified_base (383)..(383): a, c, t, g, unknown or other
  misc_feature (383)..(383): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctntcctgcagggccagtcagaatgtaccaanaggttcagcctggaccagcagaacctggccaggttcccagcctcctcatctatggtatatccaccagggcccactggcatcccagacctagggttccaggtggcaggccgggtntgggacngacttcactctcacntcagcagctggacnctagagtatttgctagttgtattactgtcagtctagttagtaggtagccgtacgacggtaccggttcggaccgtaaacgggacctaagggtaggaacgtaacgtaaacgtaacgtacggtaggtccgtacgacctaacgtacttccgttagttaccttactacgttcctttaccccgtcctacgttaccgg

SEQ ID NO: 244774 - DNA, 757 bp, Homo sapiens
  misc_feature: GYAE6OF01CFGW1.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccaggcaccctgtctttgtctccgaggggaaancgccaccctctctgcagggccagtcagaatgttaccaagtaggttcgagcctggtaccagcaagaacctggacctaggtcccagcctcctcatctagtggtatactcccacgagggcccacgtggaccacgtcccaagtacctagggttccaggtcggccgaggtccgggtcgtaggggactaacggtacctttcactctaccgtaccatcgagtcgaagtaccgtaggacgtaccgtaggtaacgttagttttaggacgttaggttacgttaacgtttaccgtaggttaccgtaacgtacgtaaggttaacggttagggttaacgtaccgttacccggtaaccgggttaaccgggtttacccggggtaaacccgggtaaacgggggtaaacccggtaaacgggggttaacgggtaaaaccgttaaaccggtaaaaccgggttaaacggttacgggttaaccgggtacggttaaccggacccggtaaccctacgtttaccgttacgtttacccgtttaccttaccgttcccgtttaccccgtcccgttaacgtttacccgg

SEQ ID NO: 244775 - DNA, 543 bp, Homo sapiens
  misc_feature: GYAE6OF01CTQT8.5.59.F04.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (440)..(440): a, c, t, g, unknown or other
  misc_feature (440)..(440): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaancgcccaccctctcctgcagggccagtcagaatgttaccaanaggttcgtagcctggtaccagcaagaaacctggccaggttcccagcctcctcatctatggtatactccaccgagggccacgtggccatcccagacaggttcaggtggcaggcgggtctgggacagtacttcactctcacatcagcagactggactcctagaagttatttgactagtgttaattctgtcagctagtatggtanctcgacggtaccgttcggaccgaagggaccgtaagggtagaactacgaaacgtagtgtaggcgcgacactatcgtagtcttacacttccttcccgcctgtccg

SEQ ID NO: 244776 - DNA, 536 bp, Homo sapiens
  misc_feature: GYAE6OF01B3G7J.5.59.F04.1.454.CMB.1.raw
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctcaggcaccctgtctttgtctccaggggaaanagccaccctctcctgcagggccagtcagaatgttaccaacgnggttcgtagcctggtaccagcagaaacctggccaggttcccagcctcctcatctatggtatatccaccagggccactggcatcccagacaggttcagtgcagcggtctgggacagacttcactctcaccatcagtcagactggagcctagaagtatttgcgtagtgtattactgtctagctagtatggtagcgtcgacggtacgttcggaccgtaaggaccgaagggtacgtaaatacgaaacgaagtacggtaggcgtcgacacctagtctcgtcgttctactcttcccgtctagtcg

SEQ ID NO: 244777 - DNA, 557 bp, Homo sapiens
  misc_feature: GYAE6OF01AZRM5.5.59.F04.1.454.CMB.1.raw
  modified_base (192)..(192): a, c, t, g, unknown or other
  misc_feature (192)..(192): n is a, c, g, or t
  modified_base (230)..(230): a, c, t, g, unknown or other
  misc_feature (230)..(230): n is a, c, g, or t
  modified_base (377)..(377): a, c, t, g, unknown or other
  misc_feature (377)..(377): n is a, c, g, or t
  modified_base (427)..(427): a, c, t, g, unknown or other
  misc_feature (427)..(427): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctcaggggaangccaccctctcctgcaggccagtcagaatgttaccaanaggttcgtagcctggtaccagcagaaacctggccaggttcccagcctcctcatctatgtatactccacgagggccactggcactcccagacaggttcagtgcaggcggtctgggacagacttcactctcacatcagcagactggacncctagaagtatttgactagtgtaattacgtgtacagtctagtagtggtancgtacgacggtacgttacggaccgtaacgggtaccgaaggtacggtaaacgtacgtaaacggtaacgtaggtacggtacgtcgtaccgacgtacttcgtacgttcttactacttcctcccgtctgttccg

SEQ ID NO: 244778 - DNA, 574 bp, Homo sapiens
  misc_feature: GYAE6OF01A9MA1.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaanagccaccctctcctgcagggccagtcagaatgttaccaacaggttcgtagcctggtaccagcaagaaacctggccaggttcccagcctcctcatctatggtatactccaccgagggccactggcatcccagacaggttcagtggcagcggtctgggacagacttcactctcacatcagcagacgtggacgcctagaagtattttgcgtaagtcgtatttacgtgtactagactagtataggtagctcgcggtacgttcggaccgtaagggaccgaagggtacgaacgtacgaaacgaacgttaggtacggtacgtacggacaaccgtacttccgtacgttaccttacctacttacccgttccccgtctacgttcccg

SEQ ID NO: 244779 - DNA, 727 bp, Homo sapiens
  misc_feature: GYAE6OF01DFP6L.5.59.F04.1.454.CMB.1.raw
  modified_base (147)..(147): a, c, t, g, unknown or other
  misc_feature (147)..(147): n is a, c, g, or t
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (481)..(481): a, c, t, g, unknown or other
  misc_feature (481)..(481): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaanactgtgttgacgcagtctccaggcaccctgtcttgtctccgaaggggaaangcccaccctntcctgcagggccagtcagaatgttaccagtaggttcagcctggaccagcagaactgcaggttcccagcctccnactctatgtatactccacngggtccacgtcggcactcccgagaacgtacggttcgaggtcggaccagggtccggggtacgtaggggaacacggtaccttccaccgttcaccgtaacctactacgaacgcgaacgtacgtacggaacgtcccgtaagtaacgttacttttaggaccgttaaggttacgttaatttaccggngttaccgagtaccgttaaggttaagtcgggttaacgtccgttacggtaaccgggtaccggtttacccggaacccgggttaaacgggaaccggtaacgggttaacgggtaaacctaaaccggtaaaaccggtaaacgttcgggtacgtacccgttacggtaacccgtaacccgtacgttaccgttaccggttacccctttacgtaacccgttttcccccgtaccccggtacttaccggtttacccgg

SEQ ID NO: 244780 - DNA, 556 bp, Homo sapiens
  misc_feature: GYAE6OF01EYZDF.5.59.F04.1.454.CMB.1.raw
  modified_base (196)..(196): a, c, t, g, unknown or other
  misc_feature (196)..(196): n is a, c, g, or t
  modified_base (394)..(394): a, c, t, g, unknown or other
  misc_feature (394)..(394): n is a, c, g, or t
  modified_base (525)..(525): a, c, t, g, unknown or other
  misc_feature (525)..(525): n is a, c, g, or t
  modified_base (549)..(549): a, c, t, g, unknown or other
  misc_feature (549)..(549): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctcaggcaccctgtctttgtctccgaggggaaangccaccctctcctgcgagggccagtcagaatgttaaccaactaggttcgtagcctggtaccagcaagaaacctggaccacggttcccagcctcctcatctatggtatactccaccgagggccacgtggcactccagacaggttcagtgcaggcggtcgtgggacagtacttcactctcactatcagcagacgtggacnccgtagtaagtatttgactagtgtattactgtacagctagtagtggtacgtctcgacggtacgtccggacgaacgggaccgtaaggtacgaacgtacgaaacggtactaggtaggtacgtcgtacaccgtntcgtgttcttactactccttcccnctattcg

SEQ ID NO: 244781 - DNA, 554 bp, Homo sapiens
  misc_feature: GYAE6OF01EOF2P.5.59.F04.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacnggttcgagcctggtaccagcagaaacctggccaggttcccagcctcctcatctatggtatatccaccagggccacgtggcatcccagacaggttcagtggcagcgggtctggggacagacttcactctcacatcagcagactggacgcctagaagtattttgctagtgtattactgtcagctagtagtggtagtctcgacggtacgttcggaccgtaagggaccgtaagggtacggaaagtaccgaaacgtaacgtaggtaggtcgtggaccaccgtacgttcgtcgtacgttctacttcccttccccgcctgttccg

SEQ ID NO: 244782 - DNA, 551 bp, Homo sapiens
  misc_feature: GYAE6OF01EKUJ7.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagcccaccctctcctgcagggccagtcagaatgttaccaacaggttcgtagcctggtaccagcagaacctgccaggttcccgctcctcatctatgtatactccaccgagggccacgtggcactcccagactaggttcagtggcaggcggtctgggacagacttcactctcaccatcagcagactggacgcctgaagtatttgactagttgtattactgtcagtctagttagtggtagtctacgacggtacgttacggaccgaagggaccgtaaggtacggtaagtacgaaacgaacgtggtacggcgtagacctacatcttcgtcttacgtacttccttacccgctagtcgtacg

SEQ ID NO: 244783 - DNA, 554 bp, Homo sapiens
  misc_feature: GYAE6OF01BYKI0.5.59.F04.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacnggttcgtagcctggtaccagcagaaacctggccaggttcccagcctcctcatctatggtatatccacagggccacgtggcatcccagacaggttcagtggcaggcgggtctgggacagacttcactctcaccatcagcagactggagcctgaagtatttgctagtgtattactgtcagctagtatggtagctcgacggtacgttcggaccgtaacgggaccgaagggtaggaaacgtacgaaacgtaacgtggtaggacgtcggacaaccgtataccgttggttaccttctacgttccttcccccgtcctacgttccg

SEQ ID NO: 244784 - DNA, 563 bp, Homo sapiens
  misc_feature: GYAE6OF01D2KCZ.5.59.F04.1.454.CMB.1.raw
  modified_base (198)..(198): a, c, t, g, unknown or other
  misc_feature (198)..(198): n is a, c, g, or t
  modified_base (397)..(397): a, c, t, g, unknown or other
  misc_feature (397)..(397): n is a, c, g, or t
  modified_base (444)..(444): a, c, t, g, unknown or other
  misc_feature (444)..(444): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaancgcccaccctctcctgcagggccagtcagaatgttaccaataggttcgtagcctggtaccagcaagaaacctggccaggttcccagccctcctcatctatggtatactccaccgagggccacgtcggcactcccagactaggttcaggtgcgaggcgggtcgtgggacagacttcactctcacatcagcagactggacncgtagaagtatttgactagtgtattactgtacagtctagtatggtanctcgacggtacgttcggaccgtaaacggaccgaaggtagaactacgaaacgtacgtcgtacggcgtcgacgtactactcgttacgttcgttactacttcccgttcccgtctacgttccg

SEQ ID NO: 244785 - DNA, 546 bp, Homo sapiens
  misc_feature: GYAE6OF01DX348.5.59.F04.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (282)..(282): a, c, t, g, unknown or other
  misc_feature (282)..(282): n is a, c, g, or t
  modified_base (361)..(361): a, c, t, g, unknown or other
  misc_feature (361)..(361): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctccaggggaangccaccctntcctgcagggccagtcagaatgttaccaacaggttcgtagcctggtaccagcagaaacctggccaggttcccagcctcncatctatggtatatccacaggccatggcatcccagacaggttcagtggcagcgggtctgggacagacttcactctcacntcagcagactggagcctgaagtattttgctagtagtattactgtcagctagtatggttagctcgaaccggtacgttaccggaccgtaagggaccgtaaggtaggaaactacgaaacgtaacgtggtaggcgtagacgacctacgttaccgtgttccttacgaacttcccttaccccgctactccg

SEQ ID NO: 244786 - DNA, 701 bp, Homo sapiens
  misc_feature: GYAE6OF01CTOTL.5.59.F04.1.454.CMB.1.raw
  modified_base (195)..(195): a, c, t, g, unknown or other
  misc_feature (195)..(195): n is a, c, g, or t
  modified_base (380)..(380): a, c, t, g, unknown or other
  misc_feature (380)..(380): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatgccaccggaaagactgtgttgacgcagtctccaggcaccctgtctttgctccgaggggaaancgccaccctctcctgcagggccagtcagaatgttaaccaataggttcgagcctggtaccagcaagaacctggaccaggttcccagcctcctcactctatggtatactccaaccagggccacgtggacactcccaagactaggttcagtggcaggcgggtctgggacaggacttcgactctcaccntccgagccaagaccgtggacgtacctagtaagtacgttttcggacgtaaggttgttaactttacgtacggttaccgtaagtaccgtaagttacgttacgggttacgtacgttacggtaaccgggttaccggttaccgggtaacccgaaaccggggtaaccggaaacggggttaacggtaaacggttaacggaaaaaccggtaaacggtacgggttaacgggtaccgtacggtacccgtaacccggtaacgttaccggttacgtttaaccgttaccgtaaaccgtttacccgttaccccggtacccttaaccgtttacccgg

SEQ ID NO: 244787 - DNA, 571 bp, Homo sapiens
  misc_feature: GYAE6OF01D54DT.5.59.F04.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
  modified_base (344)..(344): a, c, t, g, unknown or other
  misc_feature (344)..(344): n is a, c, g, or t
  modified_base (390)..(390): a, c, t, g, unknown or other
  misc_feature (390)..(390): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacnggttcgtagcctggtaccagcaagaaacctggccaggttcccagcctcctcatctatggtatatccaccagggccactggcatccagacagttcagtggcagcggtcngggacagacttcactctcacatcagcagactggacgcctagaagtntttagcgtagtagtattacgtgtcagtcgtagttagtggtagctacgaacggtacgttacggaccgtaagggaacctaaggtaggaaactacgaaaaccggtaacgtggtacggtcgtcgacctaaccgtacttccgtcgttacctttcctaacttcccgtttaccccgcctagttacccg

SEQ ID NO: 244788 - DNA, 524 bp, Homo sapiens
  misc_feature: GYAE6OF01C2SAZ.5.59.F04.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
  modified_base (343)..(343): a, c, t, g, unknown or other
  misc_feature (343)..(343): n is a, c, g, or t
  modified_base (390)..(390): a, c, t, g, unknown or other
  misc_feature (390)..(390): n is a, c, g, or t
  modified_base (521)..(521): a, c, t, g, unknown or other
  misc_feature (521)..(521): n is a, c, g, or t
tcagatcagacacgcacgaccggtgctcgatttagtacacacactttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangcccaccctntcctgcagggccagtcagaatgttaccaanggttcagcctggaccngcagaaacctggccaggttcccagcctcctcatctatggtatatccaccagggccactggccatcccagacaggttcagtggcaggcggtntgggacagacttcactctcaccatcagcagactggagcctagaagtntttgactagtgttattactgtcagtcagttagtaggtagccgtcgacgggtacggttccggacgtaagggaccgtaagggtaggaatacgaaacgactgtgctgcacatctgtcttcactccttcccgctntcg

SEQ ID NO: 244789 - DNA, 618 bp, Homo sapiens
  misc_feature: GYAE6OF01EPYNY.5.59.F04.1.454.CMB.1.raw
  modified_base (194)..(194): a, c, t, g, unknown or other
  misc_feature (194)..(194): n is a, c, g, or t
  modified_base (335)..(335): a, c, t, g, unknown or other
  misc_feature (335)..(335): n is a, c, g, or t
  modified_base (380)..(380): a, c, t, g, unknown or other
  misc_feature (380)..(380): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctccgaggggaangccaccctctcctgcagggccagtcaagaatcgttaccaacgtaggttcgtacgcctggtaccagcaagaaaccgtggacctaggttcccagccctctcatctatggtatactccacgaggccacgtggcactcccagacnggttcagtcggcaggcgggtctgggacagtactcactctcactancgagcagactggactccgtagaacgtgtttgactaggtagttaactttacgtagtacgtagacgtaggttagtagggttacgaccgtacggaccgggtaccggttccggaaccgtaaagggacccgtaaggtacggaaactaccgaaacggtaacgtgggtacggtacgtacgaccgtaactacgttacgtacgtttaccgttaccaaccgtttcccgtaccccgtctaacgttccgg

SEQ ID NO: 244790 - DNA, 590 bp, Homo sapiens
  misc_feature: GYAE6OF01CQ4RQ.5.59.F04.1.454.CMB.1.raw
  modified_base (197)..(197): a, c, t, g, unknown or other
  misc_feature (197)..(197): n is a, c, g, or t
  modified_base (241)..(241): a, c, t, g, unknown or other
  misc_feature (241)..(241): n is a, c, g, or t
  modified_base (362)..(362): a, c, t, g, unknown or other
  misc_feature (362)..(362): n is a, c, g, or t
  modified_base (455)..(455): a, c, t, g, unknown or other
  misc_feature (455)..(455): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaaggggaaancgccaccctctcctgcgagggccagtcaagtatcgttaaccaanaggttcgtaagccctggtaaccagaccaagaaaccttggccaggttcccaagccctctcatctatggtatactccacgagggccacgtgctatcccagacaggttcagtggacaggcggtngggacagacttcactctcaccatcaagcagactgacgcctagaagtattttgactagtagttattacgtagttcaagctaggtaagtggtaanccgtacgtacgggtaaccgttcggacccgaaagggtaacccgaaaggttaacggaaagtaactaaacggaactacggtagaccgtcgacgacctagttctcgttattcctaatccctttacccgcctattacccg

SEQ ID NO: 244791 - DNA, 934 bp, Homo sapiens
  misc_feature: GYAE6OF01B59XH.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccgaggggaaancgcccaccctctcctgcagggccagtcagaatcgtaccaacgtaggttcgagcctggtaccagacaagaaacctggacctagggttcccagcctcctcatctatggtatactccaccgagggcccacgtcggcctaacgtcccgaagtaccgtagggtttaccaggtcgggccctaaggggtccgggggttcgtacggggggaaacctaacggttaacccgttttacccgaaacgttccctaaccgaacccctacgttacccgaaaggcccgtaaacgggttaaccgttcggggtaaccgtacccgttaacgggtaaagttaacgttttttacgggaaccgttaacgggtttaacggtttaaacgttttaaccggtttacggttaaccgtaacgggtaacccgtttaaaggggttaacgtttaacgggggttaaccggtacccgtttaacccggggtaaaccggggttaaacccggggttttaacccgggggaacccgggttaaaaccggggggtaaacccgggttaaaaaccgggggttaagggtaaaaccgttaaaccgggaaaaacccgggttaaaaccgggttacgggttaaccggggtaccggttaccgggtaaccccgtaaaccggttaacccgtttaccggggtttaacccgttcccgttttaacccgttaaacccgttttaccccccggtttaacccccggttaacccgttacccggtttaacccggg

SEQ ID NO: 244792 - DNA, 552 bp, Homo sapiens
  misc_feature: GYAE6OF01BRR2O.5.59.F04.1.454.CMB.1.raw
  modified_base (196)..(196): a, c, t, g, unknown or other
  misc_feature (196)..(196): n is a, c, g, or t
  modified_base (237)..(237): a, c, t, g, unknown or other
  misc_feature (237)..(237): n is a, c, g, or t
  modified_base (520)..(520): a, c, t, g, unknown or other
  misc_feature (520)..(520): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangcccaccctctcctgcagggccagtcagaatgttaccaacnggttcgtagcctggtaccagcaagaaacctggccaggttcccagcctcctcatctatggtatactccaccgagggccactggcactcccagacaggttcagtgcaggcgggtctgggacagacttcactctcaccatcagcagacgtggacgaccgtagaagtatttgactagtgtattacgtgtacagtcgtagtagtggtagctacgacggtacgttcggaccgtaagggaccgtaagggtacgaagtacgaaacgtaacgtagtcggacgtcgacacgtntcgtagtcttactacttccttcccgctcgtcg

SEQ ID NO: 244793 - DNA, 549 bp, Homo sapiens
  misc_feature: GYAE6OF01DJEHE.5.59.F04.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (361)..(361): a, c, t, g, unknown or other
  misc_feature (361)..(361): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccaccctctcctgcagggccagtcagaatgtacaanaggttcgagcctggaccagcaagaaacctggccaggttcccagcctcctcatctatggtatactccacagggccactggccatcccagacaggttcagtgcagcggtctgggacagtactcactcncaccatcagcagacgtggagccgtagaagtattttgactagtagttattacgtgtcagactagtagtggtagtcgtacgacggtacgttcggacgtaacgggaaccgaaggtaacggaataacgaaacgtaacgtaggaggacgtcgacacctatctcgttctactacttccttcccgtcctcgtacg

SEQ ID NO: 244794 - DNA, 563 bp, Homo sapiens
  misc_feature: GYAE6OF01EHCFS.5.59.F04.1.454.CMB.1.raw
  modified_base (196)..(196): a, c, t, g, unknown or other
  misc_feature (196)..(196): n is a, c, g, or t
  modified_base (392)..(392): a, c, t, g, unknown or other
  misc_feature (392)..(392): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccacggttcccagcctcctcatctatggtatatccacagggccactggcatcccagacaggttcagtggcagcgggtctgggacagacttcactctcacatcagcagactggagcctagaagtnttttgactagtgttattacgtgtcagctagtatggtatcgtacgacgggtacgttacggaccgtaaacgggaccgtaagggtacggaaacgtacgaaagtacgtaggtacggacgtcgacaaccgtacttacgtcgttcgttacagttccctttaccccgcctagtacccg

SEQ ID NO: 244795 - DNA, 587 bp, Homo sapiens
  misc_feature: GYAE6OF01DK3L5.5.59.F04.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
tcagatcagacacgcacgaccggtgctcgatttagtacacacacttagggattggggtgctcagttaggacccagagggaaccatggaaaccccagcgcagcttctcttcctctgctactctggctcccagatgccaaccggaaagactgtgttgacgcagtctccaggcaccctgtctttgtctcgagggaangccaccctntcctgcaggcagtcagatgtacacgagttcganctgacagcagaactggcaggtccagcctctcatcgtatggtatactccacgaggccactgacactccagacaggtnaggtgcagcggtctgggacagacttcactcacacatcagcagacgtgagcctagaagtatttcgactagtacgttaattacgtgtcgtaagtcgtagttagttacggtagtcgtacggaaccggtacggttacccgggaccggtaaaccgggtaaccggtaaacggttaagggaaacgtaaaccgtaaaacggtaaacgtacggtaggacgtacgtacctaccgtacgttacgttacgttaccttctaacttcccttcccggtacctcgttaccg

SEQ ID NO: 244796 - DNA, 569 bp, Homo sapiens
  misc_feature: GYAE6OF01CBCVH.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccaccctctcctgcagggccagtcagaatgttaccaactaggttcgtagcctggaccagcagaacctggccaggttcccagcctctcatctatggtatactccaccgagggccacgtcggcactcccagacaggttcagtggcaggcgggtctgggacagacttcactctcacatcagcagacgtggacgccgtagaagtatttgctagtagttattacgtgtctagtctagtagtaggtacgcgtcgacggtacggttacggaccgtaacgggaccgtaaggtacggaatacgaaacgaacgtaggtacggacgtgaccacctagtcgttagttaccttactacttccgttcccgtccgtacgttaccg

SEQ ID NO: 244797 - DNA, 604 bp, Homo sapiens
  misc_feature: GYAE6OF01EPFAO.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaactccagcgcagcttctcttcctcctgctactctggctcccagatgccaccggaaagactgtgttgacgcagtctccaggcaccctgtctttgtctccgaggggaaangccaccctctcctgcagggccagtcagaatgttaccaacaggttcagcctggtaccagcagaaacctggccaggttcccagcctcctcatctatggtatactccaccgagggccacgtcggaccactcccgaagacgtacggttcaggtcggcgaggtcgggtacgtaggggactagacctttcactctaccaaccatcgagtcaagtacgtggacgtaccgtagtaacgtagttttacgacgtaggttagttaactttacgttagtacgagtacgtagtagtggtagtcgtacgacgggtacgttacgggaccgaacgggtaccgaacgggtagaacgtacgaaacggtaacgtaggtaggtcgtagactacgatcgtacgttcttactacttccttccgcctacg

SEQ ID NO: 244798 - DNA, 532 bp, Homo sapiens
  misc_feature: GYAE6OF01C3HMR.5.59.F04.1.454.CMB.1.raw
  modified_base (196)..(196): a, c, t, g, unknown or other
  misc_feature (196)..(196): n is a, c, g, or t
  modified_base (507)..(507): a, c, t, g, unknown or other
  misc_feature (507)..(507): n is a, c, g, or t
  modified_base (527)..(527): a, c, t, g, unknown or other
  misc_feature (527)..(527): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangcccaccctctcctgcagggccagtcagaatgttaccaacaggttcgtagcctggtaccagcaagaaacctggaccaggttcccagcctcctcatctatggtatactccaccgagggccacgtggcactcccagacaggttcaggtggcaggcggtctggggacaggtacttcactctcaccatcagacagactggacgcctgaagtatttgctagtattattctgtcagctagttatggagtctacgacggacgttcggaccgtaagggacgaaggtaggaactacgaaacgtacgtgtgacgtgacacntctagcttacacttctcccntctcg

SEQ ID NO: 244799 - DNA, 806 bp, Homo sapiens
  misc_feature: GYAE6OF01CNZGV.5.59.F04.1.454.CMB.1.raw
  modified_base (200)..(200): a, c, t, g, unknown or other
  misc_feature (200)..(200): n is a, c, g, or t
  modified_base (458)..(458): a, c, t, g, unknown or other
  misc_feature (458)..(458): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgttctttgtctaccgaaggggaaanacgccctaccctctcctgcgacgggccagtcaagaattcgttaaccaacgtaggttcgtagcctaggtaccagccaaagaaaccgtcggaccctacgggttcccacgtcccttcctactattcgttagtggtaattactcccgaccgacgggcccaacgtgcctactacccagtaccgtacggttccaggtcggaccgtaggtccggggtacgtacggggaactaggtaccctttcgaacctttccgacaaccgttanaccacggtacaggtaccggtcggaacgtcccgttaaggtaacgtttacgtttacgacgttaaggttagttaactttacgttggttaacacgttacgtaggtttacgtacggggtttacaccgttacgggtaaccggttaacgggtttaccgggaaaccggttaaccgggggtaaacgtaaacgggtttaaacgggaaacgtaacggtaaaaaccgggtaccggtttaggggtaacggtaccggttaaccggaacgttaacccggttaagtttcccggtttaacggtttacccttaccggtttaccccttaacccggttttccccgaaacccggttttcgttacccggg

SEQ ID NO: 244800 - DNA, 540 bp, Homo sapiens
  misc_feature: GYAE6OF01E3ZMQ.5.59.F04.1.454.CMB.1.raw
  modified_base (196)..(196): a, c, t, g, unknown or other
  misc_feature (196)..(196): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagccctcctcatctatggtatatccaccaggccactggcatccccagacaggttcagtggcagcgggtctgggacngacttcactctcaccatcagcagactggancctgaagtattttgctagtgtattactgtcagctagtagtggtagctcgacggacgttccgggaccgaagggaaccgaagggtaggaaagtacgaaacgaacgtggtggacgtggacacctatctgttcttactacttccttcccgccgtagtccg

SEQ ID NO: 244801 - DNA, 566 bp, Homo sapiens
  misc_feature: GYAE6OF01B9V5U.5.59.F04.1.454.CMB.1.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
  modified_base (285)..(285): a, c, t, g, unknown or other
  misc_feature (285)..(285): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgttaccaanaggttcgtagcctggtaccagcagaaacctggccaggttcccagcctcncatctatggtatatccacgagggccactggcactcccagactaggttcaggtggcaggcgggtctgggacagacttcactctacaccatcgagcagactggacgcctagaagtatttgctagtgtattactgtacagacagtagtggtagctcgacggtacgttcggaccgtaagggaaccgtaagggtacggaaataacgaaacggtaacgtaggtacggacgtacgaccaaccgtacttccgttagttaccttactacttacccttcccgctacgtccg

SEQ ID NO: 244802 - DNA, 652 bp, Homo sapiens
  misc_feature: GYAE6OF01AMOWO.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccaggcacctgtctttgtctccgaggggaancgccaccctctcctgcagggccagtcagaatgtaccaagtggttcgtagcctggaccagacaagaacctggcctacggttcccagtcctcctcatctagtggtactactccgaccgacggccacgtcggctactcccgagacgtaggttcaggtcggcagggcggtacgtacgggactacggtaccttcgacttcgtaccaacctagtccgaggaccaggtaccgtacgggacgtaccgtagtaagttcgttttcgacgtaggttgttaactttacgtcgtacgtagtcgtaagtagtaggtacgtccgtacggtacggtacggttccgggaaccgtaacgggaaccgtaagggtacgtaaacgtacgaaacggtactaggtacggtaccgtcgacccgacctagttccgttacgttaccttacgtaccttacccgttcccgtccgttacgttaccgg

SEQ ID NO: 244803 - DNA, 578 bp, Homo sapiens
  misc_feature: GYAE6OF01EGXVH.5.59.F04.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcacctgtctttgctccgaggggaaancgccaccctntcctgcagggccagtcagatgtaccagnggttcagcctggaccagcaagaacctggaccaggttcccagcctcctacatctagtggtatactccacgagggccacgtggccactcccgagacgtaggttcaggtcggcgaggcgggttcagggacaggtacttcactctcacatcagcagacgtggatcctagaagttatttgactagttagttatacgtgtacagtcgtagtagtggtatctacggacggtacggtaccggaccgtaaacgggaccgtaagggtacgaaacgtacgaaacgtacgtggtaggtcgtacgacaccgtacgtcgttacgttacttacgtacgtccgttacccgcctacgttaccg

SEQ ID NO: 244804 - DNA, 532 bp, Homo sapiens
  misc_feature: GYAE6OF01DRS47.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaaggggaaanagccaccctctcctgcagggccagtcagaatgttaccaacaggttcgtagcctggtaccagcagaaacctggaccaggttcccagcctcctcatctatggtatatccaccagggccactggcatcccagacaggttcagtggcaggcgggtctgggacagacttcactctcacatcagcagactggagcctgaagtattttgctagtagttaattactgtcagcagtataggtagctcgaacggtacgttcggaccgaagggaaccgaaggtaggaatacgaaaacgaacgtgtggtcgtgcactactctgtcttcactccttcccgcctgtacg

SEQ ID NO: 244805 - DNA, 582 bp, Homo sapiens
  misc_feature: GYAE6OF01DG0IF.5.59.F04.1.454.CMB.1.raw
  modified_base (199)..(199): a, c, t, g, unknown or other
  misc_feature (199)..(199): n is a, c, g, or t
  modified_base (240)..(240): a, c, t, g, unknown or other
  misc_feature (240)..(240): n is a, c, g, or t
  modified_base (394)..(394): a, c, t, g, unknown or other
  misc_feature (394)..(394): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaanagcccaccctctcctgcaggccagtcagaatgttaccaacnggttctagcctggaccagcagaaacctggccaggttccagcctcctcatctatggtatatccacagggccactggcactccagacaggttcagtgcaggcggtctgggacagacttcactctcaccatcacgcagacgtggacgcctagaagtntttagctagtagtattactgtacagctagttatgggtacgtcgtacgacgggtaccggttacggaccgaacgggaccgtaaagggtaaggtaaactacgaaaacgtaaacgtggtacggtacgtacggtaccaaccgtaagttccgttagttaccttactacgttccctttcccggccttagtacccg

SEQ ID NO: 244806 - DNA, 695 bp, Homo sapiens
  misc_feature: GYAE6OF01CBX9C.5.59.F04.1.454.CMB.1.raw
  modified_base (201)..(201): a, c, t, g, unknown or other
  misc_feature (201)..(201): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtcctccgaggcctaccctgtctttgctccgaaggggaaanacgcccaccctctcctgcagggccagtcagaatgtaaccaagtaggttcgagcctggaccagcaagaacctggaccacggttcccagcctcctcatctagtcgtatacgtccaccgacggccacgtcggaccactccccgaagaccgtaggttccgaggtacggcgtaagggtccggggttacgacggggaactaacggtaccgtttccgaacctttccgtaccaacctaactcgaacggacctaagggtaccgtagggaacgtaccgtaaggtaaacgttacgttttggacgttaaggtttacgttaacgtttacgttacgtacgtaagtacgtaaggtacgttagggtacgtaccgtacgtaaccgggtacggtaccggaccggtaacgggtaaccgaaggtaacggaaacgtacgaaacgtacgtaggtacgcgtacgacgaaccgtcgttactacgttctacgtacttacccgtcccgccgtcgttaccg

SEQ ID NO: 244807 - DNA, 761 bp, Homo sapiens
  misc_feature: GYAE6OF01BT4YZ.5.59.F04.1.454.CMB.1.raw
  modified_base (191)..(191): a, c, t, g, unknown or other
  misc_feature (191)..(191): n is a, c, g, or t
tcagatcagacacgcacgaccggtgctcgatttagtacacacacttagggattggggtgctcagttaggacccagagggaaccatggaaacccagcgcagcttctcttcctcctgctactctggctccagatgccaccggaagactgtgttgacgcagtctccaggcacctgtcttgtctccgagggaaangccacctctcctgcaggccagtcagatgtaccaatggttcagcctaggtaccagcagaacctggacctaggttcccagtcctctcatctatggtatactccacgaggccacgtcggactacgtcccagacgtacggttcaggtcggcgagggtccgggtcgtacggggactacggtacctttaccgaccgttactaccaaccgtaattccgaagccgtaacggtaccgttgggaacgtaccgttaggtaaacgttacgtttttacggacgttaaggtttacggttaaacgtttaccgttacgttaccgtaacggttaccgttaagggttacgttacgggttaccggtaccgttaaccgggtaaccgggttaacccgggtttacccgggaacccgggttaaaaccgggggtaacccgttaaacggggttaaaccgggaaaacgttaaccggtaaaaccgggttaacgttacgggtacggtaccggttaacgtacccgtaacccgttaacgttccgttaaccgttacccgttactaccgtttacccttacccggtaccttacggttacccgg

SEQ ID NO: 244808 - DNA, 794 bp, Homo sapiens
  misc_feature: GYAE6OF01A9RCS.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccaggccaccctgtctttgctccgaggggaaanacgcccaccctctcctgcagggccagtcagaatgttaccagaggttcagcctggaccagcagaacctggcctaggtcccagcctcctcatctatggtatactcccaccgaggccacgtggacctagtccccaagaccgtaggttcaggtggcgagggtccgggtactacggggaactacggtacctttccgaccttcgtacccaaccctagtaccgaggtaccaacggtccggttaacgggaccgtccggttaggtaaacggtttacgtttttacggaccgtttaaggtttacggtttaacgttttaccgttacggttaaccgtaaccggttacgtaacggtttaaggttacggggttaaccgtacccggtttaccgggtaacccgggttaaccgggttttaccccgggaacccgggtaaaccgggggtaacccggtaaaggggttaacgggaaaccgttaaaccggtaaaccggttaaacggttacggggtacggtaacccgttcgggtaaccctaacccggttacgtccggtttaccggttacccgtttaaccgttacctttaccccgtttaccccggtcccgtaagttaccccgg

SEQ ID NO: 244809 - DNA, 760 bp, Homo sapiens
  misc_feature: GYAE6OF01CDV25.5.59.F04.1.454.CMB.1.raw
  modified_base (194)..(194): a, c, t, g, unknown or other
  misc_feature (194)..(194): n is a, c, g, or t
  modified_base (292)..(292): a, c, t, g, unknown or other
  misc_feature (292)..(292): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccagcacctgtcttgtctcgaaggggaaancgccaccctctcctgcagggccagtcaagtatcgtaaccaagtaggttcgtagccgtggtaccagacgagaaacctggcctaggttcccagcctccanatctatggtaactactcccgaaccgagggccctaacgtcggacctaacgttccccaaggtaaccgtacgggtttaccgaggttacgggaccaacgggtccggggttacgtacgggggaaccaacggtacccgttttccgaacccgttaccgtaaccgaacccgtactacccgaagaccgtaaacggtaaccgtacgggaccgtacccgtaggtaaacgttacgttttacggacgttaacggtttagttaacgtttacgttacggtactacggtactaaggttacgttaggtacgtccgttacgaaccgggttacggttaccggacccggtaaacgggtaaccggtaacggtaacggtaaacgtaaccggtaaacgtaaccggttacggtacggaccgtacgacctaaccggttactaccgttacgttaccgttaccgtaccttcccgtaccccgtcgtccgttaccgg

SEQ ID NO: 244810 - DNA, 572 bp, Homo sapiens
  misc_feature: GYAE6OF01A32MK.5.59.F04.1.454.CMB.1.raw
  modified_base (353)..(353): a, c, t, g, unknown or other
  misc_feature (353)..(353): n is a, c, g, or t
  modified_base (391)..(391): a, c, t, g, unknown or other
  misc_feature (391)..(391): n is a, c, g, or t
tcagatcagacacgcacgaccggtgctcgatttagtacacacacttagggatttgggtgctcagttaggacccagagggaaccatggaaaccccagcgcagcttctcttcctcctgctactctggcccccagatgccaccggaaagactgtgttgacgcagtctccaggcaccctgtctttgtctccaggggaagagccaccctctcctgcagggccagtcagaatgttaccaacaggttcgtagcctggtaccagcaagaaacctggccaggttcccagcctcctcatctatggtatatcccaccgagggcccacgtcggcactcccagacaggttcagtggcaggcggtcngggacagtactcactcctcaccatcagcagactggacnccgtagaagttatttgacgtagttggttaattacgtgtactaggactagtagtggtagtccgtacgacgggtaccgttacggaccggaacgggtaaccggtaagggtagaaacgtacgaaacgtagtaggtgacgtcgacgtacagtctgtcttactcttacctccccgtctgttcgtacg

SEQ ID NO: 244811 - DNA, 521 bp, Homo sapiens
  misc_feature: GYAE6OF01DYTPL.5.59.F04.1.454.CMB.1.raw
  modified_base (197)..(197): a, c, t, g, unknown or other
  misc_feature (197)..(197): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (431)..(431): a, c, t, g, unknown or other
  misc_feature (431)..(431): n is a, c, g, or t
  modified_base (489)..(489): a, c, t, g, unknown or other
  misc_feature (489)..(489): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgttaaccaactaggttcgtagcctggtaccagcaagaaacctggcctacggttcccagcctcctcatctatggtatatccaccagggccactggcatcccagacaggttcagtggcaggcggtctgggacagacttcactcncaccatcagcagactggatctagaagtntttgctagtntaattctgtcagcagttagtgtanctcgaacggtacgttcggacgaagggacaaggtagaatacaaacgatgtaggctcganactactctgtcttcacttcttcccgctagtcg

SEQ ID NO: 244812 - DNA, 679 bp, Homo sapiens
  misc_feature: GYAE6OF01EV8E9.5.59.F04.1.454.CMB.1.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (270)..(270): a, c, t, g, unknown or other
  misc_feature (270)..(270): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagactgtgttgacgcagtctccaggcaccctgtctttgtctcgaggggaaancgcccaccctctcctgcgaggccagtcagatgtaccanggttcagctggacagcagaactgcagtccagcctctnatctatggtatactccaccgacgggccacgtcggacactacccgaagtaccgtaggtttcaggtcggcgtacggtccggggttcgtaggggacacggtaccttccgacttccgtacaacctagtccgaaggaccaacggtaccgtagggacgtaccgttaaggtaacgttacgttttacggacgttaagttagttacgtttacgttcggttacgtacgtacgtaaggttacgttaggttacgtccgtaccggtacgggttaccggttacccgggaccggtaaacgggtaaccggtaaagggtaacggtaaacgtaaccgaaaacggtacgtacggtacggtaccgtacgaccgaacctacgttaccgtacgttaccttactacttacccgttcccgtccgtcgttaccg

SEQ ID NO: 244813 - DNA, 562 bp, Homo sapiens
  misc_feature: GYAE6OF01ASFZ3.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctctgcagggccagtcagatgttaccaactaggttcgagcctggtaccagcaagaacctggccacggttcccagcctcctcatctatggtatactccaccgagggccagtggcactcccagacaggttcagtggcaggcgggtctgggacagacttcactctcaccatcagcagctggacgctagagtatttgctagtgtattactgtcagcgtagtagtggtacgtcgtacgacggtacggttcggaccgtaacgggacgaaggtacggaaactacgaaacgtacgtaggtaggtacgtcggacgtacctacgttcgtacgttaccttacgtacttcccgttcccgccgtacgtccg

SEQ ID NO: 244814 - DNA, 718 bp, Homo sapiens
  misc_feature: GYAE6OF01AOC65.5.59.F04.1.454.CMB.1.raw
  modified_base (196)..(196): a, c, t, g, unknown or other
  misc_feature (196)..(196): n is a, c, g, or t
  modified_base (398)..(398): a, c, t, g, unknown or other
  misc_feature (398)..(398): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaanacgcccaccctctcctgcagggccagtcagaatcgttaaccaacgtaggttcgtagccgtggtaccagacagaacctggccaggttcccagcctcctcatctatggtatactccacgacggccactggcactccagtacaggttacaggtggcgaggtcgggtactcggggactacggtacgttcactccgtaccaaccctntaccgacggacctaacgggacttacggggaccgtccgtaacggtaaggttacgttttacggacgtaacgtttagttaactttacggtacggtacgtaacggtacgtagggttacgttacgggttagtaccgttaccggtaccgggttaaccggttacccgggaaccggtaaaccggggtaaccggtaaacgggttaacgggtaaacgtaaaccggtaaaacggtaacgttacgggtacggttacggtaccgacctaacggtacgttaccgttacgttactttacctaccgtttaccctcccgtacccgtacgttacccgg

SEQ ID NO: 244815 - DNA, 604 bp, Homo sapiens
  misc_feature: GYAE6OF01AETEH.5.59.F04.1.454.CMB.1.raw
  modified_base (197)..(197): a, c, t, g, unknown or other
  misc_feature (197)..(197): n is a, c, g, or t
  modified_base (239)..(239): a, c, t, g, unknown or other
  misc_feature (239)..(239): n is a, c, g, or t
  modified_base (397)..(397): a, c, t, g, unknown or other
  misc_feature (397)..(397): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccacccttctcctgcagggccagtcagaatgttaccaacnggttcagcctggtaccagcagaaacctggccaggttcccagcctcctcatctatggtatagtccaccgaggccactggcatcccagacaggttcagtggcaggcgggtctgggacagacttcactctcacatcagcagtactggacgcctagaagttntttgctagttgtatttacgtgtcagcgtagttagtcggttagtccgtacgtaccgggtaccggtttccgggaccgtaacggggaccgtaagggtacggtaaacgtaccgaaaacggtacgttacggtacgggtacttcgggacctacccgtagttacccgttgttacccttcgtacttaccccgtttcccccgcgttacttacccgg

SEQ ID NO: 244816 - DNA, 765 bp, Homo sapiens
  misc_feature: GYAE6OF01CC3UB.5.59.F04.1.454.CMB.1.raw
  modified_base (199)..(199): a, c, t, g, unknown or other
  misc_feature (199)..(199): n is a, c, g, or t
  modified_base (550)..(550): a, c, t, g, unknown or other
  misc_feature (550)..(550): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagctgtgttgacgcagtctccaggccaccctgtctttgcctccgaaggggaaancgcccaccctctcctgcgagggccagtcaagtaatcgttaaccaacgtaggttccgagcccgttaggaacccagaccgaagtaaaacccgtggaccctacggttaccccaaggtcccttacctacataccttagtacggtaatacctacccgaaccgaacgggcccaacgtcggccaactccccgaagaccgtaagggttcaggtcggacgtaacggtccggggtactaggggaactacggtaacctttccgaacgttacctaacccaacctaacttaccgaaggtacccgaagtaaccgttcgggaacgtacccttaggtaaacgtttagttttacgacgttaagggttntttaaacgtttacgttacgttacgaacgtactaaggttagtacgggtaacgtccgtacggtaaccgggttaccggttacccgggaaccgtaaaccgggtaaccgtaaagggttaacgaaacgtaaccgaaacggtaacgtacggtaggtaccgtacggtaccaaccgtacgtcgttacgttccttactaacttcccgttacccgcgtacttaccg

SEQ ID NO: 244817 - DNA, 552 bp, Homo sapiens
  misc_feature: GYAE6OF01ET460.5.59.F04.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
  modified_base (427)..(427): a, c, t, g, unknown or other
  misc_feature (427)..(427): n is a, c, g, or t
  modified_base (521)..(521): a, c, t, g, unknown or other
  misc_feature (521)..(521): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctcaggggaaangccaccctctcctgcagggccagtcagaatgtaccaacnggttcgagcctggtaccagcagaacctggccaggttcccagccctcctcatctatggtatactccaccgagggccacgtggccactcccgagacgtaggttcaggtggcaggcgggtctgggacagtacttcactctacactatcagcagcgtggacgcgtagaagtatttgcgtagtgttattactgtacagtntagttagtggtagtcgtcgacggtacggtcggacgaacgggtacgtaaggtacggtaacgtacgaaacgtaacgtaggtagacgtcgtacactntcgtgttcttctacttcctcccgtctcgtcg

SEQ ID NO: 244818 - DNA, 776 bp, Homo sapiens
  misc_feature: GYAE6OF01EWHFF.5.59.F04.1.454.CMB.1.raw
  modified_base (193)..(193): a, c, t, g, unknown or other
  misc_feature (193)..(193): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaagctgtgttgacgcagtctcaggcaccctgtctttgctcgagggaancgccaccctctcctgcgagggccagtcaagtaacttcgttaaccaacgtacggttccgtacgccgttagggtaacccaggacaaacggtaaaccctcgggaccctaacgggttccccacgtcccttacctactattcgtaagtggtaactactacccgaaccggtacgggtccctaacgtcggacctaccgtacccgaaggtaccgttacggtttacgaagggttcgggaccgtacgggtcggggttaccgtaggggaacctaacggtacctttaccgaccttaccgtaccaaccgtagtaccgacgtacgtaacggtaccgtagggaccgtaccgttaggtaaacgttgttttaccggacgttaaggtttacgtttaacgtttaccgtaggttaccgacgtacgtaaggttagttacgggttaacgtcgttaaccggtaaccgggttacggttacccgggaaccggtaaacgggtaaccggtaacgggtaacggtaaactaccggaaacgtacggttggtaccgtcgtacgactacgtcctacgttacgtaccttactaccgttaccctcccgtactcgtcg

SEQ ID NO: 244819 - DNA, 558 bp, Homo sapiens
  misc_feature: GYAE6OF01A6PE6.5.59.F04.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (323)..(323): a, c, t, g, unknown or other
  misc_feature (323)..(323): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggccaccctgtctttgtctccgaggggaaancgcccaccctctcctgcaggccagtcagatgtaccangttcagcctgacngcagaactgccagtccagcctcnatntatgtatcnccacnggccactgcactccagacaggtcagtgcagcggtcnggacagtctcactcgtcactatcagcagacgtggacgtcgtagaagtgtttgactagtgtacttcgtgtactagacgtagtagtagtacgcgtacgtacggtcgttaccggaccgtaacgggaccgtaagggtaaggtaaacgtacggaaaaccgtacgttcggtacggtacgtacggtaccaccgtacgttccgtgttacccgttctacgttacccgttcccctactcgtaccg

SEQ ID NO: 244820 - DNA, 676 bp, Homo sapiens
  misc_feature: GYAE6OF01B885U.5.59.F04.1.454.CMB.1.raw
  modified_base (198)..(198): a, c, t, g, unknown or other
  misc_feature (198)..(198): n is a, c, g, or t
  modified_base (243)..(243): a, c, t, g, unknown or other
  misc_feature (243)..(243): n is a, c, g, or t
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaancgccaccctctccgtgccgagggccagtcagaatcgttaccaacnggttcgtagcctaggtaccagaccaagaaacctggacctaggttcccagtccctcctacactctagtggtactactcccgaccgacgggcctagtcgacactcccgagacaggttccaggtggcaggccgggtntagggacacggtacttcgactcgtccaaccgtntacgacgtacacggtacgtggacgtccgtaatagttactttacgtacttacgtttaacttacgtcggttacacggtacgtaggtacgttggtaacgtcgtaacggtacggtacgtttccgggaaccgtaagggtaccgtaaaggtaggtaaccgaacgtaaaccggtaagtcggtacggtacgtacggtaccgtaaccgtacgttcgttacggttaccttaccttaccgttcccgtttaccggacccttcgttccgttaacccggg

SEQ ID NO: 244821 - DNA, 549 bp, Homo sapiens
  misc_feature: GYAE6OF01CS736.5.59.F04.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (343)..(343): a, c, t, g, unknown or other
  misc_feature (343)..(343): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccaggggaaangccaccctntcctgcagggccagtcagaatgttaccaanaggttcagcctggtaccagcagaacctggccaggttcccagccctcctcatctatggtatatccaccagggccacgtggcatcccagacaggttcagtggcaggcggtcngggacagacttcactctcacatcagcagactggagcctgaagtatttgacgtagtagttattactgtcagctagtatggtagctcgacggtacgttcggaccgtaacgggacgaaggtaggaacgtacgaaacgtacgtaggtcggacgtcgacaccgtactcgtacgttcgttaccgtacttcccgttcccgtcctacgttaccg

SEQ ID NO: 244822 - DNA, 567 bp, Homo sapiens
  misc_feature: GYAE6OF01BEPRQ.5.59.F04.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctntcctgcagggccagtcagaatgttaccaanaggttcgtagcctggtaccagcagaacctggccaggttcccagcctcctcatctatggtatactccaccagggccacgtggcactcccagactaggttcagtggcaggcggtctgggacaggacttcactctacaccatcagcagacgtggacgcctagtaagtagtttgctagtgttattacgtgtacagtcgtagtagtggtagtcgtcgacggtacgttcggaccgtaacgggacgaagggtaggaacgtacgaaacgtacgtaggtaggtcgtacgacaccgtatcgttcgtaccgttactacttaccctcccgtccgtacgttccg

SEQ ID NO: 244823 - DNA, 650 bp, Homo sapiens
  misc_feature: GYAE6OF01BON83.5.59.F04.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaaanagccaccctctcctgcagggccagtcagatgtaccanggttcgacgctggaccagcagaacctggccacggttccagcctcctcatctagtggtatactccaccgacggaccactcggactactcccagacgacggtttacgagtcggacgacggtcgggtcgtggggaaccaggtaccttcgaccttcgtaccaaccatcgacgcgagtacgtggacgactaggtaacgttagtttacggactagttgttaacgtttacgttcgtacgaacggtcgtacggttagttacggtacgtaccgtacgacgggtaccggttccgggaacccgtaacggggaccgtaagggtaccggaaacgtaaccgaaacgtaacggtacgtacggacgtcgaccgtaccttacgttccttacgttaccttacgtacgttaccccttacccgtccctagttcccgg

SEQ ID NO: 244824 - DNA, 625 bp, Homo sapiens
  misc_feature: GYAE6OF01DI1LF.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctcgaaggggaangccaccctctcctgcagggccagtcagtaatgttaccaacgtaggttcgtacgcctggtaccagcaagaacctggacctacggttcccagccctcctcatctatggtatactccaccgagggccacgtggcactcccagacgtaggttcaggtggcgacggcgggtctggggacaggtaccttcacttctcacctatcgagcaagacgtggacgtccgtagaagttgtttagctagttagttatttacgtgtacgtagtcgtagttagtgggttacgccgtcgaaccgggtacggttaccggaccgtaaacgggaccgtaaagggtaggaaactaacgaaaacggtacgtaggtacggtcgtacggtacctaaccgtacgttacttcggttacctttcgtaacttccccgttaccccgacctcgttaccgg

SEQ ID NO: 244825 - DNA, 600 bp, Homo sapiens
  misc_feature: GYAE6OF01C8VNG.5.59.F04.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (366)..(366): a, c, t, g, unknown or other
  misc_feature (366)..(366): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccgaggggaaanagccaccctctcctgcagggccagtcagaatgtacaanaggttcgtagcctggaccagcaagaaacctggacctacggttcccagcctcctcatctagtgtataactccacaggccactgcatcccagactaggtcagtggcaggcggtctgggacagacttcactcncaccatcagcagtacgtgagcctgaagtagtttgatacgttagttattacgtgttacacgtctaagttagtaggtacgtcgtacgaaccgggtacggtccggaacccggtaacgggtaaccggtaaggtaacggtaaacgtaacgaaaacggtacgttacggtagtaccgtacgtaccgactacgttacgtcggttaccttactaccgttcccgttacccgtcctaagttcccg

SEQ ID NO: 244826 - DNA, 636 bp, Homo sapiens
  misc_feature: GYAE6OF01DJYS6.5.59.F04.1.454.CMB.1.raw
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
  modified_base (354)..(354): a, c, t, g, unknown or other
  misc_feature (354)..(354): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaangcccaccctctcctgcgagggccagtcagaatgtaccaactggttcagcctggaccngacagaaacctggaccacggttcccagccctcctacatctatggtatactccaccagggcccacgtggcactccagactaggtcagtcgcagcgggtcngggacagacttcactctcaccatcagcagacgtggacgtcctagaagtatttaggactagttagtatttacgtgtacgtaggactaggtacgttggtacgccgttacgggtaacggtaccggttaccgggaaccggtaaacggggaacccggtaaagggtaacgggtaaactaaccgaaaaccggtaacgtcgggttaacggaccgttaggacctaaacccgtattcccgtagtttaccttccgtaacgtttaccccgtttccccggacttacgttacccgg

SEQ ID NO: 244827 - DNA, 657 bp, Homo sapiens
  misc_feature: GYAE6OF01EMIOK.5.59.F04.1.454.CMB.1.raw
  modified_base (194)..(194): a, c, t, g, unknown or other
  misc_feature (194)..(194): n is a, c, g, or t
  modified_base (234)..(234): a, c, t, g, unknown or other
  misc_feature (234)..(234): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctcaggggaaangccaccctctcctgcagggccagtcagaatgttaccaacnggttcgtagcctggtaccagcaagaaacctggccaggttcccagcctcctcatctatggtatatccaccgagggccacgtggcactcccagactaggttcaggtggcagcgggtcgtgggacagcttcactctcaccatcgagcagactgggacgtcctaggtaagttagttttcggactaaggttagttaacgtttacgtgttaccgaaggtcctaaggttagttagggttacgtccgtaccggtaaccggggttaccggttaccgggaacccggtaaacggggtaacccgtaaaggggttacgggtaaaacgtaacccgaaaaacggtaacgttacgggtacgggtaccgtacggacccgtaaccgtacgttcgttacgttccgttacctacgttacccgttccccgtcctacgttacccg

SEQ ID NO: 244828 - DNA, 816 bp, Homo sapiens
  misc_feature: GYAE6OF01DNAP3.5.59.F04.1.454.CMB.1.raw
  modified_base (190)..(190): a, c, t, g, unknown or other
  misc_feature (190)..(190): n is a, c, g, or t
tcagatcagacacgcacgaccggtgctcgatttagtacacacacttagggattggggtgctcagttaggacccagagggaaccatggaaacccagcgcagcttctcttcctcctgctactctggctccagatgccaccggaaagactgtgttgacgcagtctcaggcacctgtctttgctcgagggaaangccacctctcctgcagggccagtcaagtaattcgttaaccaacgtaggttcgtacgcctagggtaaccagaccgaacgtaaaacccgttgggtaccgtaacgggtttccccaacggtcccttcccttactaacttccgttaacgttcggttaaacttaccttaccccgaaaccccggaacgggggtacccctaaccgttcggggaccctaaccgttaccccgaaggtaaaccgttaacggggtttaccgaagggttcgggaccgtaacggggtccgggggttacgttacggggggtaaacctaacgggttaacctttaccgtaaccgtttcccgtaaccgtaaacccgtacgtttacccgaacggtaccgtaaacgggtaaccggttacggggaaccgttacccgttaaggtaaacggtttagtttttcggacgttaaggtttacgtttaactttacgtcgttacgtaggtacgtaagtttagtcgggtaacgtcgtacggtaaccgggttaccggttaccggacggtaaacggaacgtaaggtaacggaactacgaaacgtacgtgtacggtcgtcgacaacgtgttccgtacgttctacctacttcccgtccgcgtacgttccg

SEQ ID NO: 244829 - DNA, 632 bp, Homo sapiens
  misc_feature: GYAE6OF01AFZCO.5.59.F04.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccaggggaaangccaccctntcctgcagggccagtcagatgttaccaacnggttcgagcctggtaccagcaagaacctggccaggttcccagcctcctcatctatggtatactccacgaggccactggccactcccagtacctaggttcaggtcggacaggtccggggtctaggggacaggtaccttcactctcaccatcaagcacgacgtggacgacctagtaacgtagttttcgacgtagttagttactttaacgtcgtacgtacgtactagttagtcggttaacgccgttacgtaaccgggtaccggttaccggaccgtaacgggtaaccgtaacgggtaacggaaactaaccgaaacggtaacgtacggtacggtacgtcgactaaccgtacgttacgttacgttacgttacctacgttacccttacccgtcgtaccgttaccgg

SEQ ID NO: 244830 - DNA, 523 bp, Homo sapiens
  misc_feature: GYAE6OF01CH842.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (427)..(427): a, c, t, g, unknown or other
  misc_feature (427)..(427): n is a, c, g, or t
  modified_base (499)..(499): a, c, t, g, unknown or other
  misc_feature (499)..(499): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangcccaccctctcctgcagggccagtcagaatgttaccanaggttcagcctggtaccngcagaacctggccaggttcccagcctcctcatctatggtatatccaccagggccacgtggcatcccagacaggttcagtgcagcggtctgggacagacttcactcctcaccatcagccagactggacgccgtagaagtattttgctagtgtattactgtcagcagtatggtacncgtcgacggacgttcggaccgtaagggaacctaaggtaggaacgtacgaaacgaacgtgtggcgtgacaccntctgtcttcactctcccnctntcg

SEQ ID NO: 244831 - DNA, 844 bp, Homo sapiens
  misc_feature: GYAE6OF01DSDS3.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccagcaccctgtctttgtctccagtggaaagcgccaccctctcctgcagggccagtcagaatcgttaccaacgtaggttcgtagccgtagggtaccagaccaacgaaacccgtcggacctacgggtttccccaaggtccccttcctacctattccgttaatacgggttaacttacgtaccccgtaaccgacggggtacccctaacggttcgggacctaacgttcccccgtaaaggtaacccgttaagggtttacccgaagggtttcgggacgtaacgggttccggggttaccgttacgggggaaactaccgggttaaccttttacccgaacccgtttacccgtaccgtaaccccgtaacgttaccgaacgtaccgtaacgggtaacccgtacggggtaccgtaccgttaaggtaaacggttacgtttttacggacgttaacggtttacgtttacgttaacgtcggttacgtacgtacgttagttaacggtagggttacgtaccgttacggaaccgggttaaccggtttccgggaaccggtaaacgggtaacgtaacgggttaacggtaaacgtaaccggtaaacggtaccgttacgggtacggttaccgtacgaaccgttaccgtacgttccgttaccgttaccttaccgtaccgtttcccgttaccccgcgttaaccg

SEQ ID NO: 244832 - DNA, 700 bp, Homo sapiens
  misc_feature: GYAE6OF01C3U9W.5.59.F04.1.454.CMB.1.raw
  modified_base (201)..(201): a, c, t, g, unknown or other
  misc_feature (201)..(201): n is a, c, g, or t
  modified_base (691)..(691): a, c, t, g, unknown or other
  misc_feature (691)..(691): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatcgccaccggaaagactgtgttgacgcagtctcgaggccaccctgttctttgtctaccgaaggggaaanacgcccaccctctcctgcgaggccagtcaagaatcgttaaccaagtacggttcgtacgccgtaggtaccaggaccaaacgtaaacccgtgggaccctaacgggttcccacgtcccttcctacacttctagtaggtactacgtaccgaaccgacgggtcctacgtggccacgtcccaagaccgtaggttcagtcggacgacgggtcggtacgtacgggaacacgtaccttcgacttcacacatcaagaccaagtacgtcggacgtacgtaagtaacgttagtttacgacgttagttacgttaaacgttcgtagtcgaacgtacgtaagttacggtacggtacgtaccgttacggtaaccgggtacgttacccgggaacgtaaacggggtaaaccgtaagggtaagaaacgttaaccggaaacgtacgtcggtacggacgttacgaccttaacgtcttcgttacgttaccttactaccttcctacccgtacncgttaccgg

SEQ ID NO: 244833 - DNA, 557 bp, Homo sapiens
  misc_feature: GYAE6OF01ANO3R.5.59.F04.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
  modified_base (341)..(341): a, c, t, g, unknown or other
  misc_feature (341)..(341): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgtctccaggggaaangccaccctctcctgcagggccagtcagaatgtaccaacnggttcagcctggtaccngcagaaacctggccaggttcccagcctcctcatctatggtatatccaccagggccactggcatcccagacaggttcagtcggcagcggtntgggacagacttcactctacaccatcagcagactggagctagaagtattttgctagttgtatttacgtgtcgagtctagtagtggtagctcgtaacggtcggttacggaccgaacgggtaccgaagggtacggaaactaccgtaaacgtacgtaggtacggtaccgtcgacgtaccgagttaccgtcgttcttactacttcccttcccgctctccg

SEQ ID NO: 244834 - DNA, 596 bp, Homo sapiens
  misc_feature: GYAE6OF01COM12.5.59.F04.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaancgccaccctctcctgcagggccagtcagaatgtaccaanggttcgagcctggaccngcagaactgcaggtccagcctctcatctatggtatactccgaccagggccagtcggcactcccgagactaggttcaggtcggcgaggcgggttcgtaggggaacaggtaccttcacttctacaccatcgagccaagactggacgaccgtagaagttagtttacgactagttagttacttacgttagtcagtctagtagttaggtagacgtacgtacggtacggttcggaccgtaagggaccgtaagggtacggtaacgtacgaaacgtacgtaggtaggtacgtcgtaccacgtactcgttacgttaccttactacttacccgttaccctccgtacgttccg

SEQ ID NO: 244835 - DNA, 988 bp, Homo sapiens
  misc_feature: GYAE6OF01C3M86.5.59.F04.1.454.CMB.1.raw
  modified_base (202)..(202): a, c, t, g, unknown or other
  misc_feature (202)..(202): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccgaggccaccctgttctttgtctccgaaggggaaancgcccaccctctccgtgcgacgggccagtcaagtaattacgttaaccaacgtaggttcgtacgccgttacggtaaccagaccaacgaaacccgtgggacccgtaccgggttacccaacggtccccttaccctactaacttaccgttaagttacggttaacttaaccgttaccccgaacccggaacggggtcccctaacggttacggaccctaaccgttaccccgaagtaaccgttaacgggtttaccgaacggggttcgggaccgtaggggtccggggttacgtacgggggaaacctaacgggttaccctttaccgaacccgttcccgtaaccctaacccgtacgttaaccgaacggtacctaaacgggtaccgtggggaaaccgtcccggttaaaggtaaaacggttttacgtttttacgggaacgtttaacgggtttaacgtttaaactttttacccggtaggtttaacccgtaaggttaaccgtaagggtttaacgtttacgggtaccgtaccgtttaccgggtaaacccgggttaacccggggtttacccgggaaccgggtaaaaccgggggtaaccggtaaacgggggttaacggtaaaaccgttaaacccggaaaaaccgggttaaccggttacgggttaaccgggtacccgtaaccgggtaaccccgtaaaccgtttacccgggtttacccgttttaccggtttacccttttaacccggtttaaccctttacccccccggtttaacccccgttacccgttaacgttttaacccccgggg

SEQ ID NO: 244836 - DNA, 649 bp, Homo sapiens
  misc_feature: GYAE6OF01CF311.5.59.F04.1.454.CMB.1.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (607)..(607): a, c, t, g, unknown or other
  misc_feature (607)..(607): n is a, c, g, or t
  modified_base (643)..(643): a, c, t, g, unknown or other
  misc_feature (643)..(643): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgctccgaggggaaancgcccacctctcctgcagggccagtcagatgtaccaagngtcganctgaccngcagaacctgcaggtccagcctcnatctatggtanactccacgagggccacgtggacacgtcccagtacgaggtttcacggtggccaggtccgggtcgtaggggaaccaggtaccttcgactcgaccacagtcgagaccaaggacgtacgggacgtaccgttaggaaacgtttattttaacgggacttaaggttacgttaacgtttaacgttgtaccgagtacgtagttaacgtagggtactcgttaccggaacggttaacggttacccgggaaccggtaacgggtaaaccgtaaaggggttaaacggtaaccgtaaacggtaaaacgtaccgtagggtacgtcgtacgcaaaccgtnttaccgttcgttacttacacttccgtcccctacgtnttccgg

SEQ ID NO: 244837 - DNA, 612 bp, Homo sapiens
  misc_feature: GYAE6OF01DCOZ0.5.59.F04.1.454.CMB.1.raw
  modified_base (382)..(382): a, c, t, g, unknown or other
  misc_feature (382)..(382): n is a, c, g, or t
  modified_base (409)..(409): a, c, t, g, unknown or other
  misc_feature (409)..(409): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccgaaggggaaagagcccaccctctcctgcagggccagtcagaatcgttaccaacgaggttcgtagccgtggtaccagcaagaaacctggccaggttcccagcctcctctatctatggtatatccacagggccactggccactcccagacaggttcacgtggcaggcggtcgtgggacagtacttcactctcaccntcagcagactggacgtcctagaacgtntttcgacgtagttagttacttacgtgtacgagtactagttagttcggtagtcgtacgaaccggttacggttaccgggaccgtaaagggaccgtaaagggtaaggtaacgtaacgaaaccgtaacgtcggtaggaccgtacgacctaaccggtacttcgtacggtttaccttacgtaccttacgttccccgcttacgttacccg

SEQ ID NO: 244838 - DNA, 747 bp, Homo sapiens
  misc_feature: GYAE6OF01CJ2V3.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaagactgtgttgacgcagtctccaggcacctgtcttgtctccgaggggaaagngccaccctctcctgcgacgggccagtcaagtaatcgttaaccaacgtaggttcgtagccgtaggtaaccagaccaagaaacctcggacctacggttcccacgtcccttcctcattctagttggtactacgtccaccgacgggcctacgtcggacacgtcccagtacgtaggttcaggtcggacgacgggtccggggtcgtacggggaactacggtacctttccaccgttacctaccgtaacctacgtaccgacggaccgtaacggtaccgtgggaaccgtaccgttaaggtaacggtttagttttcggacgttaggttacgttaactttacgtcgtacgacgtacgtagttagtggtacgtccgtacggtaaccgggttacggttaccggaaccggtaacggggtaaccggtaaacggggtaacggtaaacgtaaccggtaaaacggtaacgtacgggtacggtacgtacggtacccgtaacgttcggttccgttacggttaccttaccgttaccgtttaccccgttacccgtaccgttacgttaccgg

SEQ ID NO: 244839 - DNA, 599 bp, Homo sapiens
  misc_feature: GYAE6OF01AKABJ.5.59.F04.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (328)..(328): a, c, t, g, unknown or other
  misc_feature (328)..(328): n is a, c, g, or t
  modified_base (343)..(343): a, c, t, g, unknown or other
  misc_feature (343)..(343): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
tcagatcagacacgcacgaccggtgctcgatttagtacacacactttagggattggggtgctcagttaggacccagagggaaccatggaaaccccagcgcagcttctcttcctcctgctactctggctcccagatgccaccggaaagctgtgttgacgcagtctccaggcaccctgtctttgtctccgaggggaaangccaccctntcctgcagggccagtcagatgttaccacaggttcgtagcctggtaccagcagaacctggccaggttcccagcctcctcatctatggtactactccacgaggccacgtcggcatcccagaacnggttccagtcggtcngcggtcgtgggacagaccgttcactcctcaaccgatcgagcaggacgtaggacgctagtaagtagttttgactagtgtattactgtcagctagtntggtancgtcgtacggaccgttcggacgtaacggtaccgaaggtacggtaaacgtaccgtaaacggtaacgttacggtacggtacgttacggaccgtaaccgtacttcgttacggttacttaccgttacttacccgtttccccctaccgtacgttacccgg

SEQ ID NO: 244840 - DNA, 565 bp, Homo sapiens
  misc_feature: GYAE6OF01DS3CN.5.59.F04.1.454.CMB.1.raw
  modified_base (198)..(198): a, c, t, g, unknown or other
  misc_feature (198)..(198): n is a, c, g, or t
  modified_base (255)..(255): a, c, t, g, unknown or other
  misc_feature (255)..(255): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
  modified_base (414)..(414): a, c, t, g, unknown or other
  misc_feature (414)..(414): n is a, c, g, or t
  modified_base (560)..(560): a, c, t, g, unknown or other
  misc_feature (560)..(560): n is a, c, g, or t
tcagatcagacacgcacgaccggtgctcgatttagtacacacacttagggattggggtgctcagttaggacccagagggaaccatggaaaccccagcgcagcttctcttcctcttgctactctggctcccagatgccaccggaaagactgtgttgacgcagtctccaggcaccctgtctttgtctccgaggggaaagngcccaccctctcctgcagggccagtcagaatgtaccaacaggtcgtagcctggaccngcagaactggccaggtcccagcctcctcatctatggtatatccacgaggccacgtggcactcccaagactaggttcagtggcaggcggtctgggacagacttcgactctcacatcagcagactggcnctagaagtntttgactagtgttattactgtanagacgtagttagtaggtatacgtacgacggtacggttaccggaaccgaagggaaccgtaagggtaaggtaaactacggaaaacgtagtacggtagcgtacgactaacctgttacctcgttacttactacttacccttcccgacgtntaccg

SEQ ID NO: 244841 - DNA, 669 bp, Homo sapiens
  misc_feature: GYAE6OF01AQL6Z.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (279)..(279): a, c, t, g, unknown or other
  misc_feature (279)..(279): n is a, c, g, or t
  modified_base (400)..(400): a, c, t, g, unknown or other
  misc_feature (400)..(400): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctccaggggaaangccaccctntcctgcaggccagtcagaatgttaccaanggttcgagcctggtaccagcagaacctggcacggtccagcctcctnatctatggtatactccaccgtacgggccctacgtggcctacgtccccgaagtaccgtaggttccaggttcggacctagggccggggttacgtcgggggaacaggtaccctttcgaccttcnccaaccgtactcgaagtcccaaaggtaccgttacgggacgtcccgtaggtaaacgttcgtttttacgacgttagttacggttacttacgtcgtacgagtacgtagttacgtggtacgcttacggacggtaccgttccggtaccgaaacggggaaccgtagggtaacgtaacgtaccgtaaaacgtacgtaggtacggtaccgtcgtaacgtaccacgttaccttaggttacccttcgtacgttacccgttccccgaccttcgttacccg

SEQ ID NO: 244842 - DNA, 708 bp, Homo sapiens
  misc_feature: GYAE6OF01BENKQ.5.59.F04.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (287)..(287): a, c, t, g, unknown or other
  misc_feature (287)..(287): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagatgttaccaanaggttcgagcctggtaccagcaagaacctggacctaggttcccagtcctccncatctagtgtatactccacgacggccacgtggactacgtcccgaagactagggtttcaggtcggacgacgggtccggggttcgtaggggaactacggtacctttcaaccttccgtaccaacccgtagtaccgaaggtaccaacggtaaccgttcgggaacgtacccgttaaggtaacgtttagttttacggacgtaaggttagttaactttacgtgtacaggtactaggtacgtaggtacgtaccgtacgtaaccgggtaccgttccgggaaccgtaacggggaaccgtaaggggtaacggtaaactaaccggaaaaccgtacggttaggaccgggttacgtacggtaccgtaacccgtacgttaccgtttcggttaccttaaccgtacctttccccgtttaccccgtcttaacggttccg

SEQ ID NO: 244843 - DNA, 632 bp, Homo sapiens
  misc_feature: GYAE6OF01AKIPD.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaaccaactaggttcgtagcctggtaccagcagaaacctggccaggttcccagccctcctcattctatggtatactcccaccgagggcccacgtggcctactccccagacctagggttcaggtggcaggccggggtcgtgggaacaggaccttcacttcctcaccatcacgcagactcgggacgccgtagaacgtattttcgacgtaggttagttacttacgtgtcgtagtctaaggtagttggtacgtccgttacgaaccggggtaccggtttccgggaccgtaaacggggtaacccgtaagggttacggaaactaccgaaacgtacgttggtacgggtacgtcgacgtacctagttccttcggttacttaccgtacctttcccgtccccgtcgtacgttccg

SEQ ID NO: 244844 - DNA, 648 bp, Homo sapiens
  misc_feature: GYAE6OF01CBD8F.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccaccctctcctgcagggccagtcagaatgttaccaactaggttcgagcctaggtaccagcaagaaacctggccaggttcccagcctcctcatctatggtatactccaccgagggccacgtggccactcccgagactaggttcaggtggcaggcggggtcgtggggaacaggacttcacttcgtacaccatcagcgagacgtggacgacctaggaagttagttttcggacgtaaggttagttaagtttacgtcgtacgtaaggcgtagttagttaggtacgtcgtacgtaaccgggtacgttaccgggaaccggtaaacggggtaaccgtaaagggtaacggaaacgtaccggaaaacggtaacgtacgggtacggtacgtacgacctaccgtacgttccgttacgttaccttaccgttacttcccgttaccccgcgtacgttacccgg

SEQ ID NO: 244845 - DNA, 643 bp, Homo sapiens
  misc_feature: GYAE6OF01AM6Z7.5.59.F04.1.454.CMB.1.raw
  modified_base (198)..(198): a, c, t, g, unknown or other
  misc_feature (198)..(198): n is a, c, g, or t
  modified_base (595)..(595): a, c, t, g, unknown or other
  misc_feature (595)..(595): n is a, c, g, or t
  modified_base (632)..(632): a, c, t, g, unknown or other
  misc_feature (632)..(632): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccgaggcaccctgtctttgtctccgaaggggaaancgcccaccctctcctgcagggccagtcagaattcgttaacccaagtaggttcgagccttaggtaccagcaagaacctggcctaggttcccagtccctcctcacttctagtggttactacgtcccaccggacgggcctaacgtggaccactcccaggtactaggttacaggtcggcacgggccgggttctgggaacagtaccttcactctaccgactagtcgagctaggcgtacggacgtctagtacgttgtttcgacggtattacggtaacttacgtgtacgtagtacgtagttacgtcggtacgtccgtacggacggttaccggtaccggacgaacgggtacgtaacggtacgtaacgtaacggaaaccgtcgtacggtcgtacgtcgtacgactnttccgttaggtacctacgttaccttacccgtttaccncgttgtaccgg

SEQ ID NO: 244846 - DNA, 624 bp, Homo sapiens
  misc_feature: GYAE6OF01DIETQ.5.59.F04.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccaggcaccctgtctttgctccaaggggaaanagcccaccctctcctgcagggccagtcagaatgtaccaanaggttctagcctggaccagcagaaacctggccaggtcccagcctctcatctatggtatatcccaaccgagggccctacgtggacactcccagactagggttacaggtcggacaggcgggtctggggacagacttcactctcaccatcagcaggactgggacgtcctaggtaacgttagttttgacgttaggttagttaactttaccgttgtacgaaggtacgtaaggttagttgggtacgtccttacggaaccgggttacggttaccggaccggtaacgggaaccgtaagggttaacggtaaacgtaccgaaaacgtacgtacggtacggtacgtacgacctaccgtacttccgtgttccttactacttcccttccccgctcgttaccg

SEQ ID NO: 244847 - DNA, 673 bp, Homo sapiens
  misc_feature: GYAE6OF01B5V2A.5.59.F04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgtctccgaggggaaangccaccctntcctgcagggccagtcagaatgtaccaacgtaggttcgtagcctggtaccagcagaaacctggccaggttcccagcctcctcatctatggttatactccacgacgggccactgcatcccagacaggttcagtggcaggcggtctgggacaggacttcgactctccacatcagtcagactggacgtccgttagaaacgtcttttaggctaacggttagtaactttacgtgttacgaacggtactaaggttaaggtgggttaacgtccttacggtaaccgggttaccggttacgggaaccccgtaaacgggggaacccgtaaacgggttaagggaaaacgttaccggtaaaaacggttaaacctcggggttaaacggtccggttaacgaccgtaacccgtacgtttacgtacgtttaccccggtttaccaacgtttcccgttttacccggaccccgttagtttacccggg

SEQ ID NO: 244848 - DNA, 536 bp, Homo sapiens
  misc_feature: GYAE6OF01CJEHR.5.59.F04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctntcctgcagggccagtcagaatgttaccaanaggttcgtagcctggtaccagcagaacctggccaggttcccagcctcctcatctatggtatactccaccgagggccacgtggcactcccagacaggttcaggtggcaggcgggtctgggacngacttcactcncaccatcagcagactggacgcgtagaagtntttgacgtagtgtattacgtgtcagtctagtagtggtagcgtcgacggtacgttcggaccgtaacgggacgaagggtagaacgtacgaaacgtacgtgtaggcgtcgacactntcgtntctctactcctccgctctcg

SEQ ID NO: 244849 - DNA, 568 bp, Homo sapiens
  misc_feature: GYAE6OF01CA190.5.59.F04.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctcaggcaccctgtctttgtctccgaaggggaaangccaccctctcctgcagggccagtcagaatgtaccaataggttcgagcctggtaccngcagaacctggccaggttcccagcctccncatctatgtatactccacgagggccacgtcggcactcccagacgtaggttcaggtggcaggcgggtctgggacagtaccttcactctcacatcgagcagactggacgaccgtagtaagtagtttgacgtagttagttattacgtacgtactagtcgtaggtagtggtacgcgtcgtaaccggtacggttccggaccggtaacggtacgtaaggtacggtaacgtacgaaacgtacgtagcgtacgtgacactcttcgtgttacttctacttccctcccgctcgtcg

SEQ ID NO: 244850 - DNA, 573 bp, Homo sapiens
  misc_feature: GYAE6OF01E1HI0.5.59.F04.1.454.CMB.1.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
tcagatcagacacgcacgaccggtgctcgatttagtacacacacttagggattggggtggctcagttaggacccagagggaaccatggaaaccccagcgcagcttctcttcctcctgctactctggctcccagatgccaccggaaagactgtgttgacgcagtctccaggcaccctgtctttgctccgaggggaaangccaccctctcctgcagggccagtcagaatgttaccaanggttcgtagcctggtaccagcaagaaacctggacctaggttcccagtccctcctcactctatggtaatactccaccgagggccacgtggcactcccagacagttcagtggcaggcggtcnggacngtactnactcncacatcagcagactggagtcctagtaagtagtttgactagtagtacttacgtgtactgtactagttagtaggtacgtctcgaccggtacgttcggacgtaaagggacgtaaggtagaactaacgaaacgtagtggtacggtacgtacggactaaccgtagttccgtacgttcttacacttacccttcccgtcgtacttccg

SEQ ID NO: 244851 - DNA, 683 bp, Homo sapiens
  misc_feature: GYAE6OF01ER47I.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaanagccaccctctcctgcagggccagtcagaatgttaccaacgaggttcgtagcctggtaccagcaagaaacctggccacggttcccagcctcctcatctatggtactactccaccgagggccacgtcggccacgtccccaaggaccgtaggtttccaaggttcggacgtacggcggggttctagggggaacctaggtaccttcaacgttcctaccaccatccgaagccaaggaccgttgggacgtaccgttagtaaggttattttaggaccgtaaggttagttaacgtttactcgtacgaagtccgtaaggttacgtagggttacgtaccgttacgaaccgggtaccggttaccgggaccgtaaacggggtaaccgtaaggggtaacggtaaaattaccggaaaacggaaccgttaggtacgggtacgtcgtacgtaaccctgttaccgtacgttcctttacgactttacccgttcccgcctagtcccg

SEQ ID NO: 244852 - DNA, 598 bp, Homo sapiens
  misc_feature: GYAE6OF01BJ1IE.5.59.F04.1.454.CMB.1.raw
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaaangccacctctcctgcaggcagtcagatgtacanggtcagctgacngcagaactgcaggtccagcctcctnatctatggtatntccacgaggccacgtggacactccagactaggttcagtggcaggcggtctgggacagtacttcactctacacctatcgagcagtacgtaggactccgtagtaagtagtttagacgtagtcgttaagttacgtgtacgagtcgtaagttagtggtacgctacgaacgggtacggttacggaccgtaacgggtaaccgtaaagggtaacgtaaacgtaccgtaaaaacgtacgttacggtacggaccgttacggtaaccgaaccgtaagtccgttacgttaccgttacgtacctttaccgttaccccggtaccttcgtaccgg

SEQ ID NO: 244853 - DNA, 538 bp, Homo sapiens
  misc_feature: GYAE6OF01BLA2B.5.59.F04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (533)..(533): a, c, t, g, unknown or other
  misc_feature (533)..(533): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctntcctgcagggccagtcagaatgttaccaanaggttcgtagcctggtaccagcaagaaacctggccaggttcccagcctcctcatctatggtatatccaccagggccactggcatcccagacaggttcagtggcagcgggtctgggacagacttcactctcacatcagcagactggagcctagaagtattttgactagtagtattacgtgtcagctagtagtggtagctcgacggtacgttcggccgaagggaccgtaagggtaggaagtacgaaacgtaacgtagtaggcgtgacaccagtcctgtacttctactccttcccgtcctntaccg

SEQ ID NO: 244854 - DNA, 624 bp, Homo sapiens
  misc_feature: GYAE6OF01BNZRX.5.59.F04.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (233)..(233): a, c, t, g, unknown or other
  misc_feature (233)..(233): n is a, c, g, or t
  modified_base (350)..(350): a, c, t, g, unknown or other
  misc_feature (350)..(350): n is a, c, g, or t
  modified_base (414)..(414): a, c, t, g, unknown or other
  misc_feature (414)..(414): n is a, c, g, or t
  modified_base (447)..(447): a, c, t, g, unknown or other
  misc_feature (447)..(447): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagactgtgttgacgcagtctccaggcaccctgtctttgtctccgaggggaaangcccaccctntcctgcagggccagtcagatgtaccanaggttcgagcctggaccagcaagaacctggccaggttcccagcctctcatctatcggtatactccaccgacgggccactggcctactcccagactaggttcaggtgcaggccgggtntagggactaggacttcgacttcctacacctatccgaagcaggactagggagtccgtagaagttntttggactaagttgtaattacgtgtacgacgtntaacgtagtggttacgcgttacgacgggttacgttaccgggaaccgtaaggggtaccaaaggggttacggaaacgtaaccgaaaacggtacgttacggtacggtcgtacggaacgtacccgtaattcccgttacggttccttacccgttaccgttccgttcccggcctacgttaccg

SEQ ID NO: 244855 - DNA, 629 bp, Homo sapiens
  misc_feature: GYAE6OF01E3MPH.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccgaggggaaangccaccctctcctgcagggccagtcagaatgtaccaatggttctagcctggtaccagcaagaaacctggccaggttcccagtccctcctcatctatggtatactccaccgaggccacgtggccactcccgaagacgtacggttcaggtcggcacggtcggggtctggggaacaggtaccttcaacttcctcaacctatctaagccagtacgtcggacgcctaggtaacgtagttttcgactaggttagttaactttacgtgtacgtagacgtagttagtggttacgtccgtacgaccgggtaacggttccggaccggtaaacgggtaccgtaagggtacgtaaaacgtacgtaaacgtaacgttaggtacggtaccgtcgtacctacgtattccgtacgttcttactacgttaccgtccccgtcgtacgttccg

SEQ ID NO: 244856 - DNA, 791 bp, Homo sapiens
  misc_feature: GYAE6OF01BL87W.5.59.F04.1.454.CMB.1.raw
  modified_base (201)..(201): a, c, t, g, unknown or other
  misc_feature (201)..(201): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccaggccacccttgttctttgtcctccgaaggggaaanacgccctaccctctcctgcgacgggccagtcagtaattcgttaacccaacgtaggtttccgtacgccgtaggtaaccagaccaaacggtaaaccctcgggacccgtacggtttaccccacggtccccttaccgtacaacttccgtaagttacggttaactacctaccccgaaccggtacgggccctaacgtcggacctaacctacccgaagtacgtacgggtttacacggtcggcgtacgggtccgggttacgtagggactacggttaccttacaccgttccgaccaaccctagtccgacgtactacggtacgtacgggacgtacgtaacgtaagtttacgttttacggacgttaaggtttacgtaacgtttacgtacgttacgtacggtacgtagttagttcggttactacgtacggtaaccgggttacgttaccgggaaccgtaacggggtaaccgttaagggtaaccggtaaacgtaaccggtaaaacggtaccgttagggtacggttaccgtacgtaccgaccgttacgtaccgtttcgtttaccttaccgttaccgtttaccctccccgttacttcgttacccgg

SEQ ID NO: 244857 - DNA, 920 bp, Homo sapiens
  misc_feature: GYAE6OF01EAJOR.5.59.F04.1.454.CMB.1.raw
  modified_base (458)..(458): a, c, t, g, unknown or other
  misc_feature (458)..(458): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaagacttgtgttgacgctagtctccgaggcctacccttgttcttttcgtcctaccggaagggggaaagacgcccctaaccccttctcccgtaggccgaacggggcccaggttaccaaggtaaacttcgttaacccaaacggtagggtttaccgtacgcccgttagggtaaccacgtaccgaaacgaaaacccgtcggacccgtacggttccccacggtcccttacctactacttacttagtaggttaacttacctacccgaaccgtacgggaccctaaccgtggacctaccgtacccagtacgtacggttacnggtcggacgtacgggcgggtaccgtagggaactacgtaccgtttccaccttaccgtaccgaacctcgtacgacgacacgtaacggtggaccgactacggtaagttacgtttagcgtagttcgttaagttcgttacgtacgtacgtacgttagttacgttaggttacgtaccgtaggtacccgggttacggttaaccgggaccgggtaaacgggtaaccggtaaggggttaaaccggtaaaacggttaacccgtaaaaacgggttaaccgggttaacgggtaacgggtttaaccccggtaccggtttaaaccccgaacccccggttttaaccggttaccccgtttttaacgggtttaacccccccttttttaaacccgttacccccggggtttttaaaccccccccgtttttaccccccggtttaaccccccgggtttaaaaccgtttttacccccccggggg

SEQ ID NO: 244858 - DNA, 669 bp, Homo sapiens
  misc_feature: GYAE6OF01CGCHK.5.59.F04.1.454.CMB.1.raw
  modified_base (147)..(147): a, c, t, g, unknown or other
  misc_feature (147)..(147): n is a, c, g, or t
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (287)..(287): a, c, t, g, unknown or other
  misc_feature (287)..(287): n is a, c, g, or t
  modified_base (526)..(526): a, c, t, g, unknown or other
  misc_feature (526)..(526): n is a, c, g, or t
  modified_base (624)..(624): a, c, t, g, unknown or other
  misc_feature (624)..(624): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaanactgtgttgacgcagtctccaggcacctgtctttagctcgaaggggaaancgccacctcncctgcaggccagtcagaatcgtacaagtagttcgagcctaggtaccagcaagaacctggacctacggtccagcctcctanactctagtaggtatactaccaccgaggtcccacgtcggacactacccgagacgtaggttcaggtcgggaccagggtccgggttcgacggggaactacggtacctttaccgactactccgaaccagtccaacggcaaaggtacgtagggacgtaccgtaagggaagtttattttacggaccgttaaggttacgtttaaacgttactcggttacaggtactaaggttaggttaacgggtanacccgtacggaaccggttacggttaccggaacggaaacggtaccgtaagggtaaacgaacgtacgaaaacggtactgggtacgacggtacacgtaccngttcctaggtacttaccgaacttcccgtacccgctcggttaccgg

SEQ ID NO: 244859 - DNA, 599 bp, Homo sapiens
  misc_feature: GYAE6OF01D717M.5.59.F04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
  modified_base (459)..(459): a, c, t, g, unknown or other
  misc_feature (459)..(459): n is a, c, g, or t
  modified_base (590)..(590): a, c, t, g, unknown or other
  misc_feature (590)..(590): n is a, c, g, or t
tcagatcagacacgcacgaccggtgctcgatttagtacacacacttagggattgggggtgctcagttaggacccaggagggaaccatggaaaccccagcgcagcttctcttcctcctgctactctggcctcccagatgccaccggaaagctgtgttgacgcagtctccaggcaccctgtctttgctcgaggggaangccaccctntctgcagggccagtcagaatgtaccaagnggttctagcctggtaccagcagaacctggccctaaggttcccagtccctctcatctatggtaactactccacgaggccacgtggcacgtccagtacagttcagtggcaggcggtatgggacaggtacttcacgtctacacccatcgagtcacgacgtgggacnccgtagaagttntttagactagtacgttataccgtgtacgagtacgtagttagtgggtaccncgtacggtaacggtaccggttcggaaccgtaacgggtaccgtaagggtacgaaacgtacgtaaaacgtacggtgtacggacgtacgaccgtacctagttccgtgttacccttcgactttaccgtccccgtntcttaccgg

SEQ ID NO: 244860 - DNA, 661 bp, Homo sapiens
  misc_feature: GYAE6OF01AIH1J.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaangcccaccctctcctgcagggccagtcagatgtacaacgtggttcgtagcctggtaccagcaagaaacctggacctaggttcccagtcctcctcatctagtgtatactccacgaggccacgtggccactcccgagactaggttcaggtggcaggcggtcgtgggacacgtcttcactctcgacatcgagcagtcgtacgacgtcctagaagttgtttcgactaggttacgttacttacgtgtactaggtactagttagtcgggtataccgtacggtaaccgggtacggtttccggaaccggtaaagggtaaccgtaaaggggttaacgaaaacgtaccggtaaaaacggtaccggttaggtaccgggtaccgtaccggtaccgtaaccgtagttcccggtttaacgttacccgttttaacccgaaccgttttcccgtacccccggttccgttaacgtttcccgg

SEQ ID NO: 244861 - DNA, 728 bp, Homo sapiens
  misc_feature: GYAE6OF01D2RXD.5.59.F04.1.454.CMB.1.raw
  modified_base (196)..(196): a, c, t, g, unknown or other
  misc_feature (196)..(196): n is a, c, g, or t
  modified_base (717)..(717): a, c, t, g, unknown or other
  misc_feature (717)..(717): n is a, c, g, or t
tcagatcagacacgcacgaccggtgctcgatttagtacacacacttagggattggggtgctcagttaggacccagagggaaccatggaaaccccagcgcagcttctctcctcctgctactctggcctcccagatcgccaaccggaagctgtgttgaccgcagtctccaggccaccgtgtcttgctccgaagggaancgccctaccctctcctgcacgggccagtcagtactcgttaaccaacgtcggttcgacgccttaggtaacccaggtccaaagaaacccgtcggtacccgtacggttccccacgtcccttaccgtactaacttaccgtaagttcggtacttacctacccgaaccgacggggtacccaacgtccggacctacgtacccgagtaaccgtacggttacgagtcggcgacggtccggggttactacggggactacgtccttacaccgttccgtaccaaccgtcgtaccgagaccgtaacggtaccgttgggaaccgtaccgtagtaacgttgttttcgacgttaggttacgttaacttaccgtagtctacgtacgtagttacggtacggtacgtaccgtacggaacggtaccgttaccggaaccgtaaggtaaccgacggtaagaactacgaaaccgtagtcggtacggtacctacggtactaacccgtgttaccgttcgttaccgttacctacttcccgttacccnccgtcgtaccg

SEQ ID NO: 244862 - DNA, 842 bp, Homo sapiens
  misc_feature: GYAE6OF01DQU36.5.59.F04.1.454.CMB.1.raw
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatcgccaccggaaagctgtgttgacgcagtctccgaggcacctgtctttgtcctacgaaggggaaacngcccacccgtctccngcgtagggcctagtcaagaactgtaaccacgacggttcgagccgtaggtaccaggacgaacgtaaaccgtcggacctaacgggttcccacggtcccttacctactacttaccgtagtaggttaactacgtacccgaccgtaccggggaccctacgtccgggacctaaccgtacccgaagtaaccggtaggtttccgaacgggtcggaccgtacgggtccggggttacgacgggggtaacacgggttacccctttacgacccttaccgtaaccgtaacccttacgtacctaacggacccgttaaagggtaaccggttcggggaacgtccccggttaaagggtaaacggtttaccgttttttagggaacccgtttaagggttttaacgtttaaccgtttaccggtacggttaccggtaagtaccgtaaaggttaacggtcgggttaaccgcgttaacgggaccggttaaccggtaccggggaacccgttaaacgggaaccggtaaagggtaaccgtaaacttaaccgggaaacgtaccgttacggacgtacccggtacgacccgtaacttacgttccgttacggtttacccttaccgtaacttcccggttaccggtacctcgttaccggg

SEQ ID NO: 244863 - DNA, 636 bp, Homo sapiens
  misc_feature: GYAE6OF01CX7LX.5.59.F04.1.454.CMB.1.raw
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaagagcccaccctctcctgcagggccagtcagaatgttaccaacaggttcgtagcctggtaccagcaagaaacctggccaggttcccagcctcctcatctatggtatatccaccgagggccactggacatcccagactaggttcagtggcaggcggtctgggacagacttcactctcacntcagcagactgganccgtgaaagtnttttgactaggttagttaattacgtgtaccaggtctaagttagtcgggtagtccgtacgtaacgggtaccggtttaccgggaccggtaacggggaccgtaaagggttacggaaaacgttaccgaaaaacgggtaaccgttgggtacgggtacgtaccggacccaacccggttaagttcccgttaggttaccctttacgtacctttcccgtttacccccgccgtaacgtttacccgg

SEQ ID NO: 244864 - DNA, 603 bp, Homo sapiens
  misc_feature: GYAE6OF01BYT2E.5.59.F04.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccaccctctcctgcaggccagtcagatgtacacngtcagctgacngcagaactgcaggtccagctcnatcatggtatatccacgagggccactggcactcccagacaggttcagtggcaggcggtctgggacaggtacttcactctacaccatcagcagactggagcctagaagttatttgactagttagttattacgtgtacgtagtccgtagttacgtaggttacggccgttacgtaaccggtaccggtttaccgggaacccgtaaacgggggtaacccgtaaaggggtacggaaacgttaaccggaaaaccgtaacgttcggtaggtaccgtacggtacctaaccgtaattccgttacggttaccgtttacacgtttaccgttccccgtacctacgttccg

SEQ ID NO: 244865 - DNA, 546 bp, Homo sapiens
  misc_feature: GYAE6OF01ARYHX.5.59.F04.1.454.CMB.1.raw
  modified_base (196)..(196): a, c, t, g, unknown or other
  misc_feature (196)..(196): n is a, c, g, or t
  modified_base (326)..(326): a, c, t, g, unknown or other
  misc_feature (326)..(326): n is a, c, g, or t
  modified_base (383)..(383): a, c, t, g, unknown or other
  misc_feature (383)..(383): n is a, c, g, or t
  modified_base (532)..(532): a, c, t, g, unknown or other
  misc_feature (532)..(532): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccgaggccactggcatcccagacnggttcagtgcaggcggtctgggacaggacttcactcacaccgatcagcagactgganccgtagaagtattttgacgtagtagttattacgtgtacgagtacagtagttggtacgtcgtacgtacggtacggttccggacgtaacgggtacgaaggtacgtaacgtaacgaacgtaacgtgtaggacgtgacactagtctgtcttcncttctcccgctgtc

SEQ ID NO: 244866 - DNA, 683 bp, Homo sapiens
  misc_feature: GYAE6OF01CJ2FL.5.59.F04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatgccaaccggaaagactgtgttgacgcagtctccaggcaccctgtctttgtctcgaggggaaangccaccctntcctgcaggccagtcagatgttaccaacgtggttcgagcctggtaccagcagaacctggccaggtcccagcctctcatctatgtatactccaccagggcccagtcggcacgtcccagactaggttcagtcggacctagggccgggttcgtagggaacaggtaacctttcacgttacctccaacccgtatccgaacgacgaaggtaccgttgggacgtaccgttagtaacggttagttttacggacgttaggttacggtttaaacgtttaccgtaggttacgtaacggtacgtaggttaagttacgggttacgtaccgttacggtaaccggtaaccggtttacgggacccggtaaacgggaccgtaaacgggtacggaaacgtaaccggaaacgtaacgtacggtacggtaccgtacgaccgaacgtcttacgttagttaccgttactaacgttcccgttccccgtacgtcgttacccg

SEQ ID NO: 244867 - DNA, 852 bp, Homo sapiens
  misc_feature: GYAE6OF01BJ9UZ.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgtctccgagggaancgccacctctctgcgacgggccagtcaagtaactcgttaaccaacgtaggttccgtacgtcctagggtaaccaagtacgaacggtaaacccgtcggacccgtacggtttccccacggtcccttaccctacctaacttacgtaacgttcgggttaacttaaccgtacccgaacccggtaccggggtaccctaccggtcggtacctaccgtacccgtaacggtaaccgtacggttacgaaggttcggaccgtacgggtccggggtacggtacgggtaacgtacgtacttaccgtaccgttccgtacctaacccgtacgtaaccgtacgaaccgtaacggtacgtacgggtaaccgtccgtaacggtaacgttacgttttacgacgttaagtttacggttaacgtttacgttacggttacgtaacggtacgttaaaggttacggttaacgggttaacgtaccggttaccggtaaccggggttaaccggttaacccgggaacgggtaaacccgggtaaccgggtaaacgggttaacggtaaaccgtaaccgtaaaaccggtaacggttacggtacggtaacggtacgtaaccgttaaccgtacgttaccttacggttaccgttaccgttacgttaccccgttacccgtaccgtcgttaccgg

SEQ ID NO: 244868 - DNA, 845 bp, Homo sapiens
  misc_feature: GYAE6OF01EBGHJ.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccgaggggaancgcccaccctctcctgccgacgggccagtcaagaacttcgttaaccaacgtagggtttcgtacgccgttacgggtaaccagacctaaacggaaaccgttcgggacccgtacgggtttccccacgtcccttcctacattacttagttacggttaacttacgtacccaaccggtacggggaccctacgttcgggacctaaccttacccccgaaggtaccgtaacgggtttaccgaacggttcgggaccgtaacggggtccggggttacgttacgggggaaccaacggtaccctttacgaccttccgtaccaaccctacgtaccgaaggtacctaaacggtacgttacgggacgtacccgttaaggaacgtttacgtttttcggaacgttaacggtttacgtttaagtttaccgttggttacgtaacgtcgtaagttcggttacggtaccgtacgttaacggtacgggttaccggttaccgggaaccgggtaaacggggtaaccggtaaaggggttaacggtaaaccgtaacggtaaaacggtacggttaggtacgggtaccgtacggtacccgtaacgttacgttaccggttacgtttaacccgttccgttaaccctttaccccgtttacccgtacccttaacggttccg

SEQ ID NO: 244869 - DNA, 693 bp, Homo sapiens
  misc_feature: GYAE6OF01B71EJ.5.59.F04.1.454.CMB.1.raw
  modified_base (197)..(197): a, c, t, g, unknown or other
  misc_feature (197)..(197): n is a, c, g, or t
  modified_base (391)..(391): a, c, t, g, unknown or other
  misc_feature (391)..(391): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctcaggcaccctgtctttgtctccgaggggaaanacgccaccctctcctgcacgggccagtcagaatcgttaaccaataggttcgtagcctaggtaccagacaagaaacctgggacctaacggttcccacgccctcctcattctatggtaactactaccgaccgacgggccacgtcggtaccactaccgtagacgtaggttcagtggacctaggcgggtctagggacnggtaccttcacgtctacaacctatacaacgcaagtacgtaggacgtaccgtaggtaacgttacgtttcgacgtagttacgttaactttactcgttacgacgtcgtaagtagtaggttacgtccgtacggtaaccgggtaccgtttacgggaaccgggtaaacgggaaccgtaaacggggtaacggtaaacgtaccggtaaaaaccggtacgttacggtaacggtacgtaaccggtaccaacgtaccgttacgttaccgttacttacctacgtttacccccgtaccgttaccctaacgtcccg

SEQ ID NO: 244870 - DNA, 597 bp, Homo sapiens
  misc_feature: GYAE6OF01BVQ77.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaancgccaccctctcctgcagggccagtcagaatcgttaccaactaggttcgtagcctaggtaccagcaagaaacctggccacggttcccagcctcctcatctagtggtaatactccaccgagggccacgtggcactcccagacgtaggttcagtcggcaggtcggtcgtgggacagtcttcactctcacagtcagcgagacgtggacgtccgtagtaagtatttgactaggtacttattacgtgtctagctagtagtggtactcgtacggtacggtacgttaccggacgtaacgggaaccgaagggtaggtaaacgtaccgaaaacggtacgtaggtacggtcgtagacctacgtacgttcgtacgttcgttcctacgttcccttcccgtccgtgttaccg

SEQ ID NO: 244871 - DNA, 872 bp, Homo sapiens
  misc_feature: GYAE6OF01BQS8D.5.59.F04.1.454.CMB.1.raw
  modified_base (145)..(145): a, c, t, g, unknown or other
  misc_feature (145)..(145): n is a, c, g, or t
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatgccaccggaaanactgtgttgacgcagtctccaggcctaccctgtctttgtctccgaggggaaanacgccaccctctccgtgcgacgggccaggtcaagaatgttaaccaacgtaggttcgagcctggtaaccagacaagtaaaccgtcggacctacggttcccagtccctcctacatctaagtggtactactccgaccgacgggtaccacgtcggctaacctcccgaacgaccgtaaggttcctaaggtcggacgaacggtcgggggtacgtcgggaactacggtaccctttcgacccttactacaacccgtagttaccaggtaaccgacggtaaccgtagggtacgtcccggttaaggaaacggtttaccgttttaggaccggttaaagtttacggtttaaacgttacccgtttaggtaaccggtaacgttaccgtaaggttttaaccggtagggttaacggttaacccggttccgtaaacccggggtttacccgggttaacccggggtaaccccgtaaacggggggtaaaaccccgttaaaagggggtaacgggaaaacccgttaaccggtaaaaaacccgggtaaccgttacggggttaaccgggttacccgggtaacccgttaacccggaaacccgttaacgtttacccgggtttacctttaacccgggtttaccctttaaccccggggtttacccctttaccccccgggtaaacccgttaaccctttaacggg

SEQ ID NO: 244872 - DNA, 724 bp, Homo sapiens
  misc_feature: GYAE6OF01DFG7W.5.59.F04.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcacccttgtctttgctccgaaggggaaancgcccaccctntcctgcgacgggccagtcaagtattcgtaaccaacgtggttcgagccgtaggtaccagcaagaaacctggacctacggttcccagcccttcctctatctatggtaacttactcccgaacgtacgggaccctacgtcggacctaactacccgaagtaccgtaggttcaggtcgcgaggtcggggtcgtaggggaacctacggtacctttccgaaccttcctaccaccgtatccgaagccaagtaccgtagggacgtaccgtaggtaacgttagttttacgacgtaggttagtttacgttacgttacgtacgtaaggtcgtaaggttacgttacggtactaccgttacggaaccggttaccggttaccggaaccgggtaaacgggtaaccggtaaagggttaacggaaaacgttacccggtaaaacgtacgtacgggttacggacggtacgtaccgaaccgttgtccgttacgttcccgttacgtaccttccctttacccgtacctacggttaccg

SEQ ID NO: 244873 - DNA, 913 bp, Homo sapiens
  misc_feature: GYAE6OF01DAKLL.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccgaggcaccctgtctttgtctccgagggaagcgcctaccctctccgtgcgagggccagtcaagaattcgttaaccaacgtaggttcgacgccgttaggtaacccagaccgaagaaaccgttcggacccgtacggttccccacggtcccttacctactacgttccgttaagttacgggtaacttaccgtaaccccgaccggtaacggggccctacgttcgggacctaccgttccccgaagtaaccgtacgggtttaccagggttacgggcgtaacgggtccgggggttcgtaacggggaccgtaacggttacccgtttaccgtaaccgttacccgttaaccgaacccgtacgttaccgaacggtacccgtacgggtaacggttacggggaccgtttaaccccggttagggttaaacggttttacgttttaccggggacgtttaaagggtttacggttttaaacttttacccgggttacggttaccaaacggttcgtaaacggttttacgggtttacgggtaaacgtcccggtttaaccggtaaaccgggtttacccgggttaacccgggtaaccgggtaaacgggtaacccggtaaaggggtaaccggtaaaccgtaaccggtaaaaccgggttacggtaccgggttacgggacccgtacggtaaccccgaactttaccggttaccgttaccggttacccgtttacctaacccgtttccccgttaacccgtcccgtaggtttaccccgg

SEQ ID NO: 244874 - DNA, 603 bp, Homo sapiens
  misc_feature: GYAE6OF01AF728.5.59.F04.1.454.CMB.1.raw
  modified_base (192)..(192): a, c, t, g, unknown or other
  misc_feature (192)..(192): n is a, c, g, or t
  modified_base (230)..(230): a, c, t, g, unknown or other
  misc_feature (230)..(230): n is a, c, g, or t
  modified_base (358)..(358): a, c, t, g, unknown or other
  misc_feature (358)..(358): n is a, c, g, or t
  modified_base (403)..(403): a, c, t, g, unknown or other
  misc_feature (403)..(403): n is a, c, g, or t
  modified_base (427)..(427): a, c, t, g, unknown or other
  misc_feature (427)..(427): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcacctgtcttgtctcgagggaaangccaccctctcctgcagggccagtcagatgtaccaagnggttcgagcctggtaccagcaagaacctggcctaggttcccagccctcctcatctagtggtatactcccacgacggccacgtggcactcccaagcgaggttcaggtggacaggtcgggtctgggaacngacttcacgttcacaccatcgagcagactaggcgtctagaagttntttcgacgtagttagtaacttacngttaccgagtacgtaagttgtaggtagccttacgaacgggtaccggttcggaaccggtaaacgggtacgtaagggtacgtaaacgtaccgaaacggacttacgggtagtacgtacggacctaaccgtcttccgtcttaccgttactaccttacccgtccccgtactcgttacccgg

SEQ ID NO: 244875 - DNA, 624 bp, Homo sapiens
  misc_feature: GYAE6OF01BY3OS.5.59.F04.1.454.CMB.1.raw
  modified_base (193)..(193): a, c, t, g, unknown or other
  misc_feature (193)..(193): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccgagggaangccaccctctcctgcagggccagtcagaatgttaccacgaggttcgagcctggtaccagcagaacctggccacggttcccagccctcctcatctatggtatctcccaccgagggcccacgtcggccactcccagaccgtaggttcaggtggcaggccgggttgcgggacaggtaccttcacgtcctacgacctactcgacgcaacggtactgggacgtcgtagtaagttacgtttgactaggttcgttatttacgtgtacgagtcgtaaggttgtacggtacgtaccgtacggtaccgggtacggttccggaccgtaacgggaccgtaaagggtacggaaacgtacgaaacggtacgtggtacggtcgtacggacctaaccgtacttaccgtcgttaccttctaccgttccctacccgtccgtacgttccg

SEQ ID NO: 244876 - DNA, 551 bp, Homo sapiens
  misc_feature: GYAE6OF01CYQG3.5.59.F04.1.454.CMB.1.raw
  modified_base (205)..(205): a, c, t, g, unknown or other
  misc_feature (205)..(205): n is a, c, g, or t
  modified_base (282)..(282): a, c, t, g, unknown or other
  misc_feature (282)..(282): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (427)..(427): a, c, t, g, unknown or other
  misc_feature (427)..(427): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgtctccaggggaaagagccaccctntcctgcagggccagtcagaatgttaccaacaggttcagcctggtaccagcaagaacctggccaggttcccagcctcncatctatggtatatccaccgaggccacgtggcatccagacaggttcagtcgcagcggtctgggacagacttcactcncacntcagcagactggagtcctgaagtatttagctagtagttattactgtacagtacagtagtggtancgtcgaacggacgttacggaccgaaggacgtaaggtaggaacgtactaaacgaacgtagtcggtacgtgacctaaccgataccgttagtccgttacacttacccgttcccgtaccgtcttaccg

SEQ ID NO: 244877 - DNA, 657 bp, Homo sapiens
  misc_feature: GYAE6OF01BAFD1.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgtctccgaggggaaangcccaccctctcctgcagggccagtcagaatgttaccaacaggttcgagcctggtaccagcaagaacctggacctaggttcccagcctcctcatctatggtatactccaccgacgggccacgtggcactcccagactaggttcagtcggcaggcgggtctgggactagacttcactctacactatcagcaagacgtggacgtccgtagtaagttagtttcgacgtaaggttagttaacgtttacgtgttacgaagtactaacggttagttaggtacgtaccgttacggaaccgggtaccggttccggaccggtaaacggggtaacccgtaagggttaacggtaaacgtaaccgtaaaaccggtacgtacggtacgggtaccgtacggacctaaccgtacgttccgtacggtttaccttaccgttacctttaccccgttaccccgtaccgttacgttacccg

SEQ ID NO: 244878 - DNA, 749 bp, Homo sapiens
  misc_feature: GYAE6OF01CQFTV.5.59.F04.1.454.CMB.1.raw
  modified_base (150)..(150): a, c, t, g, unknown or other
  misc_feature (150)..(150): n is a, c, g, or t
  modified_base (201)..(201): a, c, t, g, unknown or other
  misc_feature (201)..(201): n is a, c, g, or t
  modified_base (611)..(611): a, c, t, g, unknown or other
  misc_feature (611)..(611): n is a, c, g, or t
  modified_base (739)..(739): a, c, t, g, unknown or other
  misc_feature (739)..(739): n is a, c, g, or t
tcagatcagacacgcacgaccggtgctcgatttagtacacacacttagggattggggtgctcagttaggacccagagggaaccatcggaaaccccagcgcagcttctcttcctcctgctactctggcctcccagatcgccaaccggaaanactgtgtgacgcagtctccgaggccacctgtctttgtctaccgaagggaancgcccaccctctccgtgcgacgggaccagtacaagtatcgttaaccaacgtacggttcgtacgtccgtacggtaaccagaccgaaacggaaacccgttcgggtacccgtaccgggttcccaccggtcccttaccctactacttacgttacgttacggttaactacccgtacccgaacccggtaacggtcccacgttacggaccctaaccgtcccgaacggtacgtacggttacgacggttacgggaccgacgggtccgggtacgtacgggaactacggtacttccgaccttaccgtaccaactcgtaccgacgaccgtaacggtccgtacgggaccgtaccgtaggttaagttcttggacttaggtttacgtaactttcggaggttacagtacgtagttaggtcggtacnccgtaacgggtaccggtaccggtacggaaccggtaaaggtaccgtaaggtaacgacgtaacgaaccgtgtcgtagtaccgactaccgacttacgtcgttacccgttactaccgtaccttccgtacccngtttcgtacg

SEQ ID NO: 244879 - DNA, 628 bp, Homo sapiens
  misc_feature: GYAE6OF01BH7VQ.5.59.F04.1.454.CMB.1.raw
  modified_base (195)..(195): a, c, t, g, unknown or other
  misc_feature (195)..(195): n is a, c, g, or t
  modified_base (492)..(492): a, c, t, g, unknown or other
  misc_feature (492)..(492): n is a, c, g, or t
  modified_base (570)..(570): a, c, t, g, unknown or other
  misc_feature (570)..(570): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagctgtgttgacgcagtctccaggcacctgtctttgctccgaggggaaangcccaccctctcctgcacgggccagtcaagtaactgttaaccaacgtaggttcgagcctggtaccagcaagaaacctggacctagtcccagcctctcatctatggtactactccacgacgggccacgtggacactcccgagactagggttcaggtggcaggcggtctggggactacggtacttcgacctcgtccaaccctatccgaggtacacggtacgtcgggactccgtaaggtaacgttattttcggactaaggttagttacttacgtgtaccgagtactaggtagtgggtacncgtacggtacgggtaccgttacgggacctaaacggggtaccaaggtaggaaactaacgaaacggaacgttggtacggntacggcctacgtacttacggttctcgtttactaccttccgtaccctcgacgttacccg

SEQ ID NO: 244880 - DNA, 650 bp, Homo sapiens
  misc_feature: GYAE6OF01EL52K.5.59.F04.1.454.CMB.1.raw
  modified_base (197)..(197): a, c, t, g, unknown or other
  misc_feature (197)..(197): n is a, c, g, or t
  modified_base (376)..(376): a, c, t, g, unknown or other
  misc_feature (376)..(376): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaancgcccaccctctcctgcagggccagtcagaatcgttaccaacgtaggttccgtagcctggtaccagcaacgaacctggacctacggttcccagtccctcctcatctatggtactactccaccgacggccacgtggaccactcccgatacgtacggttcaggtggcgtacggcgggttcngggacacgtactcactctaccactacgtcgagacgtacgacgtggacgccgttaaggtaacgtttagtttacgacgttaggttacttacgttacgtgtacgtacgtacgtaaggttagtggtacgtaccgtacggaacgggttacggtaccggaccggtaaacgggaccgtaagggtaacgaaacgtacgaaaacggtacgttaggtacgcgtacggtacccgacgttcgtccgttagttaccttactaccgttaccctacccgtctcgttacg

SEQ ID NO: 244881 - DNA, 689 bp, Homo sapiens
  misc_feature: GYAE6OF01CHBDM.5.59.F04.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgctccgaaggggaaanacgcccaccctctcctgcaggccagtcagatgtacangtcagctgacngcagaactgcagtccagcctcncatctatgtatactccgacaggccacgtggccactcccgagactaggttcaggtcggacgagggtccgggtcgtgggaacctaggtacctttcgaactcctaccgaccagttcgaacgctaacggacgtcgggaacgtccgtaagggtaacgttacgttttacgacggtaacgtttagttaacttaccggttcgtacgtaagtcgtaagttagtacggggttactacccgtaacggtaaccgggttaccggttaccgggaacccgggtaaaacggggtaacccgtaaagggtaacggtaaacgtaaccgaaaacgggttaccgtggtaaccggtaccgttacggacccgtaaccgttacgtcccgtttacgttacccgttaccgttaaccgttccccgttaccccggtaaccttcggttaccg

SEQ ID NO: 244882 - DNA, 695 bp, Homo sapiens
  misc_feature: GYAE6OF01EV7TU.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgctaccgaggggaaancgcccaccctctccgtgcgacgggcctagtcaagtaactcgttaaccaagtggttacgtagcctaggtaccagacgaacgaaaccgtcggaccgtaacggttccccagtccctcctctaacttctagttaggtactactacccgaaccggtgggacctacgtcggacctactacccgagtacgtaggttcaggtcggcgtacgggtcgggtacgtacgggaactacgtaccttacgaccttcctaccaacctatccgaagcgtaacggacgtcggaacgtccgtagtaacgttagtttcgacgttagttacgttacttactgtactagtctagttacgtagtacgtcgtacggtacgtaccggttcggaaccggtaaacggtaacggtaagggtaacgaaacgtaacgtaaacggtaccgttaggacgtaccgtacgacgtaccgtattcgttacgttacctttacgacccgttaccgttcccgacgtcgttaccgg

SEQ ID NO: 244883 - DNA, 780 bp, Homo sapiens
  misc_feature: GYAE6OF01DJX6U.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggccaccctgttctttgtctccgaaggggaaagcgcccaccctctccgtgcgacgggccagtcaagtaattacgttaaccaacgtaggttcgtacgtccgtaggtaaccagacaacgaaccgtcggacctacggttcccagtcccttcctactactctagtgtaactacgtaccgaccgacgggtccctaacgtcggcctaacgtacccgaaggtaccgtaacggttcgaaggttcggaaccgtacgggtcggggttaccgtacggggaactacgtaccgttaccacctccgtaccaactactacgacgtacgacgtaaccggtgggaaccgtaccgtaagtaacgtttacgttttacggacgttaagtttacggttaaactttcgtacgtagtaacggtacgtaaaggttacggtacgggtaactccgttacgggtaacccgggttaaccggttccggaaaccgggtaaacgggtaaaccggtaagggttaaaccgtaaacggtaacccgtaaaggtaaccgtcgggtaccgtacggtaccaaccgtaccttacgttaccttacggttacccttaccgtaccgttaccccgttaccgccgttcgttaccgg

SEQ ID NO: 244884 - DNA, 703 bp, Homo sapiens
  misc_feature: GYAE6OF01CF2VS.5.59.F04.1.454.CMB.1.raw
  modified_base (642)..(642): a, c, t, g, unknown or other
  misc_feature (642)..(642): n is a, c, g, or t
  modified_base (661)..(661): a, c, t, g, unknown or other
  misc_feature (661)..(661): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaagactgtgtgacgcagtcctccaggcctaccctgttctttgtctccgaaggggaaagcgccaccctctccgtgccgagggccagtcagtaatcgtaaccaagtcggttcgacgtccgttacggaccagacgaaacgaaccgtcggacccgtacggttcccaagtccctcctacgtacttcgtaagttcggtaacttaaccgtacccgaccggtaagggcccctacggtcgacctaacgcccgtaaggacgttagggtccgaggtcggcgtaacgggtccggggtcgtacggggaactaacggtccttaccacgttcctaccgtaaccctagaccgacgacaacggtacgtagggcctaccgtaggtaattggttttacgcgttacggtttaatacgttactgggtaaccagtaaccgtaagtcggtacgtagaccgtacggtacgtaaccggttacggaccgtaaggtaaccggtaagtacgaaacgtaacgaagtacgngtaccgagtaccgacctancgttcgtacgttatcccgtaacgtaccctccgatacggttcg

SEQ ID NO: 244885 - DNA, 860 bp, Homo sapiens
  misc_feature: GYAE6OF01BE1NV.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccgaggcaccctgtctttgctcgaggggaancgccaccctctcctgcgagggccagtcagaatcgttaaccaaacgtggttcgtagccgtacggtaccagtccaaggtaaaccgtcggacccgtacggttcccacgtcccttaccgtactacttcgtaagtcggttaacttaccgtaccccgaccggtacgggtaccctaacgttcgggactaacccgttcccgaagtaccgtaagggtttcccaagggtcggccgtaacgggccggggttaccgaggggtaccaacggttaccctttacgacccgttacctaccaacccctagtccgaacgacgaacggtaccgtacgggaccgtacccgttaaggtaacgtttagttttaccggaccgttaaggtttacgttaacgtttaccggttacgttaacggtacgtaccgtttaacggttaacgggttacggttaccggttaccgtaacccgggttaacccgggttaccggggtttaacccgggaacccgggttaaaccgggtaaccggttaaacgggtaacggtaaaccgtaaacggtaaaaccggtaaccggttacgggtaacgggttaccggtaacggtaccctaaccggttaccgttaccgtttaccggttaccgttacccgttaccgttaaccccggtttccccgtaccgttaacgtttcccgg

SEQ ID NO: 244886 - DNA, 780 bp, Homo sapiens
  misc_feature: GYAE6OF01D56UP.5.59.F04.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctccaggccaccctgtctttgtctccgaaggggaaanacgccaccctctcctgcacgggccagtcagaatgttaccaactggttcgtagccgtggtaccagccaagaaaccgtcggcctacggttcccagtccctcctcatctatggtatactccgaccgagggcccacgtggccacgtcccagtactaggttcaggttcggcgacggtccggggtacgtcggggaactaggtaccctttcaccgttcctacctaacccgaacttccgaaacggacgtaacggtaaccggtcggggtaaccggtcccgttaacggtaaagttacgtttttacggaccgttaaggttacgttaactttacgttcgtacgtacggtacgtaaggttacggttacgggtacgtaccgttaccggtaaaccggggttaccgggttacccggggtaacccggtaaacgggggtaaccgtaaaacggggtacggtaaaaccgtaaccgtaaaaccggtaaacggtacggttaccgggtacgtaccggtaccgaacccgttacgttacccgtttcggttaccctttaccgtaccgtttacccccgtttacccccggtacccttacgttacccgg

SEQ ID NO: 244887 - DNA, 710 bp, Homo sapiens
  misc_feature: GYAE6OF01DJFBX.5.59.F04.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (342)..(342): a, c, t, g, unknown or other
  misc_feature (342)..(342): n is a, c, g, or t
  modified_base (511)..(511): a, c, t, g, unknown or other
  misc_feature (511)..(511): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatgccaaccggaaagctgtgttgacgctagtctccgaggcaccctgttctttgtcctaccgaaggggaancgccctaccctcncctgcgacgggccagtcaaggaattcgtaaccaacgtaggttcgtagcctaggtaccagacaaacgtaaccgtcggaccgtacggttcccacggtcccttcctacgattcctagtacggtacttaccncccgacggacggtcctaacgtcgccaactcccgaagaccgtaggttccgaggtgaccgtacgggccggtttacgcgggaactacgtacttcgacctcctaccgactgaccgagactaacggacctagggactaccagttagttaactttcgagtagttagttacttagngtaccagtactaggttagtcgtagtcctacgggtaccgggtacgtttaacgggaccggtaaacggggttaacccgtaaagggtaacggtaaactaaccgggtaaacgaagggtttccgtaggtacccgacggttaccacggtcgttaccgtagttttcccgtactaccgtttaccccgttcccgagttaacgtttccgg

SEQ ID NO: 244888 - DNA, 768 bp, Homo sapiens
  misc_feature: GYAE6OF01BREMG.5.59.F04.1.454.CMB.1.raw
  modified_base (166)..(166): a, c, t, g, unknown or other
  misc_feature (166)..(166): n is a, c, g, or t
  modified_base (193)..(193): a, c, t, g, unknown or other
  misc_feature (193)..(193): n is a, c, g, or t
  modified_base (306)..(306): a, c, t, g, unknown or other
  misc_feature (306)..(306): n is a, c, g, or t
  modified_base (758)..(758): a, c, t, g, unknown or other
  misc_feature (758)..(758): n is a, c, g, or t
tcagatcagacacgcacgaccggtgctcgatttagtacacacacttagggattgggggtgctcagttaggacccagagggaaccatggaaacccagcgcagcttctcttcctcctgctactctggctcccagatcgccaaccggaaagactgtgttgacgcagtcncaggcacctgtcttgctcgagggaacncgccacctctctgcgacgggcctagtcaagtactacgttaaccgaagtggttcgtacgccgttaggaccaggaccagaaacccgtggacctacgggttcccagtccttaccgnaacttcgtagttaggtaactacctaccgaaccggtacgggtaccctaacggtcggacctaccgtaacccgaaggtaacccggtaggtttaccgaagggttccggaacggtacggggtccggggtacgtacgggggaaccttaacggtaccttccgaaccgtttacacccgtaaaccttagaacggacctacggaaacgggtaccgtacggtacggtacccggttaaggtaacggttaacgttttacggacggttaacgttacgtttaaccgtttacgttacgtacgtaacggtagttaagttaggttacgggtacgtaccggtacggtaacgggtaccgggttacggaaccggtaaacgggtaaccgtaaggggttaacgaacgtaacggaacgtaacggtagtacggacgtacgacactacgtcgtacgtaccttcgtaccttcgtcccgngttcgtaccg

SEQ ID NO: 244889 - DNA, 760 bp, Homo sapiens
  misc_feature: GYAE6OF01DIOZ4.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgccaccggaaagactgtgttgacgcagtctccaggcaccctgtctttgtctccgaggggaaangcccaccctctcctgcagggccagtcagatcgttaaccaacgtaggttcgtagccgtaggtaccagcaagaacctggacctacggttcccacgtccctcctctatcttagtaggtactacctccgaaccgacggggaccctaccgtcggacctacgtaccccgaagtaccgtagggtttaccgagggttcggacgacgggtccggggtactaggggaacctagtacccttcctaccgtcctaccgaccctaatccgtaggaccaaggtaccgtagggtaccgtacgtaggtaaacgttgttttacgacgtttaaggttacgttagtttaccgtagtacgtagtaccgttaaggttacggttaggttaaccgtccgtaacgggttaacccggggtaaccgggtttaccgggaacccgggtaaaacggggtacccggtaaaagggttacgggtaaaacgtaaccggtaaaaacggtaccggtaggtacggtcgtacgacccgtaaccgtgttaccgttacgttcccgttacctaccttaccccgtcccgtaccgtcgttaccgg

SEQ ID NO: 244890 - DNA, 707 bp, Homo sapiens
  misc_feature: GYAE6OF01A8IR8.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggccaccctgtctttgtctccgaggggaaangccaccctctcctgcagggccagtcagaatgttaccaagaggttctagcctggtaccagcaagaaacctggccacggttcccggcctcctcatctatggtatactccaccgagggccacgtcggccatcccgagacaggttcaggtcggcaggcgggtctaggggacacggtaccttcgacctccgtcaaccctatccgaagcaacgtacggtcgggaacgtccgtaggaaagttacgttttacgacgtaggttagttaactttaccgttaggtacgtaacggtacctaaggttaacgttcgggtaacggtccgttaccggtaaccgggtaccggtttaccgggtaacccggtaaacgggggtaacccgtaaaggggttaacggaaaacgtaaccgaaaaaccggtaacggtggttaccgggtaccggtacggacccgtaaccgacgttcgttcggtttacctttcctaaccgtttccctttaccccggtaccctacgttccgttacggg

SEQ ID NO: 244891 - DNA, 820 bp, Homo sapiens
  misc_feature: GYAE6OF01C9LMK.5.59.F04.1.454.CMB.1.raw
  modified_base (808)..(808): a, c, t, g, unknown or other
  misc_feature (808)..(808): n is a, c, g, or t
tcagatcagacacgcacgaccggtgctcgatttagtacacacacttagggattggggtgctcagttaggacccagagggaaccatggaaaccccagcgcagcttctcttcctcctgcttactcgtgcctccagatcgaccgaaccggaagctgttgtagaccgcgtacgtcctaccgacgacctacccgttgtttcttttcgtcctaccgggaaagggggaaactccgacccctacccttccttccgacgccggacggacctagtacgaagtacgttaccgtaacctacgtacggttcgtacgtccgtacggtaccagacaaacgtaaccgtcggtaccgtaccggtccctacgtcccttacctactacttacgttaggtacgttaactccgtaaccgaccggaaccgcccgtacgtacggtacctaccgtaccgaacggtacgttaccgggttacgacggggttacgaccggtacgggtcggtttacggaccgggtaactaacggttcccttacaccgttcctacgtactacctgacgtaccgtagacgttcgacgtactaaggtactttagttacgacttacggttacgttaacgttacgtacgttacgaacgttacggtaacgtttacggtcggttaccgtaccggtaacggtaccgggttaccggttacccggaaacgggttaaccgggtaaaccggtaaggttaaacggaaccgtaaaccgtaaacggtcgtacggtacgaccggtaacgacccgtacgttacttccggtacttacccttaccggtacccttccggtaccccnttacccgtacgg

SEQ ID NO: 244892 - DNA, 784 bp, Homo sapiens
  misc_feature: GYAE6OF01CYPRU.5.59.F04.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaagacttgtgttgacgcagtctccgagccacctgtctttgctccgaaggggaaancgccacccttctcctgcgacggccagtacaagtaacgttacgttaaaccaacgtacggtttaccgtacgtacccgttacggtaaccagaccaaacggtaaacctcgggaccctaacggttcccacgtccctcctactacttactagtcggttaactacctacccgaaccgtacggaccctacgtcggacctaacctaccccgaaggtaaccgttacggttaccgacggtcgggaccgtacgggtaccggggttcgtaacggggaactaaccgtactttaccaacgtcccgtaccaaccctagtaccgaacggacgacggtacgtacggaacgttaccgtaaggttaagtttacgtttacggacgtttaagtttcggttaaacttcggttagtacgaacgttacgtaggtttagttacggtacccgttacgtacggttaacgggtaacccgggttacggaacccgggaaacgggtaaaccgtaagggtaaccgtaaactaaacgtaaccggtaaggtccggtacgacgtcgtaccgtaacttctcttacgttacttacccgtacttcccgttcctctccgttacg

SEQ ID NO: 244893 - DNA, 729 bp, Homo sapiens
  misc_feature: GYAE6OF01DUVDQ.5.59.F04.1.454.CMB.1.raw
  modified_base (422)..(422): a, c, t, g, unknown or other
  misc_feature (422)..(422): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggccaccctgttctttgtctccgaaggggaaagacgcccaccctctcctgcacgggccagtcaagaattacgttaaccaacgtggttcgtagcctacggtaccagacaagaaacctcggacctacggttcccacgccctcctcacttctagtggtactactacccaccgacgggacccacgtcggacacgtcccagactagggttcacggtcggacgaggtcgggtcgtagggactacggtccttccactaccncaaccatacagacaacggtacgtcgggaacgtaccgtaggtaaacgttagttttacgacttaacggttagttaacgtttaccgttagtaccggtaagtacgttaaggttagttacgggtaccgtacgtacccggtaaccgggttacgggttacccgggaaccggtaaacggggaaccggttaaacggggaacgttaaactaaccggtaaaacggtaccgttagggtacggacgtacggtaacctaactccggttaccgttcgttaccttaccgtacccgtttacccgttacccctccgttactacgg

SEQ ID NO: 244894 - DNA, 531 bp, Homo sapiens
  misc_feature: GYAE6OF01BFLZQ.5.59.F04.1.454.CMB.1.raw
  modified_base (194)..(194): a, c, t, g, unknown or other
  misc_feature (194)..(194): n is a, c, g, or t
  modified_base (233)..(233): a, c, t, g, unknown or other
  misc_feature (233)..(233): n is a, c, g, or t
  modified_base (361)..(361): a, c, t, g, unknown or other
  misc_feature (361)..(361): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccagcaccctgtctttgctccaggggaaangccaccctctcctgcagggccagtcagaatgttaccaanaggttctagcctggtaccagcagaacctgcaggttcccagcctctcatctatggtactactccaccagggccacgtggcactcccagacaggttcagtgctagcggtctgggacagctcactctcacntcacgcagactggacgctgaagtatttgctagtgtatacgtgtcagtcagtntggtncgtcgacggtacgttcggaccgtaacggactaacgggtagaactacgaaacgtaacgtgtacgtcgtcgactacctctctagttcttactaccttccttccccgactgtaccg

SEQ ID NO: 244895 - DNA, 702 bp, Homo sapiens
  misc_feature: GYAE6OF01BEFHV.5.59.F04.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtcctccgaggccacccttgtctttgtctacgaggggaaancgcccaccctctcctgcgaggccagtcagatcgtaccaagnggttcgagcctaggtaccagactaacgaaccgtggaccctacggttcccacgtcccttccctntacttctaagtggtaactacncccgaaccgacgggccacgtcggacctactcccgagacgtaggtacagtggcgtagggcggtcgtaggacagtccgttcacttccaccactatccgagacaggtaccgtaggacgtaccgtaggtaagttacggtttacgacgttaggttacgttaactttacgtacgttacgtagtacgtaggttaggtacggtacgtaccgtacggtaaccgggtacggttaccggtacccggtaacgggtaaaccgtaaggggttaaccggtaacgtaaaccggaaaccggtaacggtacggtaacggtcggtaccgtaccaccgtacgttcgttacgttaccttacgttacccttacccgtttacccgtccgtagttacccg

SEQ ID NO: 244896 - DNA, 574 bp, Homo sapiens
  misc_feature: GYAE6OF01ELA7M.5.59.F04.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctcaggccaccctgtctttgtctccgaggggaaancgccaccctntcctgcagggccagtcagaatgttaccaacaggttcagcctggtaccagcaagaacctggccaggttcccagcctctcatctatggtatatccacgaggccactggcatcccagacaggttcagtggcaggcggtctgggacagtacttcactctcaacatcagcagactggagccgtagaagtagttttagacgtagttacgttaatttacgttagtctaagctaagttagtggtagctacgaacggtacgttacggaccgaagggaaccgtaaggtaacgaagtaacgaaacgtaacgtaggacggtcgtacgacacctacgtacgtcgttacgttcctacttacccttcccgtcctacttaccg

SEQ ID NO: 244897 - DNA, 832 bp, Homo sapiens
  misc_feature: GYAE6OF01BBG6W.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagtactgtgttgacgcagtctccaggcctaccctgttctttgtctccgaaggggaaagcgcccaccctctcctgcgacgggccagtccaagaattgttaccaacgtggttcgtacgccgttacgggtaaccagactaacgaaaccgttggaccctaggttccccagtcccttcctcactctagttcggtaactacgtacccgaccgacgggcctacgtcggacctaacgtacccgaagaccgtacgggtttacaaggtcggaccgtagggtccgggttacggtacggggaaaccgtaacgttaaccgttacccgtaaccgttacccgtaacctaaccccgtaagttacccgaaacggaccgtaaaacggttacccggttaacggggaacccggttaccgttaagggtaaacgtttacgtttttaacgggaacttaaagggtttaccgtttaaacgtttaccgttacgttacgaaacgtcgtaaacggttacgttacgggtacgtaccgttaaccgtaccggtaccggttcccgggaaacggtaaaccggggttaaccgtaaacgggtaacggtaaactaaccggtaaaacgttacgtagggttaccggtacgaccgtacctaacggttacgttccgttaacgtctttcccgtaccgttaccccgttcccgtacccgtacgttacccgg

SEQ ID NO: 244898 - DNA, 670 bp, Homo sapiens
  misc_feature: GYAE6OF01B8OKT.5.59.F04.1.454.CMB.1.raw
  modified_base (133)..(133): a, c, t, g, unknown or other
  misc_feature (133)..(133): n is a, c, g, or t
  modified_base (191)..(191): a, c, t, g, unknown or other
  misc_feature (191)..(191): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagntgccaccggaaagctgtgtgacgcagtctccaggcacctgtcttgtctcgaggggaangccacctctcctgcgaggccagtcagatcgttaccaacgtggttcgagcctggtaccagacaagaaacctggacctacggttcccagtccctctacactctagtcggtactactccacgtacggcctacgtggacctacgtacccgagacgtacggttcaggtcggcgagggtccggttacgtaggggaacctacggttaccttacgtaccgttaccgtaccgtaaccctagtccgtaacgccgtaacggtacgtacggggactacccgtaggttaacgttacttttcgggacgttaacggttacgttacgttaccgtcgttacgacggttacgtagtacgtcggtacgtcgtacgtacggtacggtcgacggtaacggtaccgtaaggtacgaataaccggtaactacggtgtacggtacgtcgactacgtcgtccgtagttcccttactacgttacccgttccgtaacgtgtaccgg

SEQ ID NO: 244899 - DNA, 651 bp, Homo sapiens
  misc_feature: GYAE6OF01BN0AX.5.59.F04.1.454.CMB.1.raw
  modified_base (147)..(147): a, c, t, g, unknown or other
  misc_feature (147)..(147): n is a, c, g, or t
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctccagatcgccaccggaaanctgtgtgacgcagtctccgaggcacctgtctttgtctacgaggggaaancgccctacccgtntctgcgacgggccagtacagaattcgttaaccaacgtaggttcgtagcctacggacagactaagaacctggaccgtacggttccccagccttcctactacgtacgtacgttggtactactcccgaacgacgggcctagcggccaactccgaagtactaggttacacggtcgcgacgggtcggtacgagggactacggtccttcgactctacacctagcacgacacggacgtagacgcgtacgagtacgtttcgacgtaagttcgttaacgtacgttcgtacgtaagacgtagtacggtgtacgtaccgtcgtaacgggtaccgttaacgggaccgtaaacgggacgtaacggtacggtaaactacggaaacgtacgtacgtacggtcgtacgaccgacgttaactccgtacgtacgttcacttcccgtacctccgtacgtcg

SEQ ID NO: 244900 - DNA, 783 bp, Homo sapiens
  misc_feature: GYAE6OF01CVPX2.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgtgacgcagtctccaggccaccctgtctttgtctccgaagggaanacgccaccctctcctgcagggccagtcagatgtaacagngtcgagctggacagcaagaactggccaggtccagcctcncatctagtggtatactccgaccgagggcctacgtcggactactccaagactaggtcaggtggccagggccgggtactacggggactaacgtaccttcgactccgtaccaacctagtaccgaacgtactaacggtacgtacgggacctaccgttaaggtaagtttcgtttaggacttaggttagttaaactttaccggtacttagtaacggtacgttaaggtttaccggtagggttaccggttaccgttaaccgggtaaacccggggttaccggggtttaacccggggaaccggtaaaaaccggggggttaacccgttaaaagggggttaaccgggaaaaacccttaaacggtaaaaaacccgggttaggtacggggttaaccgggtaccgttaaacccgtaacccggtaaccggtaaacttttccccgggttaaacggttttacccctttaacccgttaaaccgttttccccccggtttaacccccgtaccgttaaccgtttaccccgg

SEQ ID NO: 244901 - DNA, 561 bp, Homo sapiens
  misc_feature: GYAE6OF01BP4UB.5.59.F04.1.454.CMB.1.raw
  modified_base (198)..(198): a, c, t, g, unknown or other
  misc_feature (198)..(198): n is a, c, g, or t
  modified_base (527)..(527): a, c, t, g, unknown or other
  misc_feature (527)..(527): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaccggaaagactgtgttgacgcagtctccaggcaccctgtctttgtctccgaggggaaangccaccctctcctgcagggccagtcagaatgttaccaagaggttcgagcctggtaccagcaagaacctggccaggttcccagcctctcatctagtgtatactccacgagggccactcggcactcccagactaggttcaggtcgcaggcgggtctgggacagtacttcactctcacctatcagacaggacgtggacgtcctagtaagtattttgacgtagttagttattactagtcgagtctagtataggtagctacgacggtacgtccggaccgtaacgggaaccgtaaggtaggaataccgaaacgtaacgtgtaggtcgtcgacacntaccgtgttcttctactaccttcccgtctgtccg

SEQ ID NO: 244902 - DNA, 706 bp, Homo sapiens
  misc_feature: GYAE6OF01BF5YX.5.59.F04.1.454.CMB.1.raw
  modified_base (147)..(147): a, c, t, g, unknown or other
  misc_feature (147)..(147): n is a, c, g, or t
  modified_base (196)..(196): a, c, t, g, unknown or other
  misc_feature (196)..(196): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (691)..(691): a, c, t, g, unknown or other
  misc_feature (691)..(691): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaanactgtgttgacgcagtctccaggccaccctgtcttgcctcgaggggaancgccaccctctccgtgcgacgggccagtcagaatcgttaaccaagtaggttcgagccgtaggtaccagacaagaaacctggacctacggtcccagtcctctcatctatgtatacnccacgnggccagtgcactcccgaagacgaggttcaggtcggacacgggtccggggtacgtacggggaactacggtacttaccggtactccgtaccgaacctaagttcccgaaaggtacccgtaaacggacccggttacgggaccgttaccgtaaggttaaacgttacgttttcggaacgttacggttagttactttacgtacgtacgacgtagtaacgttggtacggacgtccgtacgtaacgggtaccggttcggaaccgggtaacggtaccggtaaggtaacgtaacgaaacgtaaccgaacggtcgtacggtacggtacgtacccgaactacggttccgttaggtttacccctacggtaacccttcccggttacccnccgtaacgtttccgg

SEQ ID NO: 244903 - DNA, 777 bp, Homo sapiens
  misc_feature: GYAE6OF01DR7R0.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctcaggcaccctgtctttgtctccgaggggaaanagcccaccctctcctgcagggccagtcagaatgtaccaataggttcgtagcctggtaccagcaagaacctggccacggttccagccctctcatctatggtatactccgaccgaggccacgtggccactcccgaagtaccgtagggtttcaggtcgggaccgtagggtccggggttacgtggggaaccacggtaccctttacaaccttccgtaccaccaagtccagacctaggtacgtgggacgtcctaaggtaacgttagttttacggacgttaagggtttcgttaacgttttacgtaggttacgtaaggtaccgttaaggtttaacggttacggggtaccgttacccggttaccggtaaccccggggtttaaccgggttaccccgggggtaaacccgggtaaaccgggggaaaccggttaaacggggttaacgggtaaaaccgtaaaccggtaaaaaccgggtaaccgttaacggggttacgggtacccgtacggaccccgttaacccgttacgttcccggtttactaacccgtttccttaccgtttccccgttacccccgtcttaaccgggttacccgg

SEQ ID NO: 244904 - DNA, 733 bp, Homo sapiens
  misc_feature: GYAE6OF01A7Z8P.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatgccaccggaaagctgtgttgacgcagtctccaggccaccctgttctttgtctccgaaggggaaancgcccacccgtctccgtgccgacgggccagtcaagtaactcgttaaccaacgtagggttccgtacgtccgtagggtaccaggacaacggtaaaccgtggacccgtacggttccccaagtcccttccctatacgtacctagttggtaactaccgtacccgaccggacgggcccacgtcggacactacccgaagaccgtaggttacaggtcggaccgtaacgggtccgggggttacgtacggggaacctacggtaccttaccgaccttaccgtaccaaccgtatccggaagtccgacggtacgtagggacctacgttaggtaagtttctttacggcgttaagtagttaacgttacgtacggtacaggacgtaagttacggtgggtacctaccgtacgggaccggtaccggttcgggaacccgtaagggaaccgtaagggtaacggtaaactacggtaaaaccgtcggtaggtacggcgtacgacgtacgtactcgttacggtacttactaccgttacccgtcccaccgttggtaccg

SEQ ID NO: 244905 - DNA, 776 bp, Homo sapiens
  misc_feature: GYAE6OF01DQ43C.5.59.F04.1.454.CMB.1.raw
  modified_base (210)..(210): a, c, t, g, unknown or other
  misc_feature (210)..(210): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaagctgtgttgacgcagtcctccgaggcctacccttggttctttgtcctaccggaaggggaaacncgccctaccctctccgtgccgaggacctagtacaaggtaattcgttaaccaacgtacgggttacgtacgtccgttaggaaccaggacgaacgtaaaccgtcggacccgtaacggttcccacgtcccttccgtactacgttacctagtacggttaacttaccgtacccgaccgacgggtaccctacgtcggacctaacgtacccgaaggtacgttacggttacgacgggtcggacgtacgggtccgggtacgtacgggaacgtacggtaccttacgaccttaccgtaccaacgtacgtcgaacgtccgtaaggtacggtacggacgtaccgtaaggttaacgttacgtttgacgttaaggttacgttattacggtacgtacgtacgtacgtaagttacggtggtacgtccgtaacggtccgggtacggtaccgggaacgtaaccgggtaacgtaaggtaacgtaaacgacgtaaaaccggtgtacggtacgtacggtaccgtacgacgtttacgtaccgttagttcccttacgtaccgttacccgtacccgtacgttagttacccgg

SEQ ID NO: 244906 - DNA, 578 bp, Homo sapiens
  misc_feature: GYAE6OF01ELA3Q.5.59.F04.1.454.CMB.1.raw
  modified_base (242)..(242): a, c, t, g, unknown or other
  misc_feature (242)..(242): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
  modified_base (574)..(574): a, c, t, g, unknown or other
  misc_feature (574)..(574): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacccttgtctttgtctccgaggggaaagagccaccctctcctgacagggccagtcaagaatgttaaccaacnggttcgagcctggtaccagcaagaacctggaccaggttcccagtcctcctcatctatggtatatccaccgagggccactggcactccagacaggttcagtgcacggnggtctgggacagtacttcactcncacatcagcagactggagacctagaacgtattttgactagtagttattacgtagtactagacgtagtagtggtaacgccgtacgtacgggtacggttaccggaccgtaaacgggtaaccgaaggtaaggaaagtaacgtaaacgaacgtaggtacggacgtcgacacagttactacgttacttctacttcctcccgtccgtntacg

SEQ ID NO: 244907 - DNA, 919 bp, Homo sapiens
  misc_feature: GYAE6OF01DY6XQ.5.59.F04.1.454.CMB.1.raw
  modified_base (134)..(134): a, c, t, g, unknown or other
  misc_feature (134)..(134): n is a, c, g, or t
tcagatcagacacgcacgaccggtgctcgatttagtacacacacttagggattggggtgctcagttaggacccagagggaaccatcggaaaccccagcgcagcttctcttcctcctgctactctggctcccagntgccaaccggaaagactgtgttgacgcagtctccgaggcacccttgttctttgtcctccgaaggggaaacacgcccaccccttctcccgtggccgacgggccagtccaagtaacttacggtttaacccaaacgtacggtttccgtacggtcccgtaggtaccacgactaaacggtaaaccgttcggacctacggtttaccccacggtccccttacctcctaactccttaagtacggttacttacgtacccgaacccgtacggggacccctaacgtcggtaccctaaccgttaccccgaacgtaccgtaacgggttttacgaacggggttccgggaccggtaaccggggtccgggggttacggtaaccggggtaacccgtaacggttaccctttaacccggtaccctttaccgtaacccgtaaccctacgttacccgaaggtacccaaacggtaaccgttcgggaacgtacccgttagggtaaaccgttttgtttaccggtacgttaggttaagtttaacgtttacgttacgggtaccgttaacggtacgtttaggttaacggtttcggtaaccgtccgttaccgggaaaccggggttccggtttaacccggggaaaaccggtaaccggggtaaaaccggtaaacgggtttaaccgggtaaaacttaacccggaaaagggttaccgtagggtaccggtaccgtacgaccgtaacccgttacgttacgttttaccgttaccgttttaccgttaccgtttacccccgctttaaccgttcgtaacccgg

SEQ ID NO: 244908 - DNA, 762 bp, Homo sapiens
  misc_feature: GYAE6OF01BUI05.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaagcgcccaccctctcctgcgagggccagtcagaatgttaccaatggttcgagcctggtaccagcagaacctggccaggttcccagccctcctcatctatggtatactccaccgagggcccacgtcggacctactcccgaagtacctagggtttcaagggtggcgtacgggtccggggtcgtggggaacaggtaccttcgaccttccgtaccaacccgtacttaccgaacggtacctaaacgggtaccgttacggggtaaccgtcccgttaagggtaaacggtttacgttttttacggaccgttaaggttttacgttaacgttttaccgtacggttacctaacggtaccgtaagggtttacgttacgggttacgtaccgttaccggtaaccgggttaccgggtttaccgggaacccggtaacggggtaacccgtaaggggtaacggtaaacgtaaccgaaaacggtaacgttcgggtacggtaccgtcggaaccgtaaccgttacgttccgttacggttaccgtttaccgtacgttaccccgtttaccccggaccctcgtttacccgg

SEQ ID NO: 244909 - DNA, 678 bp, Homo sapiens
  misc_feature: GYAE6OF01BI5NM.5.59.F04.1.454.CMB.1.raw
  modified_base (148)..(148): a, c, t, g, unknown or other
  misc_feature (148)..(148): n is a, c, g, or t
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaanactgtgttgacgcagtctccgaggccaccctgtctttgtcctccgaaggggaaancgcccaccctctccgtgcgagggccagtcaagtatgtaaccaagtggttcgagcctaggaccagcagaacctggcctaggtcccagcctctnatctagtgtactactccaccgaggccacgtgcctatcccaagtacaggttcgagttgacgtggccggtagtacggacagtaccttcgactcctacgacccgtatccgtaacggctaacggacgttcggacgcgtagagttagtttgacgttagttacgttacttacgtacgtacgtacgtataaggtagttacggtacgtacccgttacggtaaccgggtaaccggttaccggtaaaccgggtaaccggggtaaccgtaaaggggtaacgtaaacgtaaaccggtaaacggttaacgtaggtacggtaccgtacgtaccgtaaccgtacgttcgtaccgttacctttaccgttacttccccgttaccctccgtacgttaccgg

SEQ ID NO: 244910 - DNA, 598 bp, Homo sapiens
  misc_feature: GYAE6OF01DVW4R.5.59.F04.1.454.CMB.1.raw
  modified_base (144)..(144): a, c, t, g, unknown or other
  misc_feature (144)..(144): n is a, c, g, or t
  modified_base (193)..(193): a, c, t, g, unknown or other
  misc_feature (193)..(193): n is a, c, g, or t
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (344)..(344): a, c, t, g, unknown or other
  misc_feature (344)..(344): n is a, c, g, or t
  modified_base (368)..(368): a, c, t, g, unknown or other
  misc_feature (368)..(368): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaanactgtgttgacgcagtctccaggcacctgtctttgtctccaggggaaancgccaccctctcctgcaggccagtcagatgtaccangtctagctgacagcanaactgcagtccagctcncatctatgtatatccacagggcctactggcatcccagacagttcagtcgcagcggtctgggacagacttcaactcgtacacntcagcagactgacgacctgaaatntttagacgtacgtagtaacttaccgtagttaccgagtaccgagttaacttagggtacgtaccgttacgtaaccggtaccggttacggtacccgaaacgggacccgtaaagggtacggtaaacgtaaccgtaaaacggaaacgttacggtacggtacgtacgtacgtacccgaagttcccttagtacccgtttacgtaaccttacccgtttccccggtcctagttacccgg

SEQ ID NO: 244911 - DNA, 759 bp, Homo sapiens
  misc_feature: GYAE6OF01D3SU7.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctcaggcaccctgtctttgtctccgaggggaaanacgccaccctctcctgcgagggccagtcaagtaattcgttaaccaacgtaggttccgtaacgtccgtaggtaccaagacgaacgtaaaccgtcggaccgtacggtaccccagtccctcctacaacttctagtacggtaacttactacccgaaccgacggaccacgtcggactactacccgagtacgtaggttcaagggtcggcgacgggtcggggtacgtaggggaacctacggtaccttcaccgttcctaccaacgtactcgaagcctaaggtacgtacggacgtaccgtaagtaagttagttttaggacgtaggtttacgttaatttaaccgtgtacgaggtacgttaacggttaacggtagggttacgaccgttacggtaacccggggttaaccggtacccgggtaaccgggtaaacgggtaacccggtaaagggttaacgggtaaaaccgtaaccggtaaaacgtaacggtcggtaacgggtaccgtacacccgtaacgtacgttccgttacgttaacccgtttacgaccctttacccgttacccgtcgtcgttaccg

SEQ ID NO: 244912 - DNA, 644 bp, Homo sapiens
  misc_feature: GYAE6OF01B1X8T.5.59.F04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (297)..(297): a, c, t, g, unknown or other
  misc_feature (297)..(297): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctccgaggggaaangccaccctntcctgcgagggccagtcagaatgtacangttcgagctggaccagcagaacctggaccaggttccagcctcnatctagtggtatactccacgnggccctacgtcggcactcccgagacgtaggttccagtggacagggcggtcagggacaggcttcgactcgtaccactagtcaagtacacggtacgtgggactccgtaagtaacgttagttttacgacgtaggtttactaaagtttcacgttacgtaggtcctaagggttacgttacgggtaagtcccgtacgggtaaccggggttaccgttaccggggaacccgggtaaacggggtaaccgtaaaggggtagtaaacctaaaccggaaaccggtaagttcgggacggtactacggaccctactacgtcttaacgtccttaacgtcctaccctccggtcctcgttaacg

SEQ ID NO: 244913 - DNA, 778 bp, Homo sapiens
  misc_feature: GYAE6OF01BLND5.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaanagcccaccctctcctgccgacgggccacgtcagatacgttaaccaacgaggttcgtacgccgtggtaccacgcacgaaaccgtggaccgtacggttcccacgcctcctcacttctagtggtactactccgacgacggccacgtcggcaccgtcccgaacgtacgtacggttccgacggtcgggacgtacgggtcggggttacgtacgggggaacgtacggtaacccgttcctaaccgtttacccgtaaaccgtactacccggaacgtaccgtaacggaccgttacgggaccgtaccgtaacgggtaaagtttacgttttacgacggttaagttacgtttaacgtttaccgtcggttaaccgagtccggttaagttacggtaggttaccgtaccgttaacggtaccgggttaccggttaccgggaacccgaaaccgggggtacggtaaacgggttaacggaaacggtaaccgaaacggtacggttcgggacggtacctaccggaccgtaaccgtactttccgttacgttcccttaaccgtaccctttccccgttaccccgtaccttaccggttcgttaacgg

SEQ ID NO: 244914 - DNA, 731 bp, Homo sapiens
  misc_feature: GYAE6OF01C08IW.5.59.F04.1.454.CMB.1.raw
  modified_base (477)..(477): a, c, t, g, unknown or other
  misc_feature (477)..(477): n is a, c, g, or t
  modified_base (499)..(499): a, c, t, g, unknown or other
  misc_feature (499)..(499): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaagctgtgttgacgcagtctcaggcctacctgttcttgtctaccgaaggggaaacacgcctaccctctacctggcgacgggccagtacgaagtaacttacgttaaaccaacgtacggttaccgtaacgtccgttacgggtaaccaaggaccgaaacgtaaaccgtcggaaccctacggttcccaacgcccttcctacactacttagaggtaactactaccgaccgacggacctacgtcggacctacgtacccaagtacgtaacggtcgaggtcggaccgtaggtccgggttagacggaactaacgtaccgttcaaccgtcctacaaccgtanacgaagcgtaagacgtggaacncgttaagaacgtttagtttagacgttaagttaggttaacttacgtagtaacaggacttaaggttagtaggtactcgtaacggtacgggttacgttaccgaaacgggtaaacggtaaaccgtaaagggttaacgaaacgtaacctaaaagggtacctagggtacgaggtaacctactaacgtacgtttctacgtttaccttacaacttttcccgtaccccacgtgtttaccgg

SEQ ID NO: 244915 - DNA, 672 bp, Homo sapiens
  misc_feature: GYAE6OF01B31UB.5.59.F04.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (471)..(471): a, c, t, g, unknown or other
  misc_feature (471)..(471): n is a, c, g, or t
  modified_base (487)..(487): a, c, t, g, unknown or other
  misc_feature (487)..(487): n is a, c, g, or t
  modified_base (664)..(664): a, c, t, g, unknown or other
  misc_feature (664)..(664): n is a, c, g, or t
tcagatcagacacgcacgaccggtgctcgatttagtacacacacttagggattggggtgctcagttaggacccagagggaaccatggaaaccccagcgcagcttctccttcctcctgctactctggctcccagatcgccaaccggaaagactggtgttgacgcagtctccgaggccaccctgttctttcgcctaccgaaggggaaacncgcccaccctctccngcgacggccagtcagtaatcgtaaccaacgtggttacgacgtccgtaggtaccagacaacgtaaccgtggaccctacggtcccagtccctacctactactcgtagtcggtaactacctcccgaacgcggcctacgtcggcctacctcccgaaggaccgttagggttaccaggtcggaccgagggtccggtgtacgggactaggtaccttcacgttccacgacctacgtcgagacaggtacgtcggacncgttaagtaacgtttnttcggacgttagttacgttaactttacgagtacgagtacgtagttacggtcggtactccgtaccggtaacggtaccggtaccggaacgtaaaccggtacgaaggtacgtaacaaccgtaaaggtcgtcggacgactacgaccgtatcgtctacgttacctcgttacccttcctaccngtcgttcg

SEQ ID NO: 244916 - DNA, 612 bp, Homo sapiens
  misc_feature: GYAE6OF01EEX83.5.59.F04.1.454.CMB.1.raw
  modified_base (251)..(251): a, c, t, g, unknown or other
  misc_feature (251)..(251): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccagcacctgtcttgtctcgaagggaagcgccacctctcctgcgaggccagtcagaatgtacaatgtcagctggtacagcagaacngcaggtccagcctctcatctatggtactactccaaccgtagggccaacgtcggacatcccgaagtacctaggttccaggttcggacgacggtcggtcgtacggggacaggttaccttcgacttcctacacgatccgagcacggacgtaggacgtccgtagtaagtattttagacgtagtagttaagttactcgtactagacgttagtagtaggtacgtactacggtaacggtacgttacggtaaccgggaaccggttaacgtaaaggaacgttaaacgtcgtaaaacggtaacgtaggtaacgtcgtacgaccgtaacacttacgtcgtacctttacgactcccgttccgcctcgttacgg

SEQ ID NO: 244917 - DNA, 764 bp, Homo sapiens
  misc_feature: GYAE6OF01D57NC.5.59.F04.1.454.CMB.1.raw
  modified_base (189)..(189): a, c, t, g, unknown or other
  misc_feature (189)..(189): n is a, c, g, or t
  modified_base (514)..(514): a, c, t, g, unknown or other
  misc_feature (514)..(514): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatcgccaccggaagactgtgttgacgcagtctcagcacctgtcttgctcgaagggaanacgccacctctcctgcgacggccagtcaagtaattcgtaaccaacgtaggtttccgacgccgtacggtaccagacaacgaaacctggacccgtacggttacccacgtcccttacctcagttctagtacggtacttactccaaccgacgggtaccacgtggaccactcccgagacgtaggttcaggtcggacgaggtccggggtcgtacggggaacacgtaccgtttacaaccgtcctacaacccagtaccacggactaacggtacgtaggaacgtaccgttgggtaaattgttttacgacttaggttaacgtttaagtttaccgngggtttacaacgggttcctaaggtttaacggttcgggttaaccgtacccgttaccgggtaaccgggtttaccggttaccgggaaaccgggtaaaccgggtaaccggtaaacggggttaacggaaacgttaaccgaaaaaccgggttacgttacgggttaccgggtacgtaaccggtaccctaaccgttacgttaccgtttcgttaaccgttacctacccgtttcccttaccccggtacgtcgttaccggg

SEQ ID NO: 244918 - DNA, 556 bp, Homo sapiens
  misc_feature: GYAE6OF01BXO3E.5.59.F04.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (279)..(279): a, c, t, g, unknown or other
  misc_feature (279)..(279): n is a, c, g, or t
  modified_base (385)..(385): a, c, t, g, unknown or other
  misc_feature (385)..(385): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgtctccgaggggaaangccaccctctcctgcagggccagtcagatgtaccaanaggttcagcctggtaccngcagaactggccaggttcccagcctctnatctatggtatatccaccgagggccacgtggacactcccagtacaggtttcaggtggcaggtcgggtctgggacaggacttcactctacacatcagcagctggacnctagtaagtatttgctagttgtattacgtgtctagctagtagtggtagctacgacggtacgttcggaaccgtaagggacgaacgggtagaacgtacgaaacgtacgtggtacggtcgtacgacgaacctcgttcgttcgttacttcgtacttccttcccgactacgttccg

SEQ ID NO: 244919 - DNA, 837 bp, Homo sapiens
  misc_feature: GYAE6OF01CEC9Z.5.59.F04.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgttctttgtctccgaaggggaaancgcccaccctctcctgcgacgggccagtcagaatcgtaaccaagtaggttcgtagcctggaccagcaagaacctggacctacggttcccagccctctcatctagtgtatctccacgagggccacgtggaccactcccgagtactaggttcaggtcggctagggtcgggttctagggaactaggtacctttacgaccttcctaccgtaaccctagtaccgaacggtcccgtaaacgggtaccggttacggggtaaccggtacccggtttaagggttaaacggtttaacgttttttacgggacgtttaaacgggtttacgttttaaacgttttacccgttacggttaccgttaacggtacgtttaacggttaacggtttacgggttaaccgtaccggttaccggtaaccggggtttacccgggttacccgggtaacccggggtaaacggggtaacccgggttaaaggggttaacggtaaaaccgttaaccggtaaaaccgggttaaccggttacgggttaaccgggtaccgttacccgggaacccgttaaacccggttaccgtttaccgtttccggtttaacccgtttacccgttaccctttaccccggtttccccccgtacgtttacccggttacccg

SEQ ID NO: 244920 - DNA, 759 bp, Homo sapiens
  misc_feature: GYAE6OF01A61LS.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagctgtgttgacgcagtctccgaggcaccctgttctttgtctccgaaggggaaancgcctaccctctccgtgcgacgggccagtcaagtaacttcgttaaccaagtacggttcgtagcccgttagggaacccaggaccgtaaacgaaaccgttcgggacccgtacggtttaccccacgtcccttacctacgtaacttcgttaaggtacggttacttaaccgtaccccgaaccggacgggtccctaagtcggacacctcccgaagacgtacggttccgaggttccggacgtaccgggtcggggttacgttacggggaaccgtacgtaacccgttacgaacccgttccgtaaccgtaacccgtagtacccgaacggaaccgtaaccggttacggtacgggacgttaccgtaaggtaaacgtttcgttttacgacgttaagttacgttaacgtttacgtagtacgtacgtacgtagttcgtagtacggtcgtacgtaacgggttccgtaccggacggtaacggtaacgtaacgggtaacgtaacgtacgtaacgtacgtcggtacgtacgtacgtacacgtactacgtcgttactctacgttacctcctcgttctaccg

SEQ ID NO: 244921 - DNA, 1019 bp, Homo sapiens
  misc_feature: GYAE6OF01DV67V.5.59.F04.1.454.CMB.1.raw
  modified_base (152)..(152): a, c, t, g, unknown or other
  misc_feature (152)..(152): n is a, c, g, or t
  modified_base (209)..(209): a, c, t, g, unknown or other
  misc_feature (209)..(209): n is a, c, g, or t
tcagatcagacacgcacgaccggtgctcgatttagtacacacacttagggattggggtgctcagttaggacccagagggaaccatggaaaccccagcgcagcttcttttttctcctcctgctactctggctcccagatcgccaaccggaaanactgtgttgacgcagtctccaggcctaccctgttctttgtctaccggaaggggaaanacgccctaccctctcctcggacgacgggaccaggttcaagtaagttaccgttaacccaaacgtacgggtttccgtacggtacccgttacgggtaacccaggaccgaaacggtaaaacccggtcgggacccgtaccgggttcccacgtccccttccgtactagttccttaagtacggttactacgtacccgaaccgtacgggccctacgtcggacctaccttacccgaacgtacgtaacggttacgacggtcggacgacgggtccggggttacgtaggggaacctaacggttaccttacccgtaaccttcccgttaaccgaaacccgtacgtaccggaaacggacccgtaaacgggtaaccggtacggggtaacccggttaaacccgtttagggtaaaaggttttttcggttttaaccgggaacccgttttaagggttttaaccgttttaaaccgttttaccggttacgggttacccgttaaacgggttaccgtttaaacgggttttaacggttaacgggggttaaccgttacccgggttaaccggttaaccccggggggtttacccggtttaaaccccggggggtaaacccgggttaaaaccgggggtaaacccgggttaaaagggggttaaacccgggtaaaaccttaaaccggggtaaaaaacccgggtttaacggttcgggttaacccgggtaccgtaacccggtaaaccccgtaaccctttaggttacccggttttctttaaccccgttttaaccggtacccctttaccccccgttaaccccggtaccgtttacgttaaccccggg

SEQ ID NO: 244922 - DNA, 749 bp, Homo sapiens
  misc_feature: GYAE6OF01AG0G8.5.59.F04.1.454.CMB.1.raw
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctccaggggaangccaccctctccngcagggccagtcagatgtaccacnggttcagcctggtaccagcagaacctggccaggttcccagcctcctcatctagtggtatactcccgaccgacgggcccacgtcggcctactccccgaagacgtaggttaccaggttggaccgacgggtcggggtcgtacggggaacctaggtaccctttccaaccgttcctaccgaaccctataccgaacggtaccaacgggtacgtcgggacgtacccgtaggtaacgttagttttacggacgtaaggtttacgttaacgttttaaccgtcgggttaccaggtacgttaaggttacggtacggttacggtaccgttaccgtaaccggggtaccgggttacccgggaaccggtaaacggggtaaccgtaaacgggtaacgggtaaaccgtaaaccggtaaaaccggtaaccgtacgggtacgggtaccgttaacggacccgtaaccgttacgttaccgttacgtttacccgttacccttaccgtttaccccgttacccccggtccttaacgttcccgg

SEQ ID NO: 244923 - DNA, 762 bp, Homo sapiens
  misc_feature: GYAE6OF01CK4TW.5.59.F04.1.454.CMB.1.raw
tcagatcagacacgcacgaccggtgctcgattttagtacacacacttagggattggggtgctcagttaggacccagagggaaccatggaaaccccagcgcagcttctcttcctcctgctactctggctcccagatcgccaccggaaagacttgtgttgacgcagtctccaggccacccttgttctttgtctaccgaaggggaaagacgccctacccttctcctgcgacgggccagtcaagtaacttcgttaaccaacgtaggttcgtacgcccgttaggtaccagacaacgtaaccgtcggacctacggttccccagtccctacctcattctagttggtactactcccgacggacggtcccagtcggaccacgtacccgaagtacgtacgggtttacaggttcggacgacgggtccgggtacggtacgggtaacctacggtaccctttacaccgttcctaccaaccctagtaccaggctaacggtacgtacgggacgtccgttaaggtaacgtttagtttcgacgttaggtttagttacgtttacgtacgttacgtacgtacgtaagttacgtaggttacgtaccgtaacggtcggtaaccgggttaccggaaccggtaacgggaaccgttaaagggtaacggtaaacgtaaccggtaaacggtacgtacgggtacgtaccgtacgtaccctaacggttacgttacgttaccgttaccgttaccttacccgttaccctttaccccggacttacgtttcccgg

SEQ ID NO: 244924 - DNA, 844 bp, Homo sapiens
  misc_feature: GYAE6OF01DRUND.5.59.F04.1.454.CMB.1.raw
  modified_base (160)..(160): a, c, t, g, unknown or other
  misc_feature (160)..(160): n is a, c, g, or t
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
  modified_base (411)..(411): a, c, t, g, unknown or other
  misc_feature (411)..(411): n is a, c, g, or t
tcagatcagacacgcacgaccggtgctcgatttagtacacacacttaggggattgggggtgctcagttaggacccagagggaaccatggaaaccccagcgcagcttctcttcctctgctactctggctcccagatcgccaccggaaagactgtgttgacncagtctcaggcacctgttctttgtcctcgaggggaaanacgccctacctctccngcgacgggccagtacagtaactacgttaaccaagtacgggttcgtacggccgtagggtaccagacaacggaaaccgtcggaccgtaacggttccccacgtacccttccctactactcgttacgtaggtacttaccacccgtaccgtacgggccctacgtcggacctaccgtacccgaaggtaaccgtacgggtttanaaccgggttggacccggtagggcccgggggttacggtacgggggaaacctacgggtaacccgtttcctaaccgttccttaaccccgaactacttacccggaaggaccttaaacggaccgtaccgggtacgtacccgtaagtaacgggtttacttttcgggacgttaagggtttactttacgttaccggttagtaccggtacgttaacggtaggtttacggttaacggtacgggtaaccgttacgtaaccgggggttaccggttaccgggtaaaacccggggtaacgggtaaaccgggtaacgggtaacgggttaaaaccttaccggaaaaccggttaggtacggtacggtaccgtaccacggtaccttacgggttccttacgggtttacccttacggttacccttaccccggtaccctccttcggttaacccg

SEQ ID NO: 244925 - DNA, 818 bp, Homo sapiens
  misc_feature: GYAE6OF01CYZRP.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcacctgtctttgtctcgaagggaaancgcccaccctctcctgcgaggccagtcaagtaatcgttaaccaacgtaggttcgtagccgtaggtaaccagaccaacgaaaaccgttcgggacccgtaaccgggttccccaacggtcccccttacctactaacgtccgttaagttcggttaactaacgtaccccgaaccgtaacggggccctaaccgttgggaccctaaccgtcccgaaggtaaccgtacgggtttacacgggttcgggaccgtaaggggtcccggggttcgtacgggggaaacctacggtaacccgtttccaaaccgtttcccgaaccctaaccctacgttaaccgaaacggtacctaaacgggtaccggttagggaaccggtaacccgttagggtaaacgttacgttttacggaccgttaaggtttacgttaacgtttacgtaggttaccgaacggtacgtaaggttagtacgggtacgtaccgttacgggtaaccggtaccggttaccgggaaccggtaacgggtaaccggtaaggtaacggaactaaccggaaaacggtacgtggtacggtacgtacggtacctaacgtactaccgttcgtaccttacgtaccttccgttaccccgtctacgttaccg

SEQ ID NO: 244926 - DNA, 708 bp, Homo sapiens
  misc_feature: GYAE6OF01BM7EB.5.59.F04.1.454.CMB.1.raw
  modified_base (199)..(199): a, c, t, g, unknown or other
  misc_feature (199)..(199): n is a, c, g, or t
  modified_base (567)..(567): a, c, t, g, unknown or other
  misc_feature (567)..(567): n is a, c, g, or t
  modified_base (698)..(698): a, c, t, g, unknown or other
  misc_feature (698)..(698): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcctacctgttctttgtctccgaggggaanacgccctacctctcctgacgaggccagtcagaacttcggttaaccaacgtaggttccgtacgtccgtaggtaacccaggacctaaacggaaacccgttcggacccgtaccggttacccaacgtccctacctacacttacttaacgtacggttactacgtaccccacggtaccgggtaccctacggtcggacctaccgtacccaggtaaccgtacggtttacaggtcggacgtacgggtccggggtcgtacggggaactacggtacccttacacctaccgtaccacctataccgacgacgtacgtacggtagaccgtacgttaagaacgtttgtttacgacgttagtaacgttaatttacgtacggttnacgtacgtagtacggtcgtagcgtacggacggtacggttacggaccgtaacgggtacaagggtacgtaaactacgaaggacgtaggacgatcgacacgtgtaccttacgttctactaccttccgtaacccngtacttccgg

SEQ ID NO: 244927 - DNA, 652 bp, Homo sapiens
  misc_feature: GYAE6OF01ESU7J.5.59.F04.1.454.CMB.1.raw
  modified_base (97)..(97): a, c, t, g, unknown or other
  misc_feature (97)..(97): n is a, c, g, or t
  modified_base (198)..(198): a, c, t, g, unknown or other
  misc_feature (198)..(198): n is a, c, g, or t
tcagatcagacacgcacgaccggtgctcgattttagtacacacacttagggattgggggtgctcagttaggacccagagggaaccatggaaaccccngcgcagcttctcttcctcctgctactctggcctcccagatgccaccggaaagactgtgttgacgcagtctccaggcaccctgtctttgctcgaggggaaangccaccctctcctgcaggcagtcagatgtacacgagttcgtagcctggtaccagcaagaacctcggccacggttcccacgcctcctcactctatgtatactaccaccgacggcctgaactcgggccaagtcccgtagtacagggtttccagtcggggcctaggcggggtacctaggggtacctaaggacctttccaacctaccttacaacccgaattccgaacgtaccgtaagggcttacgtacgggagtttcgttacggaaacgttagttttaagttacagttacgtacgttacgtcgttacgtacgtacgtacgtacgtacggtacgtacgtacggtaccggtaacggtacggtaacggtaacggtaaccggtaacggtaaggtaacgtaacgtaacgtacgtcgtacgacgtcgtacgtactactacttacgtaccttactcttccgtccg

SEQ ID NO: 244928 - DNA, 798 bp, Homo sapiens
  misc_feature: GYAE6OF01ARAY4.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaaggggaaancgcccaccctctcctgccgacgggccagtcaagatcgtaaccaagtggttcgtagtccgtaggtaccagacaacgaaacctcggacctacggttccccacgtcccttcctactacttctagttcggtaactaccgtccccgaaccggacggcccacgtcggaccacgtcccgaagtacgtaggttcgaggtcggaccgtagggtccgggtcgtaggggaacctacgtaccttcgaaccttcctacacctataccgacgtacgacgtacgtacgggtactaccgtaaggtaacgtttcgttttacgaccgtttagttacgtttaacttacgttacgtaccgtaaggtacgttaggttaggttaacgggtacgtacccggttaacgggtaaccggggtttaacccggttaccgggaaacccgggtaaaggggtaacccggtaaaagggttaaccgaaaaccgttaaaccggtaaacggttaccggttacgggtacccgtaaccgtaccggtaacccgtaccgttccgttaccggtttaccgttaaccccgtttaccgttaaccccgttaccccggtttacccgtccgtttaacgttacccggg

SEQ ID NO: 244929 - DNA, 674 bp, Homo sapiens
  misc_feature: GYAE6OF01C32LZ.5.59.F04.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (340)..(340): a, c, t, g, unknown or other
  misc_feature (340)..(340): n is a, c, g, or t
  modified_base (415)..(415): a, c, t, g, unknown or other
  misc_feature (415)..(415): n is a, c, g, or t
  modified_base (468)..(468): a, c, t, g, unknown or other
  misc_feature (468)..(468): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatgccaaccggaaagactgtgttgacgcagtctccaggcacctgtcttgctccaggggaaancgccacctcncctgcagggccagtcagatgtacacaggttcagcctaggtaccagcaagaaacctggaccaggttccagtccctcctacatctatcggtatacgtacccaccgagggccccaatcgggaccacgtccccagtaaccngggttacaggtggccaggtcgggtctggggactaggacctttcaacgtcctacacctagtcagcagacctggacnctaggaactatttgctagtgtaattacgtgtacagtcaagttagtacggtaancgtacgtaacgggtacgttaccgggacccgtaaacgggtaccgtaaagggtaacggtaaagtaacccgtaaaaacggtacccgttagggttaccgggtacggtaccgtaacccgtaacccggtaaacgttttcccgttacggtttaccctttaaccggtaacccttttcccgtttaaccccccgggacctttaaaccgttcccggg

SEQ ID NO: 244930 - DNA, 746 bp, Homo sapiens
  misc_feature: GYAE6OF01CHECF.5.59.F04.1.454.CMB.1.raw
  modified_base (209)..(209): a, c, t, g, unknown or other
  misc_feature (209)..(209): n is a, c, g, or t
  modified_base (738)..(738): a, c, t, g, unknown or other
  misc_feature (738)..(738): n is a, c, g, or t
tcagatcagacacgcacgaccggtgctcgatttagtacacacacttagggattggggtgctcagttaggacccagagggaaccatggaaaccccagcgcagcttctcttccctcctgctactctggctcccagatcgccaaccggaaagactgtgttgacgcagtcctccaggcctacccttgttctttgtcctaccggaaggggaaanccgccctaccctctcctgcgacgggccagtcaagtatacgttaaccaagtacggttacgtacgccgtacggtaaccagaccaaacgtaacccgtcgggtaccctacggttacccacggtcccttacctctacttactagtaggtactactcccgaaccggcggaccacgtcggacctacgtacccaagtaccgtacggttcgacggtcggaccgtagggccgggtacgtacgggactacggtaccttccaccgtcctaccactactacgagactacggacgtaggacgtaccgtagtaacgttgtttacgacgttagttacgttacgtttagttacgtacgtaagtacgtttagtacggttacggttaacgtaccgttaacccggggtaccgttaacgggttacccggaaaccgggtaacggggtaaaccgtaagggtaacgaacgtaccggaacgtaaccggagttcgggtacgtcgtaccgacctacgttcgtactttccgtaccttccgacctttcccgtacccgnttacccgg

SEQ ID NO: 244931 - DNA, 852 bp, Homo sapiens
  misc_feature: GYAE6OF01B24QI.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaancgcccaccctctcctgcgacgggccagtcagtaattcgttaacccaacgtaggtttccgtacgtccgtagggtaacccagaccgaacggtaaaacccgttcgggacccctaacgggtttaccccccaaggtccccctttacccgtactaacgtttaccgttaaggttacgggttaacttaaccgttcccccgaaacccggtaacgggggtcccctaacggttcggggaccctaaccgttacccccgaaggtaacccgttaggggtttccgaagggtccgggaccgtacggggtccggggttcgtacggggaaccacggtaacctttccaaccgttcctaccaacctacgtacgacgaccgtaacgtaccggtacgggacgtaccgttaaggtaagttacgttttacggacgttaacggtttacgtttaacgtttacgttacgttaccgtaacggtacgttaaggttacggttacgggttacgtaccgttaccggtaaccgggttaccggttacccgggaaccggtaaacggggaaccgtaaagggtaacgaaactaaccggaaaacgtacggttacggtacggtacgtacgtaccgtaccgtagttaccgttcgttaccgttcctacttacccgttcccgtccgttcgttaccgg

SEQ ID NO: 244932 - DNA, 722 bp, Homo sapiens
  misc_feature: GYAE6OF01CB3IH.5.59.F04.1.454.CMB.1.raw
  modified_base (193)..(193): a, c, t, g, unknown or other
  misc_feature (193)..(193): n is a, c, g, or t
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
  modified_base (369)..(369): a, c, t, g, unknown or other
  misc_feature (369)..(369): n is a, c, g, or t
  modified_base (439)..(439): a, c, t, g, unknown or other
  misc_feature (439)..(439): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtcttgctccgaggggaangcctaccctctccgtgacgacggcagcaagtatcgtaaccgaagtacggttcgacgccgtcggtaaccngccaacgaaccgtcgccgtacggttcccacgcccttctactnttatacgtgtaactactcccgaacggtcggtacctacgtcgcctactcccgagtacgtacggttnaggttcggaccgcgggtaccgggtacggtacggaaacgtcgtaccgtttcaaccgttccgtacaaccgtntaccgaggtcctaaacggtacgtcgggataccggttaggtaacgtttacgtttcgaacgttagtttacgttaactttaggtcgtactagacgtaggttactcgggtactaccggtacggtaaccgggttaccgttaccgggaaccggtacgggtaaactaacgggtaacgtaaacgtaaccgtaacgggttaaacgttcggaaacggtcccttggaacccgtaccggttattccggttaccgtacttaaccgtaccgttacccgttcccggtctaacggttcg

SEQ ID NO: 244933 - DNA, 592 bp, Homo sapiens
  misc_feature: GYAE6OF01BHNG3.5.59.F04.1.454.CMB.1.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (277)..(277): a, c, t, g, unknown or other
  misc_feature (277)..(277): n is a, c, g, or t
  modified_base (378)..(378): a, c, t, g, unknown or other
  misc_feature (378)..(378): n is a, c, g, or t
  modified_base (570)..(570): a, c, t, g, unknown or other
  misc_feature (570)..(570): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaangccaccctctcctgcagggccagtcagatgtaccaagngtcagcctggtaccagcagaacctggccaggtcccagcctcctnatctagtggtatactccaccggaggccacgtggcctacgtcccagacctaggttacgagtggcgaggtcgggtactgggacagtaccttcgactctcactnaccagcagcgtggcgaccgtagaagtatttcgactagttagttaacttacgttcgtacgtagtactaggttagtgggtacgtaccgtacggaccgggtacggttaccgggaccgtaaacgggtaccgaagggtacggaacgtacgaacgtaacgtcggtagacgtcgacctacgtgttacgtcgttacttcncttacctcccgcgtcgttaccg

SEQ ID NO: 244934 - DNA, 782 bp, Homo sapiens
  misc_feature: GYAE6OF01ESGML.5.59.F04.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgctcgagggaangccacctntcctgcaggccagtcagaattgtaccaanggttcgagcctggtaccagcaagaacctggccaggttcccagcctccacatctatggtaatactaccacgaggccactggacactcccagacaggttcagtggcacggcggggtctaggggaactacgtaccttcaacgttccgtacaacccgtatcccgaaagccgaacggtacgtacgggaacggtacccgttaaggaacgttagtttttacggacgtaaggtttaacggtttaactttaaccggttacggtttaccgaacggtaccgttaaagggtttaacggttaagggttaacggtaccgttaaccgggttaaaccgggtaaccgggtttaccgggtaacccggtaaacggggtaaacccgggtaaacgggtttaaacgggaaaaacgttaaaccgtaaaaacccgggttaaaccggtaacgggttaccgggtaccgttaaccgggtacccgtaaacccgttaaacgttacccgtttaccggtttaaccgttttaccgttaacctttaccccgtttaaccccgttaccccgtaaacgtttacccgg

SEQ ID NO: 244935 - DNA, 612 bp, Homo sapiens
  misc_feature: GYAE6OF01C542P.5.59.F04.1.454.CMB.1.raw
  modified_base (198)..(198): a, c, t, g, unknown or other
  misc_feature (198)..(198): n is a, c, g, or t
  modified_base (390)..(390): a, c, t, g, unknown or other
  misc_feature (390)..(390): n is a, c, g, or t
  modified_base (429)..(429): a, c, t, g, unknown or other
  misc_feature (429)..(429): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaanagccaccctctcctgcagggccagtcagaatgttaccaactaggttcgtagcctggtaccagcaagaaacctggccagggttcccagccctcctcatctagtggtattactccaccgagggccacgtcggcactcccagtacgtaggttcaggtcggcgaggcgggtctggggacagtacttcactctcacntcagcagacgtggacgcctagaagttgttttgctagttnttattacgtgtcagtctagtagtggtactcgtcgacggtccgttacggaccggtaagggaccgtaagggtacggtaaacgtaccgaaaaccggtacgtacggtacgggtcctacggtaccaaccgttagtcctttcggttacctttaccgtactttaccccgttcccgtccgttcgttaccgg

SEQ ID NO: 244936 - DNA, 873 bp, Homo sapiens
  misc_feature: GYAE6OF01ETS0R.5.59.F04.1.454.CMB.1.raw
  modified_base (194)..(194): a, c, t, g, unknown or other
  misc_feature (194)..(194): n is a, c, g, or t
  modified_base (681)..(681): a, c, t, g, unknown or other
  misc_feature (681)..(681): n is a, c, g, or t
  modified_base (817)..(817): a, c, t, g, unknown or other
  misc_feature (817)..(817): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctcgaggggaanagccaccctctcccgcgacgggaccgacgtacgacgtaaagttacgtttaaccgtaaaccgtaacggttaccggttacggtacccgttcgggttaacccgaacggaccgaaaccggtaaaacccgttaccggggaccccgtaaccggggttttacccccgaacccggtacccgttccccttacccgtaacttacccgtttaacgtttacggggttaacttaaacctttacccccgaaccccgtaacggggggccccctaaccgttaccgggcccgtaaacctttacccccgaacggtaaaccgttaacgggtttaccggtaaacgggttcgggtaccgggaaaccggttccgggggttaccgttcggggaaccgtaacgtaccgttacctacctcccgttaccaaccgtaactacaacgtcaagtacgtacggacggtacctaggtaaagttcgttttagacgaggttttacgtaatttacacggtnaacggtactaggttacgttggtacgtccgttacggtaccggtacggttaccggaccggaacgggttaaccggaagggttaaacgaacgttaacggaaaaccgtacgggttgtacgggccttcgggaacccgtaacnctttaggccgtttacgttacctaacgtttcccgttaccccggctaagtcggtacgg

SEQ ID NO: 244937 - DNA, 574 bp, Homo sapiens
  misc_feature: GYAE6OF01A4RJ3.5.59.F04.1.454.CMB.1.raw
  modified_base (193)..(193): a, c, t, g, unknown or other
  misc_feature (193)..(193): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagactgtgttgacgcagtctccaggcaccctgtcttgctccaggggaaangccaccctctcctgcagggccagtcagatgttaccaataggttctagctggaccagcagaactgccagtccancctcncatctatgtatcnccacgacggccacgnggccactcccgagtacaggttcacgtggcaggcgggtcgtgggacacgtcttacactcgtcacctatacgagcacgactcgggactccgtagtaagtatttaggctagttcgtattactcgtctagctaggttactggtactctacgtaccggtacggttaccggacgtaaccgggacggtaaggtacgggtaaactaccgaaacggtaacgtaggtaggtacgtcgaccgacctacgttctcgttccttacaccttccgttacccgctacgtcc

SEQ ID NO: 244938 - DNA, 776 bp, Homo sapiens
  misc_feature: GYAE6OF01AW5SF.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccaggcaccctgtctttgtctccgaggggaanacgccaccctctcctgcaggccagtcagatcgttaccaataggttcgtacgcctggtaccagacaacgaacctcggaccacggttcccagccctcctcatctagtggtatactaccaccgacgggccacgtcggaccactacccgaagaccgtacgggttcaggtcggacgtacggtccggggtcttaggggaaccaggttaccttaccgaccttccgtacccaaaccctacgtaccgacggtacgaaacggacgtttacggggaccggtaccgtaacgggttaagttaccggtttttacgaaccggttaggttacgtttaacgttacgttcggtacgtaccggtacgttaagttacggttagggttacggtaccgttaacggtaccgggttaccgggtaccggtaaccgggtaaccgggtaaccggtaaacgggttaagggtaaacgttaaccggaaacgggttaaccggtacgggttacgggtaccgtcggtaacccgtacccggttacgtttaccgttaccgtttacccgttacgttaacccgttaccccttaccccggtacctaccggtttacccgg

SEQ ID NO: 244939 - DNA, 617 bp, Homo sapiens
  misc_feature: GYAE6OF01BOKS4.5.59.F04.1.454.CMB.1.raw
  modified_base (191)..(191): a, c, t, g, unknown or other
  misc_feature (191)..(191): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (453)..(453): a, c, t, g, unknown or other
  misc_feature (453)..(453): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtcttgctcgagggaancgccacctctcctgcgacggccagtcagatcgtaccanggttcgtacgctgaccngcagaacnggccacggttcccagcctaccgtcatctagtcggtaatcgtcccaccgacgggtccacgtggaccacgtcccagacgtggttacaggtcgcnggcggtcgtagggacngactcactcctcacctnctacgacagacgtaggacgtacctaggaactgtttgactagttagtataccgtgtacagtctagtacgtggtancctacggaccgtacggtacggaccgtaaacgggacctaaaggggtacgaagtaaccgaaaacgtacggtaggttaccgacgtacggaccccttaacggccgttaaccgttccggttaccttaccgtaccgtttaccccgttttccccaccgttagttacccggg

SEQ ID NO: 244940 - DNA, 828 bp, Homo sapiens
  misc_feature: GYAE6OF01CVPOF.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggcctcccagatcgaccgaccggaaagtactgtgttgacgcacgtctccgaggcctacccttgttctttgtccgtaccggaaggggaaacgacgcccacccttcctccgtcgcgacgggaccagtacaagtaattacgttaaccaacgttacggtacgtacgccgtacggtaaccagacgtaacgtaaccgtcggaccgtacggtcccacgtcctcctactactctagtacgtactaccgtaccgaccgacggtccacgtacgacctacgtacccgaggtaacgtacggttacgacgggtacggtccgacgggtcgggtacgacggggtacgtacgtaccgttaccaccttcaaccgtacctagtacccgaacgacgtaaccggtacggtacggaccgtaccggtaagtacggtttacgtttacgacggtttaacggtttagttaaccgtttacggtacggttaacgtacggtacgttaacggttaggttacgttacgtacccggttaccgggtaaccgggttacccggtaacccgggtaaccggggaaacggtaaccgggtaaagggttaaccggaaacgttaaaacccgggtaaacggttccgggttaggtacccggtacgtaccggtaacctacggttacgtttccggttcttacccgttaaccttacccggtccccttaccccggtatccggtttacccgg

SEQ ID NO: 244941 - DNA, 748 bp, Homo sapiens
  misc_feature: GYAE6OF01AKPSG.5.59.F04.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (250)..(250): a, c, t, g, unknown or other
  misc_feature (250)..(250): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagatgtaccaacnggttcagcctgaccngcagaacctggccaggttcccagccctcctcatctatggtactactaccaccgacggccacgtcggccacgtcccaggactaggttcaggtcggaccacggtcggggttcgtaggggaccaggtaccgtttaccaaccgttccgtaccaaccctacgttaccaacggtaccaaggtacccgttacggggacggtacccgttaggtaaacggttacgttttttacggaccgttaacgggtttaggtttaacgttttaaccggttcggttaaccgtaaggtcccgtaagttaacggttacgggttacgtaccgttaccgggtaaccgggtaccgggtttacccggggaccggtaaacgggggtaaaccgtaaacggggttaacggtaaactaaccggtaaaacggtaacgttacgggtacggaccgttacggaccctaaccgtcgttccgttagttacccgtttactaccgttccccttaccccgtcgtacgttacccgg

SEQ ID NO: 244942 - DNA, 741 bp, Homo sapiens
  misc_feature: GYAE6OF01AR3W8.5.59.F04.1.454.CMB.1.raw
  modified_base (196)..(196): a, c, t, g, unknown or other
  misc_feature (196)..(196): n is a, c, g, or t
  modified_base (366)..(366): a, c, t, g, unknown or other
  misc_feature (366)..(366): n is a, c, g, or t
  modified_base (399)..(399): a, c, t, g, unknown or other
  misc_feature (399)..(399): n is a, c, g, or t
tcagatcagacacgcacgaccggtgctcgatttagtacacacacttaggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaanagcccaccctctcctgccgacgggcccagtcaagtaattacggtttaacccaacgtagggtttccgtaagcccgttacgggtaaccagaccaaacggaaaccgttcggccgtacggttccccagccctccctacaattctaatggtaactactcccacgacggcctacgnggtacactcccgagacgtaggtcaggtcggacncggccgggtagtcgggaactgacctttccacctactccaacctacgtccgacgtagaccggtacgtacgggaccgtaccgtacggtaacgttagtttacggtaccgtaagttacggttaacgttacgttcgtacgaacgtcgtaacggtacgttacggtacggtacgttaccggtaacggtaccggttacgggaccgtaaacggggtaccggtaacgggtaacgggtaacgtaaaccggtaaacggtaaccgttacgggtacgtccggtacgtaccggtacctacgttaccgttaccgttaccgttacctacgttaccttaccccggtacccttcggtaccg

SEQ ID NO: 244943 - DNA, 874 bp, Homo sapiens
  misc_feature: GYAE6OF01B9974.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaagactgtgttgacgcagtctccaggcacctgtcttgtctccgaagggaaacncgccaccctctcctggaccgacgggcccagtaccgaagtaactacgttaaccaacgtacggttacgtaacgtccgttacgggtaccaagaccgaacgtaaccgtcggacctacgggttacccaacggtcccttccttacacttaccgtagttcggttacttaaccgtcccgaaccgttacggggaccctaaaccggttcggtaccaacttaccccgaaagggtaccgttaacggggtttaccaacggggtacgggtaccgtaacggggtccggggggtttacgtaccgggggaacgttaacggtacccgttttacccgaccgttacctacccgaaacccggtaatcccgaaaggtaccgaacggttaaccgtgggtaaccgtacgttaaggtaaacggtttacttttaacggaccgttaaaggttcgtttaaaacgtttcgtaggttaccggtaagtaaccgtaggtttacgtaaacgggttcgaaccggttaccggtaacgggggttaccggttaccggaaacccgggtaaaacggggtaaccctaaagggggttaaaccggaaacgttaaaccgggtaaacgtacgggttacggtacgggtctaaaccggtacccgtaacgttacgttccgtaaacggtttccttaaccgtctttacccgtcccgtgtaccggttacg

SEQ ID NO: 244944 - DNA, 828 bp, Homo sapiens
  misc_feature: GYAE6OF01A1L59.5.59.F04.1.454.CMB.1.raw
  modified_base (193)..(193): a, c, t, g, unknown or other
  misc_feature (193)..(193): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctcgaggggaancgccacctctcctgcagggccagtcagtaatcgttaaccaacgtggttcgtagcctaggtaccagcaacgaaaccgtggcctagggttccccagtccctcctcactctagtggtactactcccacgacgggccacgtcggactactcccgaagacgtacgggttcaggtcggacgacggtcgggtacgtaggggaccacggtacctttcgaaccgttcctaccacctactaccgacgacgaacggtaccggtacgggaacgtacccgtaaggttaaacggtttacgtttttacggaccgttaagggtttacgtttaacgtttacgttacggttaccgtacggtaccgttaagggtttaacgttacggggttaacgttacccggtaaccgggtaaccggggttaaccgggtttacccgggaaacccggggttaaaaccgggggtaaaccccggttaaaaggggttaaacgggtaaaaccggttaaacccgggttaaaaaccgggtaaacggttacgggttaaccggggtacggtacccgggtaaccctaacccgttaacggtttcccgttaacgtttaccctttaccggttaaccctttaccccggtttaacccggtaacctttacgttacccggg

SEQ ID NO: 244945 - DNA, 889 bp, Homo sapiens
  misc_feature: GYAE6OF01COQL5.5.59.F04.1.454.CMB.1.raw
  modified_base (219)..(219): a, c, t, g, unknown or other
  misc_feature (219)..(219): n is a, c, g, or t
  modified_base (271)..(271): a, c, t, g, unknown or other
  misc_feature (271)..(271): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatcgccgaaccggaaagactggttgttgacgcagtctccgaggccacccttgttctttgctccgaaggggaaagcgcccaccctcncctgcgacggcagtcagtatcgttaaccaagtgttccgtagccgtaggaccngacaacgtaacccgtcggaccacgggttcccacgtccctacctctactactacgttggttaactacgtaccgaccgacggcctacgtcgctacctaccgagaccgtaggttacgaggtcggcgacggtcgggtcggtagggacgtacggtacctacgtaccgttaccacctaacccgtactaccggacgtaaccgtaacggtaccggtcggggtaaccggtaccgttaacggttaaacgggtttacgtttttacggaacggtttaacggtttaacgggtttaacgtttaaccgttaacggttacccggtaacgtaccggtaaacgggtttacggttaacgggttaccgtacccggttaaccggtttaacccggggtacgggtttaccccgggttaaaccggggtaaacccggggtaaaacccgggttaaacgggggtaaaccggttaaaccggtaaaaaccggtaaaacccggttaacggttaccggggttaacccgttaaccgggttacccggtaccgtaaacccgggttaaccttaccggtttacccgtttaccggtttaccccttaccggttttccccccgttaacccccgttccgttaacccgggtttcccggg

SEQ ID NO: 244946 - DNA, 749 bp, Homo sapiens
  misc_feature: GYAE6OF01EYQN2.5.59.F04.1.454.CMB.1.raw
  modified_base (193)..(193): a, c, t, g, unknown or other
  misc_feature (193)..(193): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctcaggggaaangccaccctctcctgcgagggccagtcagaatgttaccaacaggttcgtagcctggtaccagcagaacctggccaggttcccagtcctcctctatctagtggtaacttactcccaacgacgggccaacgtggaccaacgtcccgaagacgtagggtttaccaggtcggacgtaacggcggggttctacgggggaacctaggtaccttacgaccttcctaccgaaccctaatacccgaaggcctaaggaccgttacgggaaccggttacccgtaggtaaacgttacgtttttacggacgttaaggttacgttaacgtttaaccgttcgttacgtaacggtacgtaagggtttaacgttagggttaacgtaccgttaccggtaaccggggtaccggtttaccggggaacccggtaaacggggtaacccggtaaaggggttaaccgggtaaaaacgttaccggtaaaaacggtaaccggttacggtacgggtacgtaccgacgtaaccctacgttccgtagttcccttacttacttacccgttcccgtccctgttacccg

SEQ ID NO: 244947 - DNA, 815 bp, Homo sapiens
  misc_feature: GYAE6OF01D21WB.5.59.F04.1.454.CMB.1.raw
  modified_base (204)..(204): a, c, t, g, unknown or other
  misc_feature (204)..(204): n is a, c, g, or t
tcagatcagacacgcacgaccggtgctcgatttagtacacacacttagggattggggtgctcagttaggacccaggagggaaccatggaaaccccagcgcagcttctcttcctcctgctactctggcctcccagatgccaaccggaagactgtgttgacgcagtctccaggccaccttgttctttgtcctaccgaaggggaaancgcccacccttctccgtggacgacgggccagtccaagtaacttcgttaacccaacgtagggttcgtacgccgttacggtaccagaccaagaaacccgtgggaccctacggttccccacgtcccttacctactacttccgttaagttacggttacttaacgtcccgaaccgtacggggaccctaccggttcggaccaccgtacccgaagtaaccgtacggttacgaggttcggacgacgggtcggggttcgacggggactacggtaccttacgaccttccgtaccaacccgaccacgccgaacggtaccgtagggaaccgtaccgttaggtaaacgtttacgttttggacgtttaaggtttacggttaactttacgtacggtactaacggtacttaaggtttacggttacgggttacgtacccgttaccgggtaaccgggttacccgggttaccggaacccgggaaacggggtaacccggtaaagggttaaaccggtaaacgtaacccggtaaaacggtaccgtagggtaccggtacgttaccggacctacgttacttccggttacttaccgttcgtaccctttacccgttcccgaccttcgttccgtacgg

SEQ ID NO: 244948 - DNA, 767 bp, Homo sapiens
  misc_feature: GYAE6OF01CI9OH.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggcctcccagatcgccaaccggaaagacttgtgtgacgcagtctccgaggcctacccttgttctttcgtcctaccggaaggggaaacgcgaccctacccttctccgtgcgacgggcctacgtcaagtaattacgttaaccaaacgtaggttaccgacgtccgtacggtaccagaccgaacgtaaaccgtcggaccgtaccggttacccacgtccccttacctactacttacgtaagttacggtactaccgtaccccgaccgtaggaccctacgtcggacctaccgtaccgaagtacgtacggttcgaggtcggtacgacgggtaccggggtttcgagggactaacggtaccttacgtacgtaccctacctaacgtacgtacacggtaaccacggtaaccggtggtaaccgtaccgttaggtaacgtttaggtttcgacgtttaggttacgtttaacgtacgttagtaccgtacgtacgttaggttacgtaggtacgtaccgtacgggtaccggtaccggtaccggacgggaacggtaacggtaaggtaacgtaacgtaacgtaaacgtacggttggaccgacgtccgaacgtaccttgtccgttacttaccttacgtaccttcccgtaccctgtaccgttacgg

SEQ ID NO: 244949 - DNA, 810 bp, Homo sapiens
  misc_feature: GYAE6OF01B6BZL.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggcctcccagatcgccaaccggaaagactgtgttgacgcagtctccgaggccaccctgtctttgtctaccgaagggaaacgcgcccaccctctcctgcgacgggccagtcaagtaactcgttaaccaacgtaggttcgtacgcctacggtaccagacaacgtaaccgtcggaccgtacggttcccagtccctcctacactctagtaggtactactaccccgaaccgtacgggaccctacgtcggacctaacgtaccccgaaggtaaccgtacgggtttacgacgggtcgggaccgtacgggtccggggttacggtacggggaaccgtaacggttacctttccgaaccgttccgtaccgaacccgtacgtaccgaacggtacccaacgggtaaccgtcgggaaccgtaccgttaaggtaacgtttcgttttacgacgttacgtttaagttaactttacgtcgtaacgtacggttactaagggttacgtacgggttacgacccggttacgggtaaccgggttaccgggttacccgggaaaccgggtaaacggggtaaccgtaaaggggtaacggtaaaactaaccggaaaaccgggttacgtcgggtacggtaccgtacgaccctaaccggttattccggttactttaccgttccgaacccgtttcccgttccccgagttcgttaccgg

SEQ ID NO: 244950 - DNA, 844 bp, Homo sapiens
  misc_feature: GYAE6OF01DF3FC.5.59.F04.1.454.CMB.1.raw
  modified_base (209)..(209): a, c, t, g, unknown or other
  misc_feature (209)..(209): n is a, c, g, or t
tcagatcagacacgcacgaccggtgctcgatttagtacacacacttagggattggggtgctcagttaggacccagagggaaccatggaaaccccagcgcagcttctcttcctctgctactctggcctccagatcgccgaaccggaagactgtgttgacgcagtcctcgaggcctacccttgttctttcgtcctaccggaaggggaaacncgccctaccctctcctcggccgacgggacctagtcgaagtaacgttacgttaaccaaacggtacggtttaccgtacgtccgttacgggtacccaaggtaccaaacgaaaccgttcgggtacccgtaacgggttttccccaacggtcccctttacctccgtaacttaccttaacgttcggggtttaacttaaaccttacccccggtaaaccccggaacggggtacccccgtaacgtttccgggaccctaaaccctttacccccggaaacggtaaccgttaacggggtttaccgtaaacggggttccgggtaccgtaacggggtttacgggggttcgtaacgggggtaaccgttaacggtaacctttccggaaacgtttccctaacgtaacccctagtacccgaacggtacctaaggtaccggttaacgaccgtaccggttaagtaacggttatttacggtacgtaagtttacgttacgtttacgtcgtacgtaagtcgtaagttacggtgtacgtcctacggtacggtaggtaccgtacggaaacggacgtaaaggtaacgtaactaacgaaacctcggtaggtacggtcacggtccactacgtcgtcgttactcttactcctacctcgtcgtcgg

SEQ ID NO: 244951 - DNA, 710 bp, Homo sapiens
  misc_feature: GYAE6OF01E0TSX.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgagggaangccaccctctcctgcaggccagtcagatgttaaccaacgtaggttcgtagccgtaggtaccagcaacgaaaccgtggacctacggttccccagtccctcctcatctagtgtatactccaccgacggccactggccacgtcccagactacggttcaggtcgacgacgggcgggtcgtagggacacgtaccttaccacttcctaacgacctacgtccaacggctaacggtacgttagggacgtaccgttaaggtaagttagttttcgaccgtagttagttacgtttacgtagtaccgtaaggtacgtaggttaagttcgggtaaccgtcgttaaccggtaccgggttaaccgggttacccgggaacccggtaacggggaaccgttaaacggggtaacggtaaaaccgtaacgaaaccggtaacgttacggtacggtaccggtaccgaccgtaaccgtacgtaccgttacggtttcccttaccgtaccgttcccgttaccccgtcgttcgttacccgg

SEQ ID NO: 244952 - DNA, 604 bp, Homo sapiens
  misc_feature: GYAE6OF01B3BJN.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgtctccgaggggaaangcccaccctctcctgcagggccagtcagaatgttaaccaacgtaggttctagcctaggtaccagcaagaaacctggccaggttcccagcctcctcatctatggttatactccaccgagggcccacgtcggctactcccagacctaggttcaggtggcaggcgggtcgtgggacaggtacttcactctccacatcaagccagtacgtggacgcctaggtaagtagttttgacgtagttgttattactgtcagtctagttagtgtagtcgtacgtaccgggtacgttccggaaccgtaacgggtaccgtaaacgggttacggtaaagtaccgaaacggtaacgtgggtacggacgtcggaccacctacgtcgtacgttcttactaccttcctccccgtccgtacgttccg

SEQ ID NO: 244953 - DNA, 749 bp, Homo sapiens
  misc_feature: GYAE6OF01A2ZOX.5.59.F04.1.454.CMB.1.raw
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggccaccctgtctttgtctccgaaggggaaagngcccaccctctctgcagggccagtcagatcgtaccacgaggttcagccgtggtaccngacaagaacctggcctacggttcccagccctcctnactctagtggtatactcccgaccgacggccacgtggccactcccgaagaccgtaggttcgaggtcggacgacgggtccggggtcgtaggggaacctacgtacccgttaccacgttaccctacctaacccgtagttacccgaacggaccgtaaacgggtaccgtacggggaaccggtacccgttaggtaaacggtttacttttacgggaacgtaggttttacgttaacgttttacgtacggttaccgacgggtactagggttaggttacgggttacgtaccggtaccggtaacgggttacccggtacgggaaccgggtaaaccgggtaaccggtaaggggtaacgtaaacgtaaccggtaaaccgtaccggttagggtaccggtacgtaccgacctaccgtacgttcttccggttaccttaccgttacccttaccccgtcccgtacgttccgttaccgg

SEQ ID NO: 244954 - DNA, 857 bp, Homo sapiens
  misc_feature: GYAE6OF01CFSQ1.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgctccgaggggaaancgccacctctcctgcgagggccagtcaagaatcgttaaccaagtcggttcgtacgccgttggtaccagacaacgtaaccgtggacctacgggttcccagtcccttcctctactcttagtggttaactactcccgaaccgtacgggccctacgtcggacctacgtccccgaaggtaaccgttacgggttaccaacgggttcgggacccgtaggggtcccgggggtttacgttacgggggaaccttacgggtaccctttacccgaacgtttaccctaccgtaaccctagtttacccgaacggtacccgtaacggtaccggttacggggaaccgttacccgttaagggttaaagttttacgttttacgggacctttaagggtttacgtttaacgtttaccgttacggttaccgtaacggttaccgtaagggtttaacggttacggggttaaccgtccggtttaaccgggtaacccggggttaaccgggttaccggggtaacccgggtaaacgggggtaaacccggtaaaggggttaaccggtaaaccggtaaccgtaaaaccgggtaccgttagggtacgtaccggtacgtacccgtaacgttacgttccgtttacgttaccgtttcctaccgtttcccgttacccccgtattacggttcccg

SEQ ID NO: 244955 - DNA, 925 bp, Homo sapiens
  misc_feature: GYAE6OF01CYUH0.5.59.F04.1.454.CMB.1.raw
  modified_base (131)..(131): a, c, t, g, unknown or other
  misc_feature (131)..(131): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccngatgccaccggaagactgtgttgacgcagtctcaggcaccctgtctttgtctccgaggggaaagcgcccaccctctccgtgcgagggccaggtcaagtaattcgttaaccaacgtaggttacgtacgtccgtaggtaaccagaccgaacgtaaaacccgttgggacccgtaacgggttccccaacggccccttacccgttacctaacttaccgttaacgttcgggttaacttaaccgttaccccgaacccggtaagggggacccctaacggtcgggaccctaacgttaccccgaaggtaccgttaacgggtttacaaacggttcgggaaccgacggggtaccggggttcgtacgggggaactaacggtacctttaccaaccgttcccttaaccgaaccctacgttaccgaaccggtacgtaaccgggtaaccgttacggggaaacggttaccccgtaagggtaaacgggttttacgtttttacgggaaccgtttagggtttaacgtttaacgtttaccggtttacgggtaaccgttaaggtaaccgtaagggtttaacgttacgggttaccgtaccggtttaaccggaacccggggtttaccggtttacccggggaaacccgtaacgggggtaaacccgggttaaagggttaaacgggtaaacctaaaccggtaaaacccggttacggttacggtacgggtacccgttaccggaacttaacccggtagtttaccgttaccggtttactttccggaacccttttccccgtaccccggttactacgtttacccggg

SEQ ID NO: 244956 - DNA, 632 bp, Homo sapiens
  misc_feature: GYAE6OF01BSO4S.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctntcctgcagggccagtcagatgttaccaactggtctagcctggtaccagcagaacctggccaggttcccagcctctcatctatgtatntccacgaggccagtcggcatcccagactaggttcaggtcggcaggtccgggtctgggactaggtccttcacgtctacaccatccagtccagtaccgtaggacgtcctaggtaacgttattttacggacgtaagttcggttaactttacgtagttacgtacgtcgtagtacgtaggtaagtcgtcgacgggtaccggttccggaccgggtaaacgggtaccgaaacgggtacggtaaacgtaacgaaaccgtacgttacggtacggtaccgtacggacctaaccgtacgttaccgttaccgttcttaccgtacttaccccgttcccgtccgtacgttacccg

SEQ ID NO: 244957 - DNA, 924 bp, Homo sapiens
  misc_feature: GYAE6OF01DR8KJ.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccaggagggaaccatggaaaccccagcgcagcttctcttcctcctgctactctggctcccagatgccaccggaagactgtgttgacgcagtctccaggcacctgtctttgtctccgaggggaaancgcccaccctctccgtggcacgggccagtcaagaatcgttaaccaacgtaggttcgtacgtcccgttagggtaacccaggccaaacggaaaacccgtttcggggacccctaaccggggttttaccccccaacgggtccccctttaccccgtaccgtaaactttacccgttaaacgtttggggttaaacctttaaccgttacccccgaaacccggtaacgggggaccctaaccggttcgggaacctaccgttacccccgaaggtaaccgtacgggttcacggttacggccgtaacgggtcggggtacgttacgggggaacctaacgtaccgtttacgaacccttccgtacccaacccgtacttacccggaacggacctaaacgggttaccggttacggggaaccggtacccgtttagggaaaacggtttacgtttttacgggacccgtttaaagggtttcggtttaaacttttaccggttacgttacgtaacgtaccgttaaggttttaaggtcgggttaacgtccgtttaccgggaaacgggttaccggtttaacccgggaccggggtaaaccggggttacccggtaaagggttaacggaaacctaacggttaaaccggtaacgtcgggttacggtaccggttacgaaccccgttacgtaacggtttccgtacggtttacccgtttacgtacccgttttacccttacccccggcttaccgtttaccgg

SEQ ID NO: 244958 - DNA, 805 bp, Homo sapiens
  misc_feature: GYAE6OF01EJKTZ.5.59.F04.1.454.CMB.1.raw
  modified_base (189)..(189): a, c, t, g, unknown or other
  misc_feature (189)..(189): n is a, c, g, or t
tcagatcagacacgcacgaccggtgctcgatttagtacacacacttagggattggggtgctcagttaggacccagagggaaccatcggaaacccagcgcagcttctcttcctcctgcttactcgtcggcctccagactcgaccgaaccggaaagtcgttggtgttacgacgctagtcctccgacggccncccgttgttcctttcgtacctaccggaaggggaaactcgaccctaccttcgtccgtggccgacggtaccagttacgaagtaacttacgttaaccaagttacggttacgtacgtccgtacgggttaaccacgaccgtaacggaaccgtcgggtacccgtaaccggttcccacgtccctacgtactacttacgtacgtcgtacttacctccgaccgcggtacctacgtcgtccacctacgacgtacgtacggtcgtacggtcgacgtagggtcgggtacgtaggtaaccgacgtttaccctacgaaccgttccgtaaccacgttacgacgtacgccgtaaagtccgacggtacgtacgttacgtaagtttacgttagtacgttacggttaatttaccgtttagtacgttaacctacggtaccgtttagtaaccggttggttaacgtccggttaacgggtacggttaaccgtccgggtaacgggtaaaccgggtacgttaaacgggtaaccgttaaggaaaccgttaaacgggtccttacgggtacggttacgaccgtaccgtacttccggttacgttcgttactttccgtacccttaccgttccctcgttagttaccg

SEQ ID NO: 244959 - DNA, 707 bp, Homo sapiens
  misc_feature: GYAE6OF01BZJKH.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctcaggcacctgttctttgtctaccgaggggaanacgccaccctctcctgcgaggccagtcagaatcgtaccaacgtggttcgacgtccgtggtaccagacaacgaaccgtcggacctacggttccccacgtcccttcctactacttctagtaggttactactaccgaccgacggcctacgtcggactactacccgaagacgtacggtcgtaggtgaccgtacggtcggggtacgtacggactacggtaccttcaaccgttcctacaacctctacgacgaccaaggtaccgtacggacgtcgtaacggtaagttacgttttacgagtagttagttacttacgttagtactaggtacgtagttacggtcggttactccgtaccgttaaccgggtaccggtaccgggaaccgtaacgggtaccggaaagggtaacggtaacgaaccgttaaacggtacgttcggaccgtacgtaccggaccttacgtacgttcgttacgtttaccttaccgtttaccgttacccgtttccgtacctcggttaccgg

SEQ ID NO: 244960 - DNA, 756 bp, Homo sapiens
  misc_feature: GYAE6OF01DNDO3.5.59.F04.1.454.CMB.1.raw
  modified_base (203)..(203): a, c, t, g, unknown or other
  misc_feature (203)..(203): n is a, c, g, or t
  modified_base (498)..(498): a, c, t, g, unknown or other
  misc_feature (498)..(498): n is a, c, g, or t
  modified_base (555)..(555): a, c, t, g, unknown or other
  misc_feature (555)..(555): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgccaaccggaaagctgtgttgacgctagtctccaggcctaccctgttctttgtctaccgaaggggaanacgcccaccctctcctgcgacgggcctagtcaagtaattcgttaaccaacgttacgggttccgtacggtcccgttacggtaaccaggaccaacggtaaacccgtcggtacccgtacggttaccccaacggtcccccttacctacgtacttactaagttacggttaactaccttaccccgaaccggacgggtccctaaccggtcggacctaaccgtacccgaaggtaaccgtacggtttacgacggtacggaccgtacgggtccggggttcgtacggggactacgtacttcactcncacatcagcagtcgtgactcgtagtaacgttatttgacttagttagttacttacgtntacgacggtacgttaggttagtcggtaacgtccgtaacggtaccgggttaaccggttaccgggaaccgggtaacgggtaaaccgtaagggtaaccgtaaacgtaaccgtaaacggtacggtaggtacggtaccgtacggaccctacgttacgttccgttagttacctaccgttaccttccccgttaccctattacggtccg

SEQ ID NO: 244961 - DNA, 751 bp, Homo sapiens
  misc_feature: GYAE6OF01EMVO6.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctcgaggggaangcccacctctcctgcagggccagtcagaatgttaccaatggttctagcctggtaccagcaagaaacctggacctacggttccccagtccctcctacattctaagtggtaacttactccaccgtaggggccctacgtggaccaactcccgagtaaccgtagggtttaccagggttcggaccgtagggccggggttcgtacggggaactagggtaccctttcgaacgttccctaacacccgtagtaccacggtaccgaaggtaccgtaggggacgtaccgttaggtaaagttacgttttaggaccgttaagttacgtttaacgtttaccgttggttacgtaacggtaccgtaagtttaggttacgggtacgtccgttaacggaaccggggtttaaccggttcccgggtaaccgggaaacggggtaaccgtaaggggtaacggaaacgtaacgtaaaaccggtaacggttaggtacgggtaccgtaacggacccgtaaccgtacgtaccggttacgttacccttacgtaccttaccctttccccgcgttacgttcccgg

SEQ ID NO: 244962 - DNA, 754 bp, Homo sapiens
  misc_feature: GYAE6OF01B06D9.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaagggaangcccaccctctcctgcgagggccagtcaagtaatcgttaaccaacgtaggttcgtagtccgtggtaccagacaacgaaaccgtggaccctaggttccccacgtaccctcctactattaccgttagttaggtaacttaactaccccaccggaacgggcccctaagtcgggaccctaccgtacccgaaggtaccgtaagggttacgaggtcgggcgtacgggtccggttggtacggggactagtaccttccgacttcctaccacgtactacgacgtacgaggtactggtacgtcgtagtaagttacgttttacgacgttaaggttagttaacgtttaacgtcgttacgacgtacgtaagttagttagggttacgccgttacggaacggttaccggttaccggaccggtaaacgggtaaccgtaaacgggtaacggtaacgtaaaccgaaacggtaaccggttggtaccggtaccgtacggtaacccgtaacgtaccgttaccgttagttaccctttacgttaccgtttacccgtttaccccgtcccgttacgttacccgg

SEQ ID NO: 244963 - DNA, 817 bp, Homo sapiens
  misc_feature: GYAE6OF01BOPTI.5.59.F04.1.454.CMB.1.raw
  modified_base (208)..(208): a, c, t, g, unknown or other
  misc_feature (208)..(208): n is a, c, g, or t
  modified_base (509)..(509): a, c, t, g, unknown or other
  misc_feature (509)..(509): n is a, c, g, or t
tcagatcagacacgcacgaccggtgctcgatttagtacacacactttagggatttggggtgctcagttaggacccagagggaaccatggaaaccccagcgcagcttctcttcctcctgcttactctggcctcccagatgccaccggaaagctgtgttgacgcagtctcgaggccacccttgttctttagtcctaccgaaggggaaacncgcccaacccttcgtcctaggccgacgggcctaaggtccaaggtaaacttcggttaacccaaacgtcgggtttaccgtaacggtccccgttagggttaacccaggtaccgtaaaccggtaaaacccgttccgggacccgttaacggggtttccccctaacggtccccttaccgttacctacgttccgttaaggttcggtaacttaccttcccgaaaccggtacggggaccctaaccgttggaccctaacgtcccgaagtaccgtacgggttctaacggtcggacgtacgggtccggttcgngggaactacggttaccttccgaccttctaccacccgtagttaccgaacggcctaaacggtaccgttacgggtaaccttaccgtaaggtacgtttacgtttagtacccgtaagtttacgtactttacggtactacgtacggtacttacggtacgttacggtacgtaccgttacggacggttaccgtacggaacctaaggggtacgtaaggtacggaacttaaccggaaagtaccgttggtacggacgtcgaccgtctaacgtttccgatttccggttaactcttacccggtttccctcgtcgtttaccg

SEQ ID NO: 244964 - DNA, 689 bp, Homo sapiens
  misc_feature: GYAE6OF01EZH7M.5.59.F04.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (308)..(308): a, c, t, g, unknown or other
  misc_feature (308)..(308): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgcccaccggaaagctgtgttgacgcagtctccaggcaccctgtctttgctcgaggggaaancgccaccctntcctgcacgggccagtcagatgtaccaagtggttcagctggtaccngcacgaacctggccaggttcccagtccctcctcatctatggttaatactccaaccgngggccctaacgtggaccacccgtacgacgtaacgtcggttacgaggtccgacggtcgggtcgggtacggtacggactacgttacctcgtactccgtaccactacgtacgagacgtaacgtcggtacggtaccgttccgtaaggttaacgtttggtttaccgacgtttaaggttcgttttaaacgtcgtacgtacgtaacggtacgtaggttaggtacgtaccgtcgtaacggtaccgggttacgtaccggaacggtaaacggtaccgggtaaaggtacgtaaaccgtaaccggaaacgttcggttacggacggttaccgacctacggtacttcgtttcgttccttaccgtacttacccgtacccttccacgttcgtaccgg

SEQ ID NO: 244965 - DNA, 794 bp, Homo sapiens
  misc_feature: GYAE6OF01DCSYI.5.59.F04.1.454.CMB.1.raw
  modified_base (197)..(197): a, c, t, g, unknown or other
  misc_feature (197)..(197): n is a, c, g, or t
  modified_base (203)..(203): a, c, t, g, unknown or other
  misc_feature (203)..(203): n is a, c, g, or t
  modified_base (252)..(252): a, c, t, g, unknown or other
  misc_feature (252)..(252): n is a, c, g, or t
tcagatcagacacgcacgaccggtgctcgatttagtacacacacttagggattggggtgctcagttaggacccagagggaaccatggaaaccccagcgcagcttctctcctcctgctactctggctccagatgccaaccggaagactgtgtgacgcagtctcgaggccaccttgtctttacgctccgaaggggaacncgcccncctctctgcgacggccagtacagtaatcgttaaccaactggttcgtacnccgtggtaaccagaccaagtaaaccctcggtacccgtacggttacccacgtcccttccgtactacttccgtaagtggttaacttaccgtcccgtaaccgacgggtaccctacggttacggacctaaccgtacccgacggtaaccgtaacggtttacgacgggttcgggaccggtacgggtaccgggggttacggttaacggggaacctaacgggttacccttacctacgttaaccctacgaacccctagttaccgaacggtaacgtacggttaaccggacggtaaccgtacgttaagggtaacgtttacgttttagaaccgtttaagtttacgtttaacgttaccgttcgtaacgtggttaacgtaggtttacgtacggtacgtcgtaccggtaacggtaccggtaccgtacggaaaaacgggtcgtaaacggttaacgtaacgtaacgaaacgtacgtacggttacgacgtaccgaacctacggtctttaccgttacgttaccgttacctactttacccgttaccgttccgtaccttacgg

SEQ ID NO: 244966 - DNA, 731 bp, Homo sapiens
  misc_feature: GYAE6OF01CFZ99.5.59.F04.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (700)..(700): a, c, t, g, unknown or other
  misc_feature (700)..(700): n is a, c, g, or t
tcagatcagacacgcacgaccggtgctcgatttagtacacacacttagggagttgggggtgctcagttaggacccagagggaaccatggaaaccccagcgcagcttctcttcctcctgctactctggctccagagtgccaaccggaaagactgtgttgacgcagtctccaggcaccctgtctttgtctccgaggggaaancgccaccctntcctgcgagggccagtccaagtaatcgttaaccaataggttcgtacgccttgggaaccagtaccaagtaaaccgtggaccgtacggttcccaaggccctcctcattactaagtcggtaattaacgtcccacggacgggaccaccgtacggcctaactcccgagtaccgtagggttccagggtcggacgaacgggtcggggtacgtagggggaacctaacggtaccttacacccttctaaccgtaaccgtataccaacggtaccaagggtaccgtagggtacgtaccgtaaggtaaagttacgttttacgaacgttacggttgtttaaaacttaccggttacgtaccgaagtcggtaagttacgtagggtactaccggtacgggtaaccgggtacgggttacccggaaccgggtaaacggggaccctaaaggggtaacggaaactaacgaaaccggtaaacgtggtacgtcgacgtacaccgtattccgtntacttcgacttccgttacccgccgtgtaccg

SEQ ID NO: 244967 - DNA, 749 bp, Homo sapiens
  misc_feature: GYAE6OF01CBYYJ.5.59.F04.1.454.CMB.1.raw
  modified_base (511)..(511): a, c, t, g, unknown or other
  misc_feature (511)..(511): n is a, c, g, or t
  modified_base (740)..(740): a, c, t, g, unknown or other
  misc_feature (740)..(740): n is a, c, g, or t
tcagatcagacacgcacgaccggtgctcgatttagtacacacacttagggattggggtgctcagttaggacccaggagggaaccatggaaacccagcgcagcttctcttcctcctgctactctggcctccagatcgaccgaaccggaaagactgttgttagacgctacgtcctccgacggcctacccttgttctttcgtcctacggaagggggaaacgccgccctaccctctccgtggccgacgggcctaggtacaagtaacgttaccgttaaaccgaacgtacgggttacgtacgtccgttacggtaaccaggaccaacggtaaacccgtcggacccgtaccgggttcccacgttccctccgtactacttcgttagtacggttactaccgtacccgaaccggtacgggtcccaacgtcggacctaccgtaccgaacggtacgtacggttcgtacggtcggacgacgggtcgggtcgtaacgggactaacggttccttcacctctaccacncgtacgatcgacgtacgtagggacgtacgtaagtacgtttcttagacgttattacgttacgttacgtacgtacgacgttacgtagttacggtacgtacgtaccgtacggtaccggtaccggtacggaaccgggttaagaccggtaaagggtactaagtaaccgtaaaggcgttcggaggtcctacggaccacgttcgttcccttagttacctcgacctttcgtacccgnttagtccgg

SEQ ID NO: 244968 - DNA, 750 bp, Homo sapiens
  misc_feature: GYAE6OF01DYRPQ.5.59.F04.1.454.CMB.1.raw
tcagatcagacacgcacgaccggtgctcgatttagtacacacacttagggattggggtgctcagttaggacccagagggaaccatggaaacccagcgcagcttctccttcctcctgctactctggcctccagatcgaccgaaccggaaagactgtgttgacgcacgtcctccgaggcctaccgttgttctttgtccgtaccggaaaggggaaacaccgaccctacccttctccgtgaccggacggaccagtacgaagtaactaccgttaacctaaggtacggttacgtacgtccgtacggtaaccacggacctaaacgaaccgtcggaccgtaccggttcccacgtcccgttacctacgtacgttacgtaagttacgtaacttacccgtacccgaccggtacggtcctaacgcggtacctaccgaccgtagtacgtacggtcgaggcggtacgcgggtcggtacgaggtaactacgttacctaccgtccgtacctaccgaactacgacgaacgcgtaaggtcgtagacgtacgtagttagtatttcggactttagtagttacgttccagtactagtacgttagtacggtgtacctggaaccggttacgtaccggtacggaacggtaaccgggagttaaacggaacgtaaacgtacgaacggtacggttaggtacgaccgtaccgtacgaacgttccgttacgtcccgtttactaccgttaccctttacccggacccttgtacgttacggg

SEQ ID NO: 244969 - DNA, 731 bp, Homo sapiens
  misc_feature: GYAE6OF01C2URJ.5.59.F04.1.454.CMB.1.raw
  modified_base (199)..(199): a, c, t, g, unknown or other
  misc_feature (199)..(199): n is a, c, g, or t
  modified_base (281)..(281): a, c, t, g, unknown or other
  misc_feature (281)..(281): n is a, c, g, or t
tcagatcagacacgcacgaccggtgctcgatttagtacacacacttagggattggggtgctcagttaggacccagagggaaccatggaacccagcgcagcttctcttctctgctactctggctccagatcgccgaaccggaagtacttgtgttgaccgcagtctccgaggcctaccctgtctttgctacgaaggggaanacgcccaccctctccgtgaccgacgggtccaggtcaagtacttacggttaaccaaacgtggtttcgacgtccttaggaaccnggacaaagaaacccgtggccctacggttcccacgtccctcctcattcctaatcgtatactacccgaccgagggtcccagtcggactactaccgagtactaggttcaaggtcgggacacgggtccggttacgacgggactacggtacctttccgacttccgactaccgagtccgaagctaacggacgtcggaacgtcgtaggtaattacgtttcgacgttaggttacgttaacttcgttacgtaccgtaggtagtacggttacgttacggtaacgccgtttacggaaccggttaccgggttcccggaaacgggtaacgggaacggtaagggttaacggtaacgtaacccggaaaaccggttaacgtgggtaccggtcgtaccggaccttaccttagtacccgtttgttaccttacccggtacttacccggtcccctacgttcgttacccgg

SEQ ID NO: 244970 - DNA, 791 bp, Homo sapiens
  misc_feature: GYAE6OF01CDUYH.5.59.F04.1.454.CMB.1.raw
  modified_base (736)..(736): a, c, t, g, unknown or other
  misc_feature (736)..(736): n is a, c, g, or t
tcagatcagacacgcacgaccggtgctcgatttagtacacacacttagggattgggggtgctcagttaggacccagagggaaccatggaaaccccagcgcagcttctcttcctcctgctactctggcctcccagatcgccaaccggaaagactggtgttgaccgcacgtctccaggccacccttgttctttcgtcctccggaagggggaaacgacgccctaccctcctcctggccgacgggtccagtacacgtaattacgtaaccaacgtacggttcgtacgtccgtagggtaccagacgaacgtaaacccgtggcccgtacggttaccccacgtcccttccgtcacttacgtacgttaggtaactacctacccgaccggtacggaccctacggtcggacctaccgtacccctaaggtaccgtacgggttaccgaggttcgggaccgtacggggtcggtgtaccggggactaggtaccctctaacgtcctaccacctactaccgaagccacggtaccgtacggtacgtcgttaaggtaacgtttaagtttcgaacgttaaggtttcgtttaacttacggtagttaccgtacgtaccggttaagttacggttaggtaaccgtcggtaccggttacggtaaccgggttacccggaaccgggtaacgggaacgtaagggtaacgtaaaccgaaccgtaacgggtacggttggaccgggtacgttaccgactaacccgtntttacccggttccttacgttactaccccggttaccttaccccgtcgtacgttccg

SEQ ID NO: 244971 - DNA, 685 bp, Homo sapiens
  misc_feature: GYAE6OF01CLZ0R.5.59.F04.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (288)..(288): a, c, t, g, unknown or other
  misc_feature (288)..(288): n is a, c, g, or t
  modified_base (357)..(357): a, c, t, g, unknown or other
  misc_feature (357)..(357): n is a, c, g, or t
  modified_base (384)..(384): a, c, t, g, unknown or other
  misc_feature (384)..(384): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaanacgcccaccctctcctgcagggccagtcagatgttaccaanaggttcagcctaggtaccagcaagaacctggacctaggttcccagcctcncatctatggtatactccacgagggccacgtggcacgtcccagactaggttcagtcggcaggtcgggtcngggacacgtacgttcactctaccactntacagctaggactggacgtccgtagaagttagttttcgacttaggttagttaactttaccgttagtacgtacggtactaaggttagttacgggttacgtaccgttacggtaaccgggtaccggtttaccgggaacccggtaaacggggtaacccggtaaacggggttaacggaaacgttaaacgaaaaccggtaaaccgttaggttacgggtacggtaccgtaacgtaacctaacgttacccgttacggtttacctttaccttaaccttccccgtttacccccgtccgtaaacgttcccgg

SEQ ID NO: 244972 - DNA, 782 bp, Homo sapiens
  misc_feature: GYAE6OF01AS8EK.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgcctactctggctcccagatgccaccggaaagactgtgttgacgcagtctccaggcaccctgtctttgtctcgaggggaaagcgccaccctctcctgcgacgggccagtcaagtaatcgttaaccaacgtacggttacgtagtccgttaggtaccagaccaagaaccgtcggccacggttcccagccctcctcatctagtggtatacgtccaccgtacgggccctacgtcggacctaccgtacccgaaggtaccgtacggttacgacgggtcggccgtacggtccgggggtaccgttaggggaacctaacggtacccgttcctaccgtcctacccgaaccctagtaccgtagaccgtacgtaacggtacgggtacgtcccgtaaggttaacgttacgttttggaccttagttaagtttacttaccgtgtactacgtacgtagttacggtagtacgtacgttaccggaccgggttacggttaccgggaccggtaacgggtaaccgtaaaggggtaacggtaaacgtaacccggtaaaaccggttacggttacgggtaccggtacgtacgggtaacccgtaacgttaccgttacccgtttccgttacccgttttaccgtaccccgttttacccccgttacccccgtcccgtttacccgtttaacccggg

SEQ ID NO: 244973 - DNA, 751 bp, Homo sapiens
  misc_feature: GYAE6OF01APMYH.5.59.F04.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagactgtgttgacgcagtctccaggcacctgtctttgctccgaggggaaangccacctntcctgcagggccagtcagaatgttaccaacaggttctagcctggtaccagcaagaacctggcctaggttcccagcctcctcatctatggtatactccaccgacggccactggctagtcccagacctaggtttccaggttcggacgtaacggtcggggtactacggggaactacggtactttccgaccgttaccgtacaaccccgtaagttccgaacggaccgtaacggtaccggttaggggaaccgtacccgttaaggtaaacgttacgtttttacgacgttaacggtttacgtttaacgtttaaccgtcgggttacctaacggtactaacggttaacgttacggggttaacgtaccgttaccgtaaccgggttacggtttaccgggaacccggtaaacggggtaacccgtaaagggttaacggaaaacgttaacgtaaaaccggtaacgttacggtacgggtaccgtaacggtaccctaacccgtagttaccgtttacgttcccgtttaacgtacgttacccgttaccccgtaccttacgttacccgg

SEQ ID NO: 244974 - DNA, 775 bp, Homo sapiens
  misc_feature: GYAE6OF01AJ6XO.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgtctcgaggggaaagcgccaccctctcctgcgacgggccagtacaaggtaacttcggttaacccaacgtaggttccgtacgtcccgtcgggtaacccaggaccaacgaaacccgtcggacccgtaacggttccccacggtccctccctctacttaccgttagtaggttacttacctccccgaaccggacgggccctaccgtggacctaacgtccccgaaggtaccgtacgggttcgaaggtcgggaccgacgggtccgggggttacgtacgggggaactacgtaccgttactacccgttccgtacctaacccgtactacgacggaccgtacgtacgtacgggacgtaccgtaaggtaacgtttagtttcggacgttagttacgttacgttacgttacgtactacgtagttaggtacgttacgggtacgttcgtaacgtagggttaccggtacggtaccgggtaaccgggtaaacgggtacggtaaacgggtaacgtaaaccgtaacggtaaacgtaacggtcggtaccggtcgtacgacctacttacgttccgttagttcccgttacctaccgtttccccgtcccgtccttacgg

SEQ ID NO: 244975 - DNA, 816 bp, Homo sapiens
  misc_feature: GYAE6OF01BTW9K.5.59.F04.1.454.CMB.1.raw
  modified_base (192)..(192): a, c, t, g, unknown or other
  misc_feature (192)..(192): n is a, c, g, or t
  modified_base (233)..(233): a, c, t, g, unknown or other
  misc_feature (233)..(233): n is a, c, g, or t
tcagatcagacacgcacgaccggtgctcgatttagtacacacacttagggattggggtgctcagttaggacccagagggaaccatggaaaccccagcgcagcttctcttcctctgctactctggctcccagatgccaccggaaagactgtgttgacgcagtctccagcaccctgtctttgtctcgagggaangccacctctctgcaggccagtcagactgtacacgtgtcgtnctgtacagacaagaaccgtggacctacggttcccacgtccctccgtactaattcgtaacgttcggtaattaccgtaccccaaaccggtaccgggtcccaacgttcgggtaacctacccttaccccgaagggtaaccgttaacggttcgaaacgggtggtacccgtaacgggttccggggttaaccggtacggggaaaccacggtttaccccgtttacgtaccccttaccgtaacccacccgtaaacgtaccgaacgtaccgtaaacggtacgttacgggaccgtacgtaacggtaacgtttacgtttaggcttaaggttacgttaacgttacgttcgtacgtaaggtccgtaaggttcggtacggttacgtccgttaccgggtaaccggttacccgggttaacccgggaaaccgggtaacggggtaaaaccgtaacggggtaaacggtaaaccgtaaaccggtaaaaccggtacgttacggtaaccggttacgtaccgtaaccgttaaaccgtccgtttaccggttacgttacccgttaccttaccccggttaaccccttcccggtaccttcggttacccggg

SEQ ID NO: 244976 - DNA, 870 bp, Homo sapiens
  misc_feature: GYAE6OF01BNYXN.5.59.F04.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctccaggcaccctgtctttgtcctccgagggggaaancgcctacccttctcctggcgacgggccagtcaagtaacttcgttaaccaacgtagggtttcgtacgtccgttgggtaacccagacctaacggaaacccgttgggaccctaacgggtttccccacgtccccttacctacgtacgttctaaggttcggtaacttacctcccgaaccggaaggggtcccctaacgtcgggacctaccgtaccccgaaggtacgtacgggtttccgaagggttcggcggtaacgggtcggggtacgtagggacctaacggtaccttccaccgttcctacctaacccgttatacccggaagcccgtaagggtacgtacgggaccgtaccgttaacggtaacggtttacgttttacgggtaccgttaaggtttacggttaacgtttaccgttaggtaaccgtaaggtaccgttaggttaacggttacgggttaacgtacccggttacgggtaccgggttaaccggggtttcccgggaacccgggttaaacgggggaaccggttaaacgggtaaacgggttaaaaccgtaaccggtaaaacggtaccgggtttaggtaccgggttacgtaaccggtccgtaaacccgttcgttaccgttaccgtttaccgtttaccgttacccgtttaccccgtttccccgtaccttaacggtccgg

SEQ ID NO: 244977 - DNA, 678 bp, Homo sapiens
  misc_feature: GYAE6OF01BG3V4.5.59.F04.1.454.CMB.1.raw
  modified_base (214)..(214): a, c, t, g, unknown or other
  misc_feature (214)..(214): n is a, c, g, or t
  modified_base (325)..(325): a, c, t, g, unknown or other
  misc_feature (325)..(325): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccgaggccacctgttctttgtctccgaggggaagacgcccaccctctccngcgagggcagtcaagatcgtaaccagtaggttcgacgccgtacggtaccaggacaacgtaaccgtggacctacggttcccacgtccctcctcattcgtagtcgtacttacnccgaccgacggaccacgtcggacaccgtacccgaggacctaggttacgagtcggcgacgggtcgggtcgacggggactacggtaccttcacctcgtccactactacgacgacacggtactagggactccgtagtacgttagttacgagtagttactagttacgtacgtacgaacgtacgtataggtaggtccgtacgtacgtaacggttaccggtaccggaccgggtaaacgggtaccgtaaacggtacggaactaacggaaacggtacgtacggtacgtacgaccgtacaccgtaacgttcttaccgttacttacttacccgttaccccgtcccggtacctaccgttaccgg

SEQ ID NO: 244978 - DNA, 835 bp, Homo sapiens
  misc_feature: GYAE6OF01DMNMT.5.59.F04.1.454.CMB.1.raw
  modified_base (206)..(206): a, c, t, g, unknown or other
  misc_feature (206)..(206): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaaccggaaagactgtgttgacgcagtcctccaggccacccttgttctttcgtcctccggaaggggaaacncgaccctaccctctcctggcgacgggccagtcaagtatacgttaaccaacgtaggttccgtacgccgttacgggtaacccaggacctaaacggtaaaacccgtcgggtacccgtaaccgggtttccccgaacgtaccccttccctactaacttactaacggttacggtaaacttacctacccgtaaccgacggggccctaacgtcggacctacgtacccgaaggtaccgtaggttaccgtaggtcggcgtacgggtcgggtacgtacgggactacgtaccttcaccgttctccaactactcgagaccgaagtacgtacggacgtcgtaaggtaacgtttacgtttcgacgttagtttacgttaattacgtacgtacggtacgtacgtaagtttacggtaacgggttctccgtttaaccgggtaacccgggttaccggtttacccgggaaaccgggtaaaccggggtaaccggtaaaggggttaaacggaaaacgttaacccgggtaaaaagtaccgggttacgggtacggtaccggttacgaacccggtacttaaccggtttccttaacccgggtttacttaacccggttacgtttaccccttcccggtttaccccgtagttaccccgg

SEQ ID NO: 244979 - DNA, 772 bp, Homo sapiens
  misc_feature: GYAE6OF01CUQ71.5.59.F04.1.454.CMB.1.raw
  modified_base (98)..(98): a, c, t, g, unknown or other
  misc_feature (98)..(98): n is a, c, g, or t
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
tcagatcagacacgcacgaccggtgctcgatttagtacacacacttaggggattgggggtgctcagttaggacccaggagggaaccatggaaaccccngcgcagcttctcttcctcctgctactctggcctcccagatcgaccgaaccggaaagctgtgtgacgcagtctccgaggcctacctgtctttgctaccgaaggggaacncgcccacctctccngccgagggccagtcaaggtatacgtaaccaagtaggttcgtacgccgttaggaccagacgaacgaaaccgtcggacctacggttacccacgtcccctacctactacttacttaacgtggttaactactaccccgaaccggtacgggacctacgtcggacctaaacgtcccgaagtaaccgtacggttacgacggtcggacgtagggtccggggttacgtacgggggaaactcggtaccttacaacttccctaccgaacgtactaccggaagtacgaacgtaccggtaggacctaccggtagtaaagtttcgtttacggattaaggttacgttaaattccggtcgtaacgtaagtacgttaaggtacggttcgtaacggtacccttaggggtaaccccggtacgggttacccgggaacggggaaaaccggtaccggggttaaaaggttaaccggaaagtttaaccggaaaacggtaacggttggaccggtacgtacccgacgtaacctcggtaactacggttctaacgtcgttacccctacggactaggtacc

SEQ ID NO: 244980 - DNA, 824 bp, Homo sapiens
  misc_feature: GYAE6OF01CGS3C.5.59.F04.1.454.CMB.1.raw
  modified_base (209)..(209): a, c, t, g, unknown or other
  misc_feature (209)..(209): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaagactgtgttgacgcagtcctccgaggctacccttgttcctttgtcctaccgaaggggaaacncgccctaccctctccgtgccgacgggccagtacaagtaacttacgttaaccaacgtacgggttccgtacgtccgtacggtaaccagtaccgaaacgtaaacccgttcgggaccctaccgggttaccccaacgtccccttccgtactacgttaccgttagtacggttaactaccgtaccccgaaccggtacgggccctaacggtcggaccctaacctacccgaagtaccgtacggttaccgagggtacggccgtacgggtccggggttacgacggggtaactacggttacccttcgaaccgttccacccgaactacgtcgaacggtacacggtacgtgggacctcgtaaggtaacgttcgtttacgacgttagttacgttaacttacgtgtacgtacgtagttaagtacggttcggtaaccgtaccgtacgggtaaccgggtacggttaacccgggaacgggtaaccgggtaaccgtaaaggggttaacgaaacgtaaacccggtaacggttacggtacgggtacggtaccgtaacggtaccctaaacctggtttaccctacgttttacccgtaccgttaccctttaccccggttacccgtccttaggttacccgg

SEQ ID NO: 244981 - DNA, 699 bp, Homo sapiens
  misc_feature: GYAE6OF01EW7XC.5.59.F04.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (240)..(240): a, c, t, g, unknown or other
  misc_feature (240)..(240): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgtctttgcctcgaaggggaaancgccaccctntcctgcaggccagtcagtatcgttaccaacgnggttcgagcctaggaccagacaagaacctggaccctaggttcccagtccctcctcgattcgtaagtgtaactctccacgacggccacgtggctactcccaagtacctagggtttcaggttcggactacgggtccgggtcgtacggggacacggtaccttacgaaccttccgtaccaaccgtactacgtaggactaaggtaccgtacggtacgtaccgtacgtaacgttagtttacgtacgtagttagttacgtttacgtacgtacgtacgtacgtagtagtagtacgtacgtcgtacggtacggtacggtaccggtaacggtaaccggtaaggtaacggtaaacgtaacgtaaacgtaacggttacggtacggtacgtacgtacgtaccgtaacgttacgttacgttaccgttaccttacgcccgttttttttttttaccccgccgttacgttacccgg

SEQ ID NO: 244982 - DNA, 834 bp, Homo sapiens
  misc_feature: GYAE6OF01DPI9O.5.59.F04.1.454.CMB.1.raw
  modified_base (204)..(204): a, c, t, g, unknown or other
  misc_feature (204)..(204): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatcgccaaccggaaagacttggtgttgacgcagtctcgaggccacccttgtctttgtctccgaaggggaanacgccctaccctctccgtaggccgacgggccagtcaagtaacttacgttaaccaacgtagggtttaccgtacgcccgttacggtaaccaaggcctaaaaggaaaccccgttgggaaccccgtaccgggtttaccccaacggttcccccttacctactaacgttaccgttaagttacggttacttaaccgtacccccgaaaccggaccggggtaccctacggtggacctacccgtaccgagtaccgtacggttacaggtacggacgtacggtccggggtacgtacggggaacctagtacccttccgacctccgtaccaaccgtagtacgacggtaacacggtaccgtagggtaccgaccgtaaggttaagtttgtttacgacgttagttacgttacttacgtacgtaccggtaagtaccgttagttaaggtacgttacgtctaacgggaccgggttaaccggttccgggaaacggtaaccgggtaaacggtaacgggttaacgggtaaacgtaaaccggaaacggttacgtttacggggaccgtacgttaccggaaccttacctacggtttaccgttacggtttaaccttacccgttaacttccccggttaaccctccgttacggttaccg

SEQ ID NO: 244983 - DNA, 1002 bp, Homo sapiens
  misc_feature: GYAE6OF01DYVVB.5.59.F04.1.454.CMB.1.raw
  modified_base (135)..(135): a, c, t, g, unknown or other
  misc_feature (135)..(135): n is a, c, g, or t
tcagatcagacacgcacgaccggtgctcgatttagtacacacacttagggattggggtgctcagttaggacccagagggaaccatggaaaccccagcgcagcttctcttcctcctgctactctcggcctcccagntcgccgaaccggaaatcgttgtgttgaccgctagtcctccgacggacctaccgttgtttctttcgtccgtaccgggaaggggaaacgtaccgtcccctacccttcgttccgtcggccggaacgggcctaaggtaccgaaggtaaacctttacggttaaaaccctaacggtaaccgggttccggtaaccggttaccgtaaccgggtaacccacggtaaccgtaaacggtaaacccgttcgggtacccggttaccggttaccccgaaccggtccccctttaccgttacctaacgtttacgttaacggtttaccggtttaaacttaacccgtccccggaaccgggtacccggtacccgtaacggtacggaccctaccggtaaccccgtaagggtaaccggttacgttaacgggtacggtacgggacgtaccggggtaccggttccggtaacgggtaaacgtaccgttaacccgttaccgaacctttacctaacccgccgttaaacgtaccgaaaccgtaccggtaacggtaccgggtagggtaaccgtcgggttaaataacggttttaacggtttacgtaaacgggttacgtttaagtttaacggtttccgttaacggtacgtaacggtacggttaacggtttacgtaccgggttaacggtaccggtaaccggggttacgggttaaccggttaccgggaaccgggttaaaacggggtaaccgtaacggggttaaaacggtaaccgtaaccgggtaaacggttacggttaccgggtacgttcccggtaactaacccggtagtttaccgttcgttaacccgtttctaaccccgtttccttaaccccggtcccgttacgtcccgttaaccggg

SEQ ID NO: 244984 - DNA, 778 bp, Homo sapiens
  misc_feature: GYAE6OF01CIOP2.5.59.F04.1.454.CMB.1.raw
  modified_base (204)..(204): a, c, t, g, unknown or other
  misc_feature (204)..(204): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccgaggccaccctgttctttgtcgtccgaaggggaaagngcccaccctctcctggcgacgggccagtcgaagtaagttcgttaaccaacgtaggttacgtacgccgttacgggtaccagaccgaagaaaccgtcggacctacggttaccccacgtcccttacctacacttcgttagtggtacttactacccgaaccggtacgggcccacgtcggaccctacctacccgtaacggtaccgtagggtttaccgaggttacgggaccggtacgggtcgggggttacgtacggggacctaacggtaccttctaccgttccgtaccgacctagtaccacgtacgtaacgtacgtacggacggtaccgttaaggttaacgtttagttttacggaacgttaggttacttaacgtttcggtacgtcgtacgtacgtacggtttaaggttcggtactaccgggtaaccgtaccggggttaccggttccgggtaacggtaacgggtaaaccggtaagggttaacggaaacgtaacccggtaaagtaacgttcggacggtcgtacgacccgtacgtacttcgtacgttccttacgtaccctttaccttacccggcttacgtccg

SEQ ID NO: 244985 - DNA, 838 bp, Homo sapiens
  misc_feature: GYAE6OF01DERRX.5.59.F04.1.454.CMB.1.raw
  modified_base (148)..(148): a, c, t, g, unknown or other
  misc_feature (148)..(148): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaanacttgtgttgacgcagtcctccgaggcctacccttgttctttgtccgtaccggaaggggaaacgcgcccacccttctccgtggcgacgggccagtacaagtaattcgtaaccaacgtacggttcgacgtccgtagtaccagacaaacgaaccgtcggaccgtaccggtaccacgtcctacctactacttctagtcgtactactacccgacgacggcctacgtacgactacctaccgaagacgttacggtcgacggtcgcggtaacggtcggggtacgtacgggaaccgtacgtacccttcgtaaccgttccgaacctaacccgtacgtaccggaacgtaccgtaaacggtacggtaacgggtaccgttaaccgttaaggttaacggttttaacgtttacggaacgtttacgggtttaacgtttaacgtttaccggttaacggttacggtaaccgttaacggttacgtttaacgggttacggtaacgtcccgggttaacccggggttaacggttaacccgggttaaccgggaacccgggtaaaaccggggtaaccgttaagggtaaaacggtaaccgtaaaccggtaaaaccggttgggtacgggtaaccggtacgtacgtaacccgttaacgtcgtttaccgtcgtttacccttacgttacccttacccgtccctaagttaccgttcggg

SEQ ID NO: 244986 - DNA, 785 bp, Homo sapiens
  misc_feature: GYAE6OF01B2PRU.5.59.F04.1.454.CMB.1.raw
  modified_base (209)..(209): a, c, t, g, unknown or other
  misc_feature (209)..(209): n is a, c, g, or t
  modified_base (568)..(568): a, c, t, g, unknown or other
  misc_feature (568)..(568): n is a, c, g, or t
  modified_base (616)..(616): a, c, t, g, unknown or other
  misc_feature (616)..(616): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgctagtctccgaggcctacccttgttctttgtcctaccggaaagggggaaacncgccctacccgtctacctgaccgacgggccagtacagtaacttacgttaaccaacgtcgggttccgtacgccgtacggtaccgagaccaacggtaaaccgtcggtaccgtacggttccccacgtcccttacctacgacttccgttaagttcggtaacttaccgtcccgaaccggtacgggtccctacgttcggacctaccgtacccgtaacgtacgtacgggttccgaggtaccggtacgacggggtccgggttacgtacggggaactacggttacccttaccacccttacgtaccacccgtataccgacggtacgaacgtacggtacggacgtacggtagtaacggttactttaccgngttaagttgtttaacgttcgtacgtatacggacttagtggtacgtacnccgtacggtacggtacggttaccggaacgggtaacggacgtaaagggtacgtaacgtaaaccggtaacgtagttccgggtaagtccgtacggaccccgtacgttaggttaccgttcggttacccttaccggttacccctttcccggtaaccctccgttaggtaccccgg

SEQ ID NO: 244987 - DNA, 822 bp, Homo sapiens
  misc_feature: GYAE6OF01AFX5P.5.59.F04.1.454.CMB.1.raw
  modified_base (191)..(191): a, c, t, g, unknown or other
  misc_feature (191)..(191): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccacggaatctgtgttgacgcagtctccagccaccctgtctttgtctcgagggaancgcccaccctctcctgcgagggccagtcagtaatcgttaaccaacgaggttcgtagccctggtaccagcaagaaaccctggaccgtacggttcccagtccctcctcatctagtggtactacgcccaccgagggcccacgtcggacctaccacccgagacgtacgggttcacggtcggacgacgggtccgggttacggtaggggacctacggtacccttacgacccgttcctaaccaaccctattaccggaagacccgtaaggtaccgttaccggggtaacgtacccgttaagggtaaacggttttgttttaccgggaaccgttaggggtttaacgtttaacgttttaaccgggtacggttaaccgtaaaggggtaccgttaaacggttttacggtaacgggggtttaaccgtcccggtttaacccggggaaccggggttttaacccgggttaccccgggggaaacccgggtaaaccgggggttaaacccggtaaaggggtttaaccggaaaacttaacccgtaaaaccggggtacttcggggtacgtacccgtagtaccccgtacgtagtttacccggtactttcccgttacctacccgtttcccccggtccctaaccgttagttacccgg

SEQ ID NO: 244988 - DNA, 771 bp, Homo sapiens
  misc_feature: GYAE6OF01DATNG.5.59.F04.1.454.CMB.1.raw
  modified_base (167)..(167): a, c, t, g, unknown or other
  misc_feature (167)..(167): n is a, c, g, or t
  modified_base (204)..(204): a, c, t, g, unknown or other
  misc_feature (204)..(204): n is a, c, g, or t
  modified_base (758)..(758): a, c, t, g, unknown or other
  misc_feature (758)..(758): n is a, c, g, or t
tcagatcagacacgcacgaccggtgctcgatttagtacacacacttagggattggggtgctcagttaggacccagagggaaccatcggaaacccagcgcagcttctcttcctctgctactctggcctccagatcgccaaccggaaagacttgtgttgacgcagtccnccgaggccaccttgttctttcgctccgaaggggaaancgcccaccctctcgtgcgacggccagtacaagtacttacgttaaccaacgtagggttccgtacgccgttacggaccagaccgaaagtaaccgtcggacctacggttcccacgtccctcctatatcgttatggttaactaccaccccgaacgtaccgggacctaccggtacggaccctaacctacccggaaacgtaacggttaagggtttacccgcgggttacgggcccggtaagggtccgggggttacggtacggggaaactacggttactttaccgtaaccgttcctaacccgaactaactcgaacgttaccgaaggtacgtcgggaacttaccgtaagttaagttaagtttcgaacgttgttaaggttacttacgttgacgtagtacgttagtaggtcgtaacgtctaccgggaaccgttacgggtacgaaaccggggtaacggaaccggtaacggttaaaggaacgtaaccgaaactacgggttggtaccgacgttaaccgacgacttacgttcccgtaattccgttaccgtaaccttcccggttaccccngttacgtacccgg

SEQ ID NO: 244989 - DNA, 845 bp, Homo sapiens
  misc_feature: GYAE6OF01AC2SM.5.59.F04.1.454.CMB.1.raw
  modified_base (193)..(193): a, c, t, g, unknown or other
  misc_feature (193)..(193): n is a, c, g, or t
tcagatcagacacgcacgaccggtgctcgatttagtacacacacttagggattggggtgctcagttaggacccagagggaaccatggaaaccccagcgcagcttctcttcctcctgctactctgctccagatgccacggaaagtctgtgttgacgcagtctccgagccaccctgtcttgcctcgaagggaacncgcccaccttctccgtgacgcggccagtcaagtatcgtaccagtgttcgacgtctggtaccagacgaacgtaacccgtcggcctacggttcccacgtccctcctactacgttctacgttacggtactaccgtacccgaccggaccgggtccctacgtcggtacctaacccgttaccggaacgtaaccggttacgggttaacgacggttcggggaaccgtcggggtacccggggttacgttagggggaaaccctaaccggtttaccgttacccgtaaacccctttccgaaccgtaaccccgtttaaccgaaccggtcttaaaccgggaaccggtaaccggtaccgggttaaccgtaccccggttaagttaaacgggtttctttaaccggtaacgttaacggtttacggtttaaacgtttccggttacgtaaccggtaacgtaacggttaacgttacggtaaccgggttacgtcccgttaacgggtaccggttaccggtaaaccgggaaccggggttaaaccggaacgggttaacgggtaacgtaaccgtaacgtaaccggtagtaccggtaggtacccgtacgacccgttactcgtttaccgttccttaccgtacccttaaccgttccccgtaccgtcccgttacggttaccg

SEQ ID NO: 244990 - DNA, 791 bp, Homo sapiens
  misc_feature: GYAE6OF01EQ5U9.5.59.F04.1.454.CMB.1.raw
  modified_base (542)..(542): a, c, t, g, unknown or other
  misc_feature (542)..(542): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactggtgttgacgcagtcctccgaggccacccttgttcttttcgtcctccggaagggggtaaacgacggtccctacccttctcctggacgacggggccagtacaaggaacttacgttaaccaacgtaggttccgtagccgtacgggtaaccagacgaacgtaaaccgtcggaccgtacggttcccaacgtccctaccgtactacttactaacgttacggtaactaccgtaccccgaaccggacgggtacccaacgttcgggacctaacctacccgaaggtaccgtaacggtttcacggtcggacggtacgggtccgggtacgtacgggacacgtaccttcgactcctacacctagtaccaggactaacggcgtacggacgtacgtaggtaacgttntttacgacgttaacgttgttaactttacgtgtacgtaacgtacgttaggttacgtggttacgtccgttaccgggacggttaccgggtaaccggaacccgggtaacgggtaaccgtaaacgggtagtaaaccggtaacgaaacggttaccggtacggtacgggtccctaagggtaccctaccgttaacgtcccgtttaagttacccgttaccttacccgtttacccgttacccgtaccttgttacccggg

SEQ ID NO: 244991 - DNA, 852 bp, Homo sapiens
  misc_feature: GYAE6OF01D3KIV.5.59.F04.1.454.CMB.1.raw
  modified_base (196)..(196): a, c, t, g, unknown or other
  misc_feature (196)..(196): n is a, c, g, or t
  modified_base (811)..(811): a, c, t, g, unknown or other
  misc_feature (811)..(811): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagactgtgttgacgcagtcctcgaggcaccctgttcttgtctccgaagggaanacgccaccgtctcctgcgacgggccagtcaaggtaattacgtaaccaacgtacggttcgtacgtccgtaggtaccagaccgtaagaaacccgttcggaccgtacggtttacccacgtcccttaccgtactattccgttaagttcggttaacttaacctaccccgtaaaccggacggggtacccctaacggttcgggaaccctaaccgtacccgtaacggaaccgtttacgggttacgaagggttccgggaccggtaacgggtcccgggggttacgtaacggggtaaccgtaaacggttaccctttaccgacccgtttacgacccctaaacccgacgttacccaaaggtaccctaaacgggtaaccgtaggggtaacccgtaacggttaaggttaaacggtttcgttttaacgggaaccgtttaggtttaacgtttaacgttacctttacgggtacctacggtaacgttaaggtttacggttaccgggtacgtaccgtacggtaaccggggtaccgttacccgggaacggtaaacgggtaacggtaaggttaacggaactaaccggtaaaaccgtcggttcgtacggtaactaccgacccgtaactgttaccgttnttaccgttactaccctcccgtttaaccccgcttagtcccgg

SEQ ID NO: 244992 - DNA, 750 bp, Homo sapiens
  misc_feature: GYAE6OF01CYKYL.5.59.F04.1.454.CMB.1.raw
  modified_base (548)..(548): a, c, t, g, unknown or other
  misc_feature (548)..(548): n is a, c, g, or t
  modified_base (734)..(734): a, c, t, g, unknown or other
  misc_feature (734)..(734): n is a, c, g, or t
tcagatcagacacgcacgaccggtgctcgatttagtacacacacttagggattgggggtgctcagttaggacccagagggaaccatggaaacccagcgcagcttctcttcctcctgctactctggcctcccagatcgccaaccggaaagactgtgttgacgcagtcctccgaaggcctacccttgtttcttttcgtccgtaccggaaagggggtaaacgacgaccctaccccttcctacccgtgaccgacgggacctagtaccgaagtaacgttacgtttaaccgaacgttacggttacgtacggtccgtacggtaccagacgaaacgaaccgtcggaccgtacggtaccaccgtcccttcctacacttcttagtagtactacgtaccgaccgacgggaccacgtggaccctactaccggtacgaaccgttcggttaccgaggtacggcggcgggtccgggtcgtaacgggactacgtaccttcgtaccttcctacacctctacgacgacctaggacgtggacgtacgtaggtaacgtttagttacgngtaggttactttacgtacgttcgacgtaagtacgtagttggttacgtacggttaccgacgttaccgggttacggtaccggaacgggtaacgggtaacgaacggtaacggtaacgaaaccggtacgtaaacgtgggtacgaccgtacgcgtaaccgttcgttcgttacgttccgtactccttacccncccgtattaccgttcg

SEQ ID NO: 244993 - DNA, 842 bp, Homo sapiens
  misc_feature: GYAE6OF01CGCCY.5.59.F04.1.454.CMB.1.raw
  modified_base (192)..(192): a, c, t, g, unknown or other
  misc_feature (192)..(192): n is a, c, g, or t
tcagatcagacacgcacgaccggtgctcgatttagtacacacacttagggattggggtgctcagttaggacccaggagggaaccatggaaaccccagcgcagcttctcttcctcctgctactctggctccagatcgccaacggaaagctgtgttgacgcagtctcgaggcacctgtcttgctcgaagggaancgcctacccgtctaccgtgacgacgggaccaggtacaagtacttacggttaaccaacgtacggggttacgtacgtaccgtaggtaacccaggaccaaaggtaacccgtcggacccgtacggttacccacgtaccctacctacgtacttacgtagtggtaactaactcccgaaccggacgggaccctaggttacggactaccgtcccgaaggacgttacgggttcaagggttcggaccgtacgggtccggggtacgtacggggaaacctacggtaacctttcgaaccgttcctacctaaccgattacccgaggaacctaggtacggtacgggtactaccggttaaggttaacggttacgttttaacgggacttaacggttaacgttaacgttaccgttgtaacgtacgttaaccgttaggtacggtttacggtacgtaccggtaaccgggtacgttaaccgggttaccgggaaacgggtaaccgggtaaaccggtaaaggtaacccgggtaaacttaaacccgggaaaaccggtaggttaaccggggtacggaccggtttaacggacccgttaccgttaaacggtttcccgtaaggttttacccctaggttaaccccttaccccggtttcccgaacgttcccgttaacggg

SEQ ID NO: 244994 - DNA, 714 bp, Homo sapiens
  misc_feature: GYAE6OF01C0BX2.5.59.F04.1.454.CMB.1.raw
  modified_base (147)..(147): a, c, t, g, unknown or other
  misc_feature (147)..(147): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaanactgtgttgacgcagtctccaggcaccctgtctttgctccgaaggggaaacgagcccaccctctcctgcgacgggccagtcaagaacttcgttaaccaacgtagggttcgtacgccgttacggtaaccagtacaacgtaaaaccgtcggaccgtaacggttcccacgtcccttacctcactctaagtgtactacgtaccaacgacggccacgtcggaccactaccgagacgtcggtacgaggtcggacgaggtccggtcgtagggaacacggtacccttacacttcctaccaacgctacgacgtcgaacgacgtacggacgtaccgtagtaagttagtttcgacttaagggttacttaacgttaccgttcgtacctagggtaacctaggttacgttacgggtactaccgtacgtaaccgggttacgttacccggacggtaaacgggtaccgaaacgggtacgaaacggtaccgtaaacgtacgggtaggtcgtacgtaccggaccgtaacgtacgtttaccgagtttaccttacgttacctcccgttccccgtacgttgttaccggg

SEQ ID NO: 244995 - DNA, 756 bp, Homo sapiens
  misc_feature: GYAE6OF01AHXNT.5.59.F04.1.454.CMB.1.raw
  modified_base (192)..(192): a, c, t, g, unknown or other
  misc_feature (192)..(192): n is a, c, g, or t
  modified_base (742)..(742): a, c, t, g, unknown or other
  misc_feature (742)..(742): n is a, c, g, or t
tcagatcagacacgcacgaccggtgctcgatttagtacacacacttagggattggggtgctcagttaggaccaggagggaaccatggaaacccagcgcagcttctcttcctctgctactctgctccagatcgccaccggaaagcttgtgtcgacgctagtctccgagcctacctgttcttgctcgagggaancgtccacctctctgcgacggccagtcaacgtatcggttaaccaacgtcgggtttcgagtccgttggaaccctaggactaaacggaaaccgttcggaccgtacggttcccacggtcctccgtactcgtactacgttcggtaacttaccgtacccgaccggtacggtaccctacggttacggcctaaaccgttcccgaacggtaccgtttacggcgtagttcggacgtacggtaccgggtgttacgggactacgtcgttacacgttcgacctaactacgtaccgagttaccgtaagacggttacgaacgtaccgttaaggtaacggttatttacggacgttaaaggttcgtttaacttacggttcgggaactttaccggtaacgttaggaacgttttcgacggtttaccgtaaccgggttacgggtaaccggtttcgggaacccggtaagggggtaacccgtaagtaaccgggtaactaacgaacgggtaactagggtcccggtaaagttcgacgtacgcgttgttaccgttcctagttaccgtccttaacncccgtgtaacccgg

SEQ ID NO: 244996 - DNA, 746 bp, Homo sapiens
  misc_feature: GYAE6OF01A4K7K.5.59.F04.1.454.CMB.1.raw
  modified_base (193)..(193): a, c, t, g, unknown or other
  misc_feature (193)..(193): n is a, c, g, or t
  modified_base (587)..(587): a, c, t, g, unknown or other
  misc_feature (587)..(587): n is a, c, g, or t
  modified_base (605)..(605): a, c, t, g, unknown or other
  misc_feature (605)..(605): n is a, c, g, or t
  modified_base (735)..(735): a, c, t, g, unknown or other
  misc_feature (735)..(735): n is a, c, g, or t
tcagatcagacacgcacgaccggtgctcgatttagtacacacacttagggattggggtgctcagttaggacccagagggaaccatggaaaccccagcgcagcttctccttcctcctgctactctggcctcccagatgccaaccggaaagctgtgtgacgcagtctccagcacctgtcttgctacgagggaacngcccacctctcctggacgacgggccagtacgaagtaactcggttaaccaacgtacggttaccgtacgtccgtagggtaaccagtaaccgaaaggtaaacccgtcgggaccctaacgggttaccccaagtccctaccgtactacgttactaacgtaggtactaaccgtccaaccggtacgggacctaacggttccggactaaccttcccggaaagtacggtaacgggtttacgacggggttaccggacggtaacgggtccgggggttaccgttaagggggaaacctacggtaaacccgtttcggacttacctaccggaacctagtaccgacgttacgaacgtaccggtagacgtaccgtaagtaacgttgtttaacgacgagtttagtagttcgngtactagacttaggtacnggtacaccgtagtacggtacgttaccggaacgtacgggtactaaggaaccgtaagaaccaacgggtatacgggacgtacacggtacccacgtcttacgttagttacccgtactactccccgttaacccgngttcgaaccgg

SEQ ID NO: 244997 - DNA, 827 bp, Homo sapiens
  misc_feature: GYAE6OF01BSUO1.5.59.F04.1.454.CMB.1.raw
  modified_base (197)..(197): a, c, t, g, unknown or other
  misc_feature (197)..(197): n is a, c, g, or t
  modified_base (449)..(449): a, c, t, g, unknown or other
  misc_feature (449)..(449): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctccagatgccaccggaagactgtgtgacgcagtctcaggcaccctgtctttgtcctaccgaaggggaaancgccctaccctcgtcctgcgacgggccaggtcaagtaacgttgttaaccaaacgtaggttcgtacgcctgggtaaccagtccaaagaaacccgtcggacccgtacggttcccccagcccttccgtacattacttagtcggttaatacgtaccccaacgaccgggcctaacgtggcccactacccgagaacgtacgggtttacaggtccggacgacgggtccggggttcgtacggggaaccacgtccgtttanacccttccacgtacctaagtcctaaggtccgaacgtaccggtagggaacgtaccgttagggtaagtttacgtttaggacgtttaacgttagtttaaccgtttacgttacgttacgttaacggtacgtaagggtttaaggtttacggtacgttaccgtacccgggtaacccgggttaccgggttaaccggtaacccggggtaaaagggtaccccggttaaaagggggttaacccgtaaaaccggttaacgaaaaaccggtttacgggtaccggttaagggcccggttaaacggccgtaacccggtaactttccggttaaccgtttaccgttcccgttaccgttttaacccccgttaccgggtccctccggtttaaccgg

SEQ ID NO: 244998 - DNA, 685 bp, Homo sapiens
  misc_feature: GYAE6OF01DLDRP.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (275)..(275): a, c, t, g, unknown or other
  misc_feature (275)..(275): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgccaaccggaaagactgtgttgacgcagtctccaggcacctgtctttgctcgaggggaangccaccctntcctgcagggccagtcagatgtaccagtggttcgagctggaccagcaagaaccgtggcctacggttccccncctcctcatctagtgtatactccgaccgacggccacgtgcactcccgagactaggtcgagtcggacgcggtcggtcgtagggaactacgtaaccttctacctcctaccaaccgtactacgacgactaacggtacgtacgggacgtaccgtaaggtaacgtttagttttggacgttaggttagttaacgtttaacgtcgttacgagtaccgtaagttaggttacgggttacgtaccgtaccggtacggtaaccggttaccggaacccggtaaggggaaccgtaagggtaacgtaaacgtaccgaaaacggttaccgttaggtacggtacgtaccggacgtaaccgttacgttacggttccgttactttaccgtacccttaccgtaccccggtcttaacgttcgttaaccgg

SEQ ID NO: 244999 - DNA, 749 bp, Homo sapiens
  misc_feature: GYAE6OF01B0BGU.5.59.F04.1.454.CMB.1.raw
  modified_base (207)..(207): a, c, t, g, unknown or other
  misc_feature (207)..(207): n is a, c, g, or t
  modified_base (329)..(329): a, c, t, g, unknown or other
  misc_feature (329)..(329): n is a, c, g, or t
  modified_base (374)..(374): a, c, t, g, unknown or other
  misc_feature (374)..(374): n is a, c, g, or t
tcagatcagacacgcacgaccggtgctcgatttagtacacacacttagggattggggtgctcagttaggacccagagggaaccatggaaaccccagccgcagcttctcttcctcctgcctactctggctcccagatcgccaccggaaagctgtgttgacgcagtctccgaggcctacccttgttctttgtcctccgaaggggaaacncgtacccacccttcgtcctgccgacgggtccagtacacgtaaattcgttaccagttacgaggttcgtacgtccgtcggtaaccaggcaacgtaacctcggacctacggttccactcctcctnactctacgtcgtactacgtccgaccgtacggcctacgtcggaccncgtaccagacgtggttaccaggtccgacgtcggtcggtacgtacggacacgttaccttcgaaccttcgtactaccgtactacgacgttacaacggttacggtacgtacgtacccgtagtaacggttacctttggtaaccgttaggttacggtttacttaccgttacggtacgtaacggtacgttaaggttacgtacggttaccgttccgtacggtaccgggtttaccggtaccgggtaacccggtaaacgggtaaccggtacggttaaacggtaacctaaccggtaacggtaccgttcgggttaccgacgttaccgacggtacgtaacgttcgttacgttaccttccgtaacgtttccccgtaccgtccgtacgg

SEQ ID NO: 245000 - DNA, 858 bp, Homo sapiens
  misc_feature: GYAE6OF01A9JCP.5.59.F04.1.454.CMB.1.raw
  modified_base (146)..(146): a, c, t, g, unknown or other
  misc_feature (146)..(146): n is a, c, g, or t
  modified_base (159)..(159): a, c, t, g, unknown or other
  misc_feature (159)..(159): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaanactgtgttgacgnagtctccaggcaccctgtctttgtctccgaggggaaagcgcccaccctctcctgccgagggcctagtcaagtaattcgttaaccaacgtaggtttccgtagtcccgttagggtaacccaggactaacgaaacccgttcggacccgtaaccgggtttccccacggtccccttaccctactaacttaccgttagttacgggttaactaccgtacccccaaccgggaccggggtcccctaaccggttcggaccctaccgtaccccgaacggtacgttacgggttacgagggttcggaccgtagggccggggttacgtaggggaacctaacggtcccttacgacccgttcctaccgaacctacgtccacgactacgtacggtgggtaactacccgttaggtaacgtttcgtttacgaacgttagtttaacggttacgtttaccgtacggtactaacggtacgtttaagggtttacgttaggtacccgtaccggttaccggttacccggggtaaccggtttaccgggaaaccgggtaacgggtaaaccgttaaggggtaaccggaaacgttaaccggtaaaaccggttacggttacgggtacggtacccgtacggtaacccgacgtttaaccttccggtttaaccgttacccttttacgaccccgtttaccccggtttaccccctacgttaccggttaaccggg

SEQ ID NO: 245001 - DNA, 724 bp, Homo sapiens
  misc_feature: GYAE6OF01B16FB.5.59.F04.1.454.CMB.1.raw
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
tcagatcagacacgcacgaccggtgctcgatttagtacacacacttagggatttggggtgctcagttaggacccagagggaaccatgggaaaccccagcgcagctttctcttcctcctgcctactctggctcccagatgccacggaatctgtgttgacgctagtctcgaggcacctgttctttgctcgagggaancgccacctctcngcgaggccagtcagtactcgttaccaagtaggttcgacgtcctggtaccagccaagaaccgtggcctaacggttcccagtccctctcatctatggtactactccgacgtacggcctacgtcggactacgtcccgtaaggtacgtaggttcgacggtcggacgtacgggtccgggtcgtacgggtactacggtacttacctacgtccgtacctaaccgtacgtaccgaacgtcgaacgttacgtacgggactaccgtaggtaacgttagtttacgacgttagttacgttacgttacgtgtaccgaacggttatacggtttaacgacggttacgtaccgtacgggttaccgggtacggttacccgggtaaccggaaaccgggtaccgttaaacgggtacgttaaaccgtaaccgaaacggtacggttacggtaccggtacggtacgtaaccctaccgtaacgttacccgttacgttaccgttactacccgttaccccgtccggtacgttccgttaccgg

SEQ ID NO: 245002 - DNA, 798 bp, Homo sapiens
  misc_feature: GYAE6OF01DS87E.5.59.F04.1.454.CMB.1.raw
  modified_base (215)..(215): a, c, t, g, unknown or other
  misc_feature (215)..(215): n is a, c, g, or t
tcagatcagacacgcacgaccggtgctcgatttagtacacacacttagggattggggtgctcagttaggacccagagggaaccatcggaaaccccagcgcagcttctcttcctcctgctactctggcctccgagatcgccgaaccggaagtctgtgttacgacgctagtcctcgacgcctaccctgttactttcgccgtaccggaagggtaaacncgaccctacccttcgtccgtgccggacgggaccaagtacgaagtacgtacgttaaccaacgttacggttcgtacgccgttacggaccgtagaccgtaacgtaaaccgtcgggacctaaccgggttacccacggtacccttccgtactacttaccgtagtacgtactacgtacccgaccgtacggtaccacgttcgaccctacgtaccgagtacgtacggtcgtacgagccgtaagggtccggtggacggacgttacgtaccgttaactaccgtccctaacaaaccgtgtaccgaagtccgtaacgtaacgtggaaccgtacggtaacgtacggtttacgttaggtaaccgttaagttacgttacgtttacggtaccggtacgtagtaacgtaaggttcggtaacgttacgggtccgtaaccgggttaccgacgggttacccgaacggggttaaccggaaacggtaacggttaacgtaaacgtaacccgtaaacggttcgtaacgtaccggtaacccgtcgacaacccgttcgttacctacggttacttcccgtacttaccccgtacctacgttcgttaaccgg

SEQ ID NO: 245003 - DNA, 1010 bp, Homo sapiens
  misc_feature: GYAE6OF01D9UAT.5.59.F04.1.454.CMB.1.raw
  modified_base (97)..(97): a, c, t, g, unknown or other
  misc_feature (97)..(97): n is a, c, g, or t
  modified_base (151)..(151): a, c, t, g, unknown or other
  misc_feature (151)..(151): n is a, c, g, or t
  modified_base (406)..(406): a, c, t, g, unknown or other
  misc_feature (406)..(406): n is a, c, g, or t
  modified_base (574)..(574): a, c, t, g, unknown or other
  misc_feature (574)..(574): n is a, c, g, or t
tcagatcagacacgcacgaccggtgctcgatttagtacacacacttagggattggggtgctcagttacggacccaggagggaaccatcggaaacccngcgcagcttctcttcctcctgctactctggcctccagatcgaccgaaccggaancttgtgttcgacgcgtagtcctcgacggcctaccgttggtttctttacgtccgtaaccggtaaagggggaaactccgtacccctacccttcgttccgtacggaccggaacgggtaccctagtaacgaacgttaaccgtttacgtaaaccctaaacgggtttcgggttccggtaacgtccggttaacggtaaccacggtaaccgtaaacggtaaccggttcggacccgttaacggttacccacgttccttacctanacgttacgtaggttactacgttaaccgccgaaccggtcggtacctaacggcgtaacctaccgaaccggtagttcccgtaaggtactaaccgggtcgtaccggtcgggtaccgggttacgaacggggttactaaccgtttcctaaccgtaccgtcccgtaacgtaaccncggttaaacccggaaggtaccgtaaaaaccggggtttcggtaaccggggtaaccgtttaccggttaaacggtttaaccgggtttaacgttttacggtaccggtttaacgttaacggtttaacgtttcccgtagggttacctacgggtttaaccgttacggtttaacggtacggtttaccggttacccggttaaccgggtaccggtttaacccggggtaaccgggtaaaccggggttaaaccgggtaaccgggttaaaacggggtaaacgttaaaccgggttaaaacccggttaaaggtttacccgggtaaccgggtttaaggtaccccggttaaaccggttaacccggttacgttacccggttttaccgtaccggttttaaccttcccgtttaaaccggttccccgttaacccgttcggttcccggttaaacccgg

SEQ ID NO: 245004 - DNA, 743 bp, Homo sapiens
  misc_feature: GYAE6OF01BD1H1.5.59.F04.1.454.CMB.1.raw
  modified_base (199)..(199): a, c, t, g, unknown or other
  misc_feature (199)..(199): n is a, c, g, or t
  modified_base (345)..(345): a, c, t, g, unknown or other
  misc_feature (345)..(345): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgtctttgtctccgaaggggaaancgcccaccctctcctgcacgggccagtcagtaatcgtaccacgtaggttcgtagcctggtaccagcaacgaaaccgtggacccgtaggttccccagtcccgtcctactactcttagtggtactactaccgaccgacgggcctacgnggactacgtcccgagacgtagttacgaggtcggacgacggtccggggttacagggtacctaggtaccttccgtaccttacctaccgtaccacgtccgaacgaccgaacggtaccgtagggtaccgtaccgttaggtaaacgtttacgtttagtacccgtagtttagttaaacctttacgtacgttaacgtaaggtaccgttaaggttacgttaacgggtaaccgttaccgttaacccggtacggggtttacccgttaaccgggacccggtaaacgggtaaacccggtaagggtaacgtaaacgtaacgtaaaccggtaagtacggtcggaccgttacgccgttaacctcgttacgttacgtaccgttaactccttaccccgtaccgtccgtcgttacg

SEQ ID NO: 245005 - DNA, 805 bp, Homo sapiens
  misc_feature: GYAE6OF01A4MCX.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctccaggcaccctgtctttgtctccgaggggaanacgcccaccctctcctgcgacgggccagtcagtaatcgttaaccaacgtagggtttacgtacgtccgtagggtacccagaccgaacggaaacccgtcgggacccgtaacgggttcccccaaggtccccttacccgtacacttaccgttaagttcggttaactactaccccgaacccggtacggggaccctaacgtcgggacctacctaccccgaaggtaccgtacgggtttaccgaggtcgggaccgacgggtccggggttacggtacggggaacctaacggtacccgttacacccgttacctaccgaaccctaataccgaacggtaccaacggtaccgtagggaccgtacccggttaaggtaacgtttagttttacggacgttaaggttacgttaacttaccgtgtacgacgtacgtaagttagttaggtactaccgtacggaaccgggttaccggttaccgggaaccggtaaacggggtaccgtaaacgggtaacgaaacgtaccggaaaacggtacggttacggtacggtaccgtacgtaccaccgtaacgttccgttacgttaccttacgtacccgttccccttacccggcttaccggttccgg

SEQ ID NO: 245006 - DNA, 749 bp, Homo sapiens
  misc_feature: GYAE6OF01BOT9I.5.59.F04.1.454.CMB.1.raw
  modified_base (162)..(162): a, c, t, g, unknown or other
  misc_feature (162)..(162): n is a, c, g, or t
  modified_base (195)..(195): a, c, t, g, unknown or other
  misc_feature (195)..(195): n is a, c, g, or t
  modified_base (583)..(583): a, c, t, g, unknown or other
  misc_feature (583)..(583): n is a, c, g, or t
  modified_base (710)..(710): a, c, t, g, unknown or other
  misc_feature (710)..(710): n is a, c, g, or t
tcagatcagacacgcacgaccggtgctcgatttagtacacacacttagggattggggtgctcagttaggacccagagggaaccatggaaaccccagcgcagcttctcttcctctgctactctggctccagatgaccaccggaaagctgtgttgacgcagtcncagcacctgttctttgtctaccgaggggaaacncgccacctctcctgcgacggccagtcagaatcgttaccacgtacggttcgacgcctaggtaccagacgaacgaacctggaccgtacggttaccccaagtcccttacctacgtaacttacgtaggttacgttaactaccgtaccccaacgggtaccggtcccaacgtcggtaaccaccgttaaccctacgggaaccgtttacgggttacgaacggttcgggacgtacggggtccgggtaacggttcgggaactcgggttaacctttaccgccgttaccgtaacaccgtaataccggaggaccggtaccggtaacggttcggacgtaccggttaaggttaaacgttttgtttaaccggacgtttacggtttaacgttcgtttaaaccgtnttaaccggagttaccgtaagttacggttcggtacgtaccgttcgggaccggttcggacccggaacggtaacggtcgtaaaggttaacgaactaacggtacgtactaggtccgatccggtataaccgnttccgtcttactacgacctttccgacctacggtctacgg

SEQ ID NO: 245007 - DNA, 695 bp, Homo sapiens
  misc_feature: GYAE6OF01BYQRR.5.59.F04.1.454.CMB.1.raw
  modified_base (207)..(207): a, c, t, g, unknown or other
  misc_feature (207)..(207): n is a, c, g, or t
  modified_base (431)..(431): a, c, t, g, unknown or other
  misc_feature (431)..(431): n is a, c, g, or t
  modified_base (688)..(688): a, c, t, g, unknown or other
  misc_feature (688)..(688): n is a, c, g, or t
tcagatcagacacgcacgaccggtgctcgatttagtacacacacttagggattggggtgctcagttaggacccaggagggaaccatgggaaaccccagcgcagcttctcttcctcctgctactctggcctcccagatcgccaaccggaaagactgtgttgacgcagtcctaccgaggcaccctgttcctttgtcctacgaggggaancgccacctctctgcgaggccagtcagtatcgtacagtggttcgtagctagtacagctaagaaccgtgacccgtaggttcccacgtcctcctcgtatctatcggtactactaccgacgacggcctacgtcggactaccgtaccgacgacgtggttccaggtcggacgtacggtcgggttacgtacggactacggtaccttcgacccgttacaaccgtaaccgttntacgacgtacgtaacgtacgggttaggtaccgtactaacggttaaagttccgttttaagacccgttaaggttacgttaacgttcgtagtaccgtagtaccgttaagtccggttaggtccgtacggtacggtaacggttaccggttcggaaaccggtaacgggtaccgtaagggtaaccgtaactacggtaaacgtaggtcggtaaaccgcgtacgacgaccttcggtcgttactaccgttccgacttcccgtccgtntcgtacg

SEQ ID NO: 245008 - DNA, 811 bp, Homo sapiens
  misc_feature: GYAE6OF01DEZJP.5.59.F04.1.454.CMB.1.raw
  modified_base (149)..(149): a, c, t, g, unknown or other
  misc_feature (149)..(149): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatcgccaaccgggaanactgtgttgacgcagtctccaggccaccctgtctttgctccgaagggggaancgcccacccttntcctgcaggccagtcagtaatgttaaccaagtggttcgagcctggtaccagcaacgtaaacctggacctacggttcccacgcctcctacatcgtatggtactactccgaaccagggccacgtggacctactacccgaagtaccttagggtttcaaggtcgggaccgagggtccggggttacgtagggggaacctaagtacccgtttacgaaccttcctaccaaacccgtagttaccgacggaacgtaacggtaccggtttggggaaccggtacccgttaggtaaaacggtttagtttttaccgggtacttaaggtttacgtttaatttaccgttacgtacgtaacggtacgtaagttacggttagggttaccgtacgttacggtaaaccgggttacgggtttacccgggaaccgggtaaaggggtaacccggttaaagggttaacggtaaaccgttaaccggtaaaaaccggttacggtaccggttcgggtaaaccgttaccggaaccttaaccggtaacccgttccgggtttaccgtttacctttacccggttaccgttttacccgtaaccccgttccgttaacgtttaacccgggg

SEQ ID NO: 245009 - DNA, 617 bp, Homo sapiens
  misc_feature: GYAE6OF01C7P17.5.59.F04.1.454.CMB.1.raw
  modified_base (194)..(194): a, c, t, g, unknown or other
  misc_feature (194)..(194): n is a, c, g, or t
  modified_base (346)..(346): a, c, t, g, unknown or other
  misc_feature (346)..(346): n is a, c, g, or t
  modified_base (399)..(399): a, c, t, g, unknown or other
  misc_feature (399)..(399): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatgccaaccggaaagactgtgttgacgcagtctccaggcacctgtctttgctcgaggggaaancgccaccctctcctgcagggccagtcaagtaatttaccaacgtaggttcgtagcctaggtaccagcaacgaaacctggacctaggttcccagcctctcatcgtatggtactactccacgaggccacgtgcactccaagactaggtcagtcgnacggcggttcaggacagtaccttcacgtctacaacataccgaagccaagtacnggacgacgtagaaagttgtttgacgtagttagtacttaacgtggtacaggtactaaggttctaaggggtactcgtacggtaacgggtacgttaccggtaccggaaacgggaaccgtaagggtaacgtaaacaacgtaaacgaacgtgaacggtaccacggtccaacgtacgttacgtcgttaacttcaacgttccccttacgcctagttccgtaacgg

SEQ ID NO: 245010 - DNA, 793 bp, Homo sapiens
  misc_feature: GYAE6OF01BYTB7.5.59.F04.1.454.CMB.1.raw
  modified_base (232)..(232): a, c, t, g, unknown or other
  misc_feature (232)..(232): n is a, c, g, or t
  modified_base (353)..(353): a, c, t, g, unknown or other
  misc_feature (353)..(353): n is a, c, g, or t
  modified_base (385)..(385): a, c, t, g, unknown or other
  misc_feature (385)..(385): n is a, c, g, or t
  modified_base (710)..(710): a, c, t, g, unknown or other
  misc_feature (710)..(710): n is a, c, g, or t
tcagatcagacacgcacgaccggtgctcgatttagtacacacacttagggattgggggtgctcagttaggacccagagggaaccatggaaaccccagcgcagcttctcttcctcctgcttactctggcctcccagactcgccgaaccggaaagtcgttgttcggttcgaccgcgtacgtcctaccgacggcctacccgttgttctttcgtccgtaccgggaagggggaaacnccgacccgtaccctcgtcctcggacgacgggccaacggttcgaagtaacgttacgtaaccaacgtacggttcggtacgtcgtacgtacgagtacgaacgtaacgtcggaccgtacggtccncgtacctctactactcgtagtacgtactaccnccgacggaccgtcaccgtcggacctactccgaacgcgttaacgtcgaggtcggacgtcgggtccggtcggtacggactacgttacctactaccgtactaccgaactcgcgaacgtactaggtaccgtcgggtaactaccgtaagtaaccgtttgttcgaacgtttagttacgttacgttacgtcgtaacgtcggtacgagggtttagtaccggtccttaaaccgggacggtttaccgggtaccggtaacccgggtaaacggggtaaccggtacggtaaacgttacgaaaaccgttacggttaacgtaaccggttggggtaacccngttaacccgaacggttcctacgtttaccggttaccgtttcgtacccgtttaccctacccggtttaccctgtaccgttaacggg

SEQ ID NO: 245011 - DNA, 774 bp, Homo sapiens
  misc_feature: GYAE6OF01AQ9ZE.5.59.F04.1.454.CMB.1.raw
  modified_base (193)..(193): a, c, t, g, unknown or other
  misc_feature (193)..(193): n is a, c, g, or t
  modified_base (456)..(456): a, c, t, g, unknown or other
  misc_feature (456)..(456): n is a, c, g, or t
tcagatcagacacgcacgaccggtgctcgatttagtacacacacttagggattggggtgctcagttaggacccagagggaaccatggaaaccccagcgcagcttctcttcctcctgctactctgctccagatgccaccggaaagctgtgttgacgcagtctcgaggcaccctgtctttgtctccgagggaaancgcccaccctctcctgcgacggccagtcagatgttaaccaagtaggttcgacgtcctggtacccagacaacgtaaccgtggtacctacggttaccccgagtccctaccgtactacttacgtacgtcggtaattaccgaccccgtaaccgacgggtcccacgttcggacctaccgttacccgaagtaccgtacgggttccaaggtccggacgacggtcgggtacgtagggactaacggtctacacctcaccaactgtacacganaacgtaccgtggacgtaccgtaaggttaacgttacgttttacggacttaacggttacgtttaacgttacgttcggtaccgtacggtacgtaaggtttcggtaacggtttaacgccggttaaccgaacccggggtttacggttacccgggaaaccgggtaacggtaacggttaaacgggtaacggtaaaactaaccggtaaacgggtaacgtcgggttaacggaccgttaacggaacccggttaacctaaccggttcgttaacccgttacctttaacccggttcgttaaccccccggttcccttacgtacccgttacgg

SEQ ID NO: 245012 - DNA, 830 bp, Homo sapiens
  misc_feature: GYAE6OF01B0XT3.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctgctcccagatgccaccggaaagactgtgttgacgcagtcctccaggccaccctgttctttgtcctacgaaggggaaagcgcccaccctctcgtgcgacgggccagtcagtaatcgttaaccactaggttcgagcctggtaccagacaacgaaacctcggccgtacggttcccacgtcccttcctctagtctagtggtactactccgaccggacgggcctacgtcggacctacctcccgaacgtacgtacggttcgagggttcggacgtacgggtccggggtaccgtcggggtaccgaacgttaccttaccgtacccgttcctacccgtaaccctacgtccgaacgtacccgaaacggtacgtacgggaccgtccgttaaagtaacggtttagttttacggacgttaaggtttacgttaacgtttaccgttcgtaacgtacgtacggtaagttacggttacgggttacgtaccgttaccgggtaaccgggttaacccgggtttaccgggaaacccgggtaaacggggtaaccggtaaaaggggttaaccggtaaacgttaaaaccgggtaaaaccgttaaccgggttacggtacgggtacccgttacgggaacccttaacccgttaccgttaccggtttccgtttaacccgtttacgttaccccgtttacccccgttaccccgttacccgttaccgtttaaccccggg

SEQ ID NO: 245013 - DNA, 714 bp, Homo sapiens
  misc_feature: GYAE6OF01BNM4P.5.59.F04.1.454.CMB.1.raw
  modified_base (59)..(59): a, c, t, g, unknown or other
  misc_feature (59)..(59): n is a, c, g, or t
  modified_base (95)..(95): a, c, t, g, unknown or other
  misc_feature (95)..(95): n is a, c, g, or t
  modified_base (205)..(205): a, c, t, g, unknown or other
  misc_feature (205)..(205): n is a, c, g, or t
  modified_base (330)..(330): a, c, t, g, unknown or other
  misc_feature (330)..(330): n is a, c, g, or t
  modified_base (552)..(552): a, c, t, g, unknown or other
  misc_feature (552)..(552): n is a, c, g, or t
  modified_base (668)..(668): a, c, t, g, unknown or other
  misc_feature (668)..(668): n is a, c, g, or t
  modified_base (699)..(699): a, c, t, g, unknown or other
  misc_feature (699)..(699): n is a, c, g, or t
tcagatcagacacgcacgaccggtgctcgatttagtacacacacttagggattggggtnctcagttaggacccagagggaaccatggaaaccccngcgcagcttctcttcctcctgctactctggcctccagatcgccaaccggaaagctgtgttgacgcagtctccgaggccacccttgttctttgtcctccgaagggggaacncgcccaccctctccgtgcgacggccaagtcaagtaatcgttaaccaacgtcggttcgtacgccttaggaaccacgaccgaaacgaaaccctcggacccgtaacggttccccagtccccttacctntacttctagttggtaactaccgtccccgaaccggcgggtaccctaacggttcggaccaacccgtcccgaaggtaccttacgggttctagggccgacgaacgggtccggggtctaggggaactacggttacctacctacttccaccgaacctatccgagtcgacgacggttcgaacgtccttaggtaaccgtttagttccgattaggttcttaagttaccgtnttacggagttaccgtagtttacgtgggtaacctcgtacgtacgggtaaccgtcggaacgaacgggacgtaagtacggaactaccgaaggtaccgtggaccgctcgaactaccggtnttaccgttaccgttcgtacctactttccccnccctagtcccttagg

SEQ ID NO: 245014 - DNA, 750 bp, Homo sapiens
  misc_feature: GYAE6OF01CWRDP.5.59.F04.1.454.CMB.1.raw
  modified_base (126)..(126): a, c, t, g, unknown or other
  misc_feature (126)..(126): n is a, c, g, or t
  modified_base (213)..(213): a, c, t, g, unknown or other
  misc_feature (213)..(213): n is a, c, g, or t
tcagatcagacacgcacgaccggtgctcgatttagtacacacacttagggattggggtgctcagttaggacccagagggaaccatggaaacccagcgcagcttctcttcctcctgctactctggcnccagatgccaacggaaagactgtgttgacgcagtctccaaggcaccctggtctttgctaccgaagggaaacgcaccaccttctccgngacggtaggcccgtaagtacaaggaaacttgtaaaccgtaacaggggttaccgtagtaccgtcgggtaaccacgtacgaaacgaaaccgtacggtacctaacgggttaccctaacggtacctacctacgaacttaccgtaagttaacgggtacttaccgttaaccgaaccgttaacggaccgaacgttccggactaactcccgaataccgaagttaccgagtacggtacaacggtcggtacgtacggactacgacgttcacttacgacactacgcaaggactacgacgtagacgactaggtaagtagtttcgaacgtagtaggtacgttaacacgtaaccgaggtacgtaggtagtacggttaaggaccgttaacggaacggttaacgtcggtaaaccgggtaacggaaaccgggtaaacgttaagaaccgtaacgtaaacgaacccgttaggtacggtacgacgggaacctaccctaaggttacccgttagtaccgtttaagttacccgttaccgtcccgtaccgagttaacccgg

SEQ ID NO: 245015 - DNA, 613 bp, Homo sapiens
  misc_feature: GYAE6OF01DSH1D.5.59.F04.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (337)..(337): a, c, t, g, unknown or other
  misc_feature (337)..(337): n is a, c, g, or t
  modified_base (389)..(389): a, c, t, g, unknown or other
  misc_feature (389)..(389): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccgaaggggaaanagcccaccctntccctagcgagggccagtcaagaatcgttaaccaanaggttctagcctggtaaccagcaagaaacctggaccacggttcccagcctcctcatctatggtatactccaccgaggcctacgtggaccanacctagactagttcagtgcaggtcggtgtagggacagacttcactctcgacntacagtcagacgtgacgctgaagtatttgacgtagtgttaatgtgtatacgntaagtntggtaatcgtacgacgtacgttaccggaccgtaaggacgtaacgtaaggtaacgtaaacgtaaacgaaacggtcggtacggtaccgtacggaactaccgttaaacgtccgtaaggtttcctttaccgacctttacccgttacccccgtaccgtaagttaacccggg

SEQ ID NO: 245016 - DNA, 944 bp, Homo sapiens
  misc_feature: GYAE6OF01C4SIO.5.59.F04.1.454.CMB.1.raw
  modified_base (133)..(133): a, c, t, g, unknown or other
  misc_feature (133)..(133): n is a, c, g, or t
  modified_base (208)..(208): a, c, t, g, unknown or other
  misc_feature (208)..(208): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagntgccaaccggaaagacttgtgttgacgctagtcctccacggccaccctgttctttgtcctaccggaaggggaaancgcccctacccttctcctgccgacgggccagtcgaagtaacttcgttaaaccaagtacggtttaccgtagcccgttacgggtaaccaggaccgaaagtaaacccgttcgggacctaaccgggttccccaacgtcccttaccgtactaacttcgtaacgtttcggtaactttacaccccgaaaccggtaacgggtcccctacggttccgggacctaaccgtaccccgaagggtaaccgttagggtttaccgaaggttcggggacctaacggggttccgggggttaccgtaacgggggaacccttaacggtaccctttaccggtaaccctttccgtaacccgtaaaccccgtacgtaccgaaacggacccgtttaaagggaccggtaacggggtaaccgttaccccgggttaaggtttaaaccggtttacggttttttaaccgggaccgtttaaagggtttaaccggtttaaacgttttaaacccggttggtttaaacggtacggttaacgttaacgggtttaaggttacgggtttaaccgtaccgggttaacccggtaaacccgggtttacccggtttaaccgggaaacccggtaacggggtaacccgtaaagggtaaccggtaaccgaaacgtaaaaccggttaacgtaccggtaggaccgtacgtacccgtaaccgttactaccgtttacgtaccttaccttaccgtttcccgtaaccctccgttacgttaccgg

SEQ ID NO: 245017 - DNA, 1055 bp, Homo sapiens
  misc_feature: GYAE6OF01BHXHX.5.59.F04.1.454.CMB.1.raw
  modified_base (149)..(149): a, c, t, g, unknown or other
  misc_feature (149)..(149): n is a, c, g, or t
  modified_base (168)..(168): a, c, t, g, unknown or other
  misc_feature (168)..(168): n is a, c, g, or t
  modified_base (200)..(200): a, c, t, g, unknown or other
  misc_feature (200)..(200): n is a, c, g, or t
tcagatcagacacgcacgaccggtgctcgatttagtacacacacttagggattggggtgctcagttaggacccagagggaaccatggaaaccccagcgcagcttctcttcctcctgctactctcggctcccagatcgccaaccggaaanactgtgttcgacgcagtcnccaggcacctgtcttgtcctaccgagggaaancgccacccgtctccgtgcgacgggaccagtcaagtaattcgttaacccgaataagggtttccgaacgtacccgttacggaacccaaggaccgaaacggtaaaacccgtacggtaaccccgtaacggttacccgaaacggtccccttaccctaacgttaaccttacgttaaacgttacgggtttaaacttaaaccggttacccccgtaaaccggtaaccggggaaccccgttaaccggttacgggaacctaaaccgttaccccgaaacggtaaacccggtaacgggtttaacctaacggggttaacgtaaccgggaacgggttcccggggggggttaaccgttaacggggaaccggttaacggtaaccccgtttaaccggtaaccccgttaaccctttaaccccgaaacccgtttaaaaccggtaccggtaaaccggaacccggtaaacggggtaaccggttaaccggggtaacccggttaacccgtttaaaggaaacggtttaacgggtttttacggaaacccgtttaaggtttaaacgtttaaggtttaaacccgttacggtacgtaacggttaaccggtaacgttaagggtttacgggtaaccgttaccgtacggtaaacggggttaaccggttccggggtaaacccggaaaaccgggtaaaccgggttaaacgggtaaaacgttaaaccggtaaaccggtaaaaaacggtaacgtttaccggggaaaccggtttacgggaaccgttaacccgaaccggttacggttaaaccccgtttacggttaaaccccttttccgggtaaaaccttttaccccggtaacccccttaaacgggtccctttaaaacccgggg

SEQ ID NO: 245018 - DNA, 831 bp, Homo sapiens
  misc_feature: GYAE6OF01CYUPK.5.59.F04.1.454.CMB.1.raw
tcagatcagacacgcacgaccggtgctcgatttagtacacacacttagggattgggggtgctcagttaggacccagagggaaccatggaaaccccagcgcagcttctcttcctcctgctactctggctcccagatgccaaccggaaagactgtgttgacgcagtctccaggccaccctgttctttgtctccgaaggggaaacgacgccctacccctctccgtgcgacgggtccagtcaagtaattacgttaaccaacgtagggttcgtacggtcccgttaggtaaccaggactaaacggtaaacccgtcgggtacccgtaccgggttccccacgtccccttaccctacctacttaccgttacgtacggttacttaacctccccgaacccggacgggtccctaacgtcgggacctacccttacccgaacggtaaccggtacggttaccgaggttcgggaccgtacgggtccgggtacgtacggggaactacggttaccttaccgtaccgttcctaccgtaccctactacgtaacgaccgtagaccgtagggaccgttacccgttaggtaaacgtttgtttacggtacgttagttaacggtttacgttacgttacgtcgtaagtacgttagttagggttcgtacggtacctacgggtaaccgggttcggttacccgggaacggtaaacggggtaacccgtaaagggttaacgaaaccgtaaaccgtaaaaccgggtacgttacgggtcggtacggtacccgaccgttaacccgttctttaccgtacgtttcctaccgttacccttacccgtttaccccggctttcgttaccgg

SEQ ID NO: 245019 - DNA, 816 bp, Homo sapiens
  misc_feature: GYAE6OF01CP0YU.5.59.F04.1.454.CMB.1.raw
  modified_base (97)..(97): a, c, t, g, unknown or other
  misc_feature (97)..(97): n is a, c, g, or t
tcagatcagacacgcacgaccggtgctcgatttagtacacacacttagggattgggggtgctcagttaggacccaggagggaaccatggaaaccccngcgcagtcttctccttcctcctgctacttctggcctcccagatcgaccaaccgggaaatctggttgttgaccgcagtcctccgacggcctacccgttgttctttcgccgtaccggaagggggaaactccgcccctacccttcgtccgtggacggaccgggcctaggtaccaaagttacgttaccgttaacgaacgttagggtttaccggtacgtccgttacggaaccctagaccgtaaacgtaaccggttccgggaccgttaaccgggttcccaaccgttccctcctacgttattaccgttaaggttcgtaacgtacccgtaccgaacccggtacggccgtacgtcgtaacccgtaccacccggtaagtaaccggttcggtaggtacggtaccgggaccggtagggtccggggtacgtacggggtaacctaacgtcccgttaacggtcctaccgacccgtaatacgtaccgagaccgtaacggtacggttcgggtacgtacccggttaagttaaccgttagtttacggacgtttaacgttacgtaacgttcgtagtacgtagttacggtagttagtacgtacgtaccgtacgggtccgtaacggttcggaacggtacggaaggaagttaacgagtaaccggtagtacggagtcgtacgtacgtaccctaacttgttcttagttccttacgtacgttccttaacctggtccgtttacggg

SEQ ID NO: 245020 - DNA, 750 bp, Homo sapiens
  misc_feature: GYAE6OF01CPZ2Q.5.59.F04.1.454.CMB.1.raw
  modified_base (59)..(59): a, c, t, g, unknown or other
  misc_feature (59)..(59): n is a, c, g, or t
  modified_base (147)..(147): a, c, t, g, unknown or other
  misc_feature (147)..(147): n is a, c, g, or t
  modified_base (159)..(159): a, c, t, g, unknown or other
  misc_feature (159)..(159): n is a, c, g, or t
  modified_base (164)..(164): a, c, t, g, unknown or other
  misc_feature (164)..(164): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (728)..(728): a, c, t, g, unknown or other
  misc_feature (728)..(728): n is a, c, g, or t
tcagatcagacacgcacgaccggtgctcgatttagtacacacacttagggattggggtnctcagttaggacccagagggaaccatggaaaccccagcgcagcttctcttcctcctgctactctggcctcccagatgccaccggaaanactgtgtgacgnagtcncaggctacctgtcttgctacgaagggaaancnccacctctctgcgagggccagtacagtaatcgtaacaagtgggttcgacgccgtaggtaccagacaaacgtaaaccgtcgggacctacggttacccaagtcccttacctacgtaacttacgttagtaggtaactaacgtaacccgaaccggaacgggccctaacgtcggtaccaaccgtacccgaaggtaaccgtagggttacaaggttcggacggtaacgggtccggggttaggtacggggaactaacgtaccttaccaccttactacaaccgtacacgaacggcgtaaacggacggtacggtaacgaccggttaagtaaacggtttcgttttaacggacctttagggtttaattaacgttaccgttaggtaaccaaggtacgtaggttaagtcgggtaatccgtaacgggtacggttacgggtaccggaaacggtaaccgggaaaggtaaggtaaacggtaacaaaccgtaaacgacggttagacggtactcggaacctacgtacttacgtggtttaccctacttacccnccgtttaaacccgctagtaccg

SEQ ID NO: 245021 - DNA, 685 bp, Homo sapiens
  misc_feature: GYAE6OF01B6VE6.5.59.F04.1.454.CMB.1.raw
  modified_base (201)..(201): a, c, t, g, unknown or other
  misc_feature (201)..(201): n is a, c, g, or t
  modified_base (266)..(266): a, c, t, g, unknown or other
  misc_feature (266)..(266): n is a, c, g, or t
tcagatcagacacgcacgaccggtgctcgatttagtacacacacttagggattgggggtgctcagttaggacccagagggaaccatggaaaccccagcgcagcttctcttcctcctgctactctggcctcccagatgccaaccggaaagactggtgttgacgcagtctccaggcaccctgtctttgtctcgaaggggaaangcccaccctctccgtgcgagggccagtcagaatgtaaccaacgtaggttctagccgtggtaaccngacaacgaaaaccgtggacccgtaaggttcccagtcctcctacaatctaagtggtaatactaccaccgagggccaacgtggaccactcccagactacggttcagtggcaggcggtcgtagggacaggtacttcacgtcaccgacatcgagcgagacgtggaacgtcctaggaagtagttttacgactaggttacgtacgtttacgtacgtagtaacgtactaaggttagtacgggtactaccgtacgaacgggttaccgtacggggtaacccgaaaggggtaaaccgaacggggttaaggtaaaccgttacgtaaaaaccggaacgttacgggtaccggtactcgggtaccaacgttaacgttacgtcttaaccgttacgttaacccttccgtttaccccggtacctacggtttaacgg

SEQ ID NO: 245022 - DNA, 926 bp, Homo sapiens
  misc_feature: GYAE6OF01CI3PU.5.59.F04.1.454.CMB.1.raw
tcagatcagacacgcacgaccggtgctcgatttagtacacacactttagggattggggtgctcagttaggacccagagggaaccatacggaaaccccagcgcagcttctcttcctcctgctactctcgctcccagatcgccaaccggaagactgtgttgacgctagtcctccgaggcctacccgttgttcctttgtacctaccggaaggggaaacgacgacccctacccttctccgtggaccgacgggtccagtacaagtaacttcgttaaccaacgtacggtttacgtacgtccgtacggtaaccagaccaacgtaacccgtcggtaccctaccgggttacccacgttcccttaccttacgtaattaccgttacgttacggtaacttacccgttaccccgaaccgggtaccgggtaccctaccggttacggtaccctaaaccgttaccccgaaagggttacccggttaacgggggttttacccgaagggggttcccgggtaaccgggtacggggttacccgggggtttaccggttaacgggggaaccctttaaccggttaaccccttttaccgaaccccgttttacccgaacccgtaacctaccggtacccgaaggtaccgtaacggtacgtcggtaccgttacgtaggttacgtttaacttcggagtttacggttactttacgttacgttacgtactaacggtacgttaaggttacggttacggttaccgtacgtaccgggttaacgggttaccgttacccggggaaaccggtacgggttaaaccgtaacgggtaacgtaaccgtaaaccgggtaaaccggttcgttaggtaccggttacccgtaccgtacccgtaacgttcctttacgtaccgtttttaccgacctttaccggtccccttaaccccggtgttacgttcccggg

SEQ ID NO: 245023 - DNA, 784 bp, Homo sapiens
  misc_feature: GYAE6OF01AYNUA.5.59.F04.1.454.CMB.1.raw
  modified_base (334)..(334): a, c, t, g, unknown or other
  misc_feature (334)..(334): n is a, c, g, or t
  modified_base (390)..(390): a, c, t, g, unknown or other
  misc_feature (390)..(390): n is a, c, g, or t
  modified_base (736)..(736): a, c, t, g, unknown or other
  misc_feature (736)..(736): n is a, c, g, or t
  modified_base (744)..(744): a, c, t, g, unknown or other
  misc_feature (744)..(744): n is a, c, g, or t
tcagatcagacacgcacgaccggtgctcgatttagtacacacacttagggattggggtgctcagttaggacccagagggaaccatggaaaccccagcgcagcttctctcctcctgctactctggcctcccagatgccaaccggaaagctgtgttgacgcagtcctaccgaggccacccgttgttcgttttcgtccgtacccggaaggggaaacgtcgccctacccctctcccgtgaccgacgggtcccagtaccaaggtaacttacggtaacccaagtacggttacgtacgccgtaggtaccagacgaacgaccgtcggaccgtacggtacccngtccctcctaatacgtacgtagttggtaacctacgtccccgaccgtaccggtaccnccgttacggaccaaccggttacccgaaggtaccgttacgggttaccgacggtcggtacgtacggtcggggttaccgtacggggacttaacgtccgttaccgtaccttaccgtacctaccgtactaccgtacgactacgtaccgtgggtaccgtaccgtaaggtacgtttcggtaacggttacgttaggttacgttaccgttacgtccgtaagtacgtaagttaacggttggtacggtaccgtacgtacgggtacccgtacggttcccggaaacggtacggtaacgtaacgggtacgtaaaaccgtagtaacgtacggttcgacccggtacgtacgtaaccgcgttnacccgttnttaacccctctaccgttaccccgtacgccttacggtcccg

SEQ ID NO: 245024 - DNA, 819 bp, Homo sapiens
  misc_feature: GYAE6OF01DJ7CO.5.59.F04.1.454.CMB.1.raw
  modified_base (361)..(361): a, c, t, g, unknown or other
  misc_feature (361)..(361): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagatcagacacgcacgaccggtgctcgatttagtacacacacttagggattggggtgctcagttaggaccaggagggaaccatcggaaacccagcgcagtcttctcttcctctgctactctggcctaccagatcgaccgaaccggaaagtctgtgttacgacgctacggtcctaccgacggcctacccgttgtttctttgtccgtaccggaagggggaaacacgccctacccttcgtccgtggacgtacggggacctagtacgtaagtaacgttacgttaaacgacgtacggttacgacgtccttagggtaaccagaccgaacgaaccgtcggaccgtacggttccaggtcctacctanaagttctacgtaggtactacgtaccgaacgtagggcctactggcctaacgtccagtacgacggtttcgaggtgaccgaacgggtcggttacgacggaactaacgtcttaccgactccgtacaccgtanacgtanacggacgttagcggtacgtacgtaacggtagttacgttgacgttacgttagttacttaacgtgtacgaacgtacgtagttacgtacggttaacgtcgtaacgtacgggtttaaccggttaccggaaccggggttaaacggtaaaccgggtaacggggttaaaccgtaacggtaaaaccggttaaccgggtaaagtaccggttaaccgggtaacgtaacccggtaaacgtaacccggttaaccggtttacgttaacccggttttacggtttaaccttacccgttttaacccggtttacccgtaaccgttaacggtttaccccggg

SEQ ID NO: 245025 - DNA, 863 bp, Homo sapiens
  misc_feature: GYAE6OF01AV84Z.5.59.F04.1.454.CMB.1.raw
  modified_base (144)..(144): a, c, t, g, unknown or other
  misc_feature (144)..(144): n is a, c, g, or t
  modified_base (186)..(186): a, c, t, g, unknown or other
  misc_feature (186)..(186): n is a, c, g, or t
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctctgctactctggctccagatgccaccggaaanctgtgtgacgcagtctccaggcacctgtcttgctcagggaangccacctncctgcaggccagtcagtatgttaaccatggtcagctggtaccagcagaactgcaggtccagtcctcctcatctagtgtatactccaaccgaggccacgtcggctacgtacccagtaccgtacgttacgacggtgaccgaacggtccggggtacgtacgggaacgtaacggtaacccgtttacacccttcgttaaccgtaaccccgtaattacccgaacggtaccgtaacggtaaccgtacggggtaacgtaccggttaacggtaaaacggttacggtttttacgaaccttaacgggtttacgtttaaaacgtttaaccggtttaacgggtacgtaaacgggtaacgtttaaaccgggtttagttacgggttaaccgtaccgttaaccgggttaaacccgggttaacggggtttaaccccggggtaaaccggttaaaccgggggtaaaccccggttaaaacggggtttaaccggaaaaacccggttaaaccgtaaaaaaaccggttaaaccgggttacccgggttaaagggtaaccccggtaaacggttaacccggaaaccccgttaaacggttacccgtttaaccgggttttacccgttaaaccccgtttaccgttaaccccggtttttaaacccccggaaccccgtttaaccgggtttaaaccccggg

SEQ ID NO: 245026 - DNA, 639 bp, Homo sapiens
  misc_feature: GYAE6OF01E12S3.5.59.F04.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctccaggcaccctgtctttgctccgaggggaaancgccaccctctcctgcagggccagtcagaatgtaccanaggttcgagcctggtaccagacagaaacctggaccaggttcccagccctcctcatctatggtatactccaccgaggccacgtggcactcccgagacgaggttcgagtcggcaggtccgggtcgtaggggacagtaccttcacgtccacaccatccagcagacgtggacgtccgtagaagttatttacggcttaggtagttactttacgtcgttacaaggtctaaggttacgtgggtacgtcgtaccgtaccgggtaaccggttacgggaacccgtaaagggtaacccgaaagggttaacgggaaacgtaaccgaaaccggtacgttaggtaccggtacgtcgtaaccacctacgttccttacgttccttacctaccgtttacccttccccgtctacgttaccgg

SEQ ID NO: 245027 - DNA, 891 bp, Homo sapiens
  misc_feature: GYAE6OF01CW5MZ.5.59.F04.1.454.CMB.1.raw
  modified_base (148)..(148): a, c, t, g, unknown or other
  misc_feature (148)..(148): n is a, c, g, or t
  modified_base (199)..(199): a, c, t, g, unknown or other
  misc_feature (199)..(199): n is a, c, g, or t
  modified_base (874)..(874): a, c, t, g, unknown or other
  misc_feature (874)..(874): n is a, c, g, or t
tcagatcagacacgcacgaccggtgctcgatttagtacacacacttagggattggggtgctcagttaggacccagagggaaccataggaaaccccagcgcagcttctcttcctcctgctactctggctcccagatcgccaaccggaanactgtgttgacgcagtctcgagccaccttgtctttgtctacgaagggaacncgcccacctctctgcgacggccagcgaagtaacgttcgttaaccaagtacggttcgtaacgtcccgttacggtaaccagaccgaaaggtaaacccgtcgggacccgtacggttccccagtcccccttaccgtactacgttccttaagtcggttaactacctaccccgtaaaccggtacgggaccctaaccggttcggaaccctaaccgttacccgaacggtaaacgttccgggtttaacgacgggttacggaccggtaaccggggttccggggttacggtaacggggaacctaaccggtacctttaccacctttaaccgacctaacccgacttaccggaaacggcgtaacgtaaccggttggaaccgttaccgtaaagttaaggttttactttacgggaacgtttaggttaaactttaacccgtttgacggttaaacgaggttaacccggagtttacggttaacggtccgtaaccggtttaacggtaaccgggggtttacgtaccccggggaaaaccgggtaaagggtaaaccccgggttaaaaggtaaaccgggtaactaaaaccgggttaaaaacggttcggtcgggttaacgacccggttaaatacccgaacggtttacgtgggttttaccctaaccgtttacccttaaccccgggttcccctttaaacccncggtttaacttcccggg

SEQ ID NO: 245028 - DNA, 746 bp, Homo sapiens
  misc_feature: GYAE6OF01A335B.5.59.F04.1.454.CMB.1.raw
  modified_base (133)..(133): a, c, t, g, unknown or other
  misc_feature (133)..(133): n is a, c, g, or t
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagntgccacggaagctgtgtgacgcagtcctcaggccaccctgtctttgctccgaaggggaactcncccgaccctgtaccctgccgacgggccagtccaagtaacttcggttaaccaaacgtgggttcgtacgcccgttagggtacccaggacctaaggaaacccgtggaccctagggttccccaggtccccttaccgtcaacttcgtaagttggtactactcccgacgacggtccacgtaggcactccgaagtacgaggttcgagtcgacggtcggtccggggtcgtacggggacacggtaccttccgaacttccgtacctaaccggtacttaccggacggaccgaacgggtaaccgttggggaccgttacccgaagtaaccggttttagtttccggacgtaggtttaccgttaaacgttcctaacggtcgtaacgcgttaaggtgttcggtaggccttacggacggttaccggtaccggacccggtaaagggtacccgtaaggtaacggaaaccgttaccgaaaccggttcgtacgggtccgtaaaccgtcggtaccgtacctaaggtttctacgttaccgtcctacgggtttcccaccggttactacgtccgg

SEQ ID NO: 245029 - DNA, 736 bp, Homo sapiens
  misc_feature: GYAE6OF01BSL58.5.59.F04.1.454.CMB.1.raw
  modified_base (133)..(133): a, c, t, g, unknown or other
  misc_feature (133)..(133): n is a, c, g, or t
  modified_base (146)..(146): a, c, t, g, unknown or other
  misc_feature (146)..(146): n is a, c, g, or t
  modified_base (164)..(164): a, c, t, g, unknown or other
  misc_feature (164)..(164): n is a, c, g, or t
  modified_base (202)..(202): a, c, t, g, unknown or other
  misc_feature (202)..(202): n is a, c, g, or t
tcagatcagacacgcacgaccggtgctcgatttagtacacacactttaggggattggggtgctcagttaggacccagagggaaccatggaaaccccagcgcagcttctcttcctcctgctactctggctccanatgccacggaaanctgtgttcacgcagtccnccaggccaccctgttctttgtcctaccgaaggggtaanagcccaccctctccgtcgcgacggccagtcaagactcgtaaccaaacgtggttcgacgccttggtaccagacaacgtaaaccgtcggaccctacggttcccctacggacccttcccgtactaacttctacgtcgggtaactaccttccgaccgagggtcccacttcggcctacgtcccgaagccgtagttaccgaggtacgcgtcgtacggtcggtacgtacggacacgtactccgtacgtcacacgactacgtacgctacgtcgtaacgtacgtacgtaacgtacggtttactacgttacgttacggtactttacgttaccgtaacgttagacgtaacgtacgtacggttacgtaccgtacggtaccggtaccggttccggtacgggtaaccggaacggtaaccggtaaggggtaacctaaagggtaacccggaacgtacggttacggagttaccggtacccgtaactccggttaccgttacgtaccctttaccggtaccgttacccttaccgttcccgtaactttccccggg

SEQ ID NO: 245030 - DNA, 859 bp, Homo sapiens
  misc_feature: GYAE6OF01AP397.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctctgctactctggctccagatcgaccgacggaaagtcgtgttcgttagaccgcacgtcgtaccgaggtccctacccgttgttactttcgtacctaccggaaggggaaacaccgccctacccttcgttcccgtaggccgaacggggcctaaggttaccaagtaacgttacggtaacccaacggtacgggtttaccgcggtacccgtacgggtacccaaggtacctaaaccggaaccgttaccgggtacccgttaacccgggttaccccgacgtccccttacccttacgtacctttacgtacgtttacggttaacctacccgtaccccgaaccggacggtcccttaacggtccggtaccctaaccggtaacccgaggtaccggttaggttaacggacggttcgggaccgtacggggttccggtacggtaggtaaccgtcggttaccttccgtaccttaccgtaccgaccgtactaccgtacacggtaacggcgtacggtacgtccgttaaggtacgttagttacgtacgttaacgttacgtttaacgtacgttcgtacgtacgacgtttagtagtcggtacgtaccgtacggtaccggtacggtaccggtaacggtaacgggtaactaacgggtaacgaacgtaaccgtacggtagtcggtaccgtcgtaaccgtacgtacccgttagttaccgttacgtttaccgttaccgttaccgttaccccggttacttaccgttcgttaacccgg

SEQ ID NO: 245031 - DNA, 725 bp, Homo sapiens
  misc_feature: GYAE6OF01AE6J1.5.59.F04.1.454.CMB.1.raw
  modified_base (154)..(154): a, c, t, g, unknown or other
  misc_feature (154)..(154): n is a, c, g, or t
  modified_base (169)..(169): a, c, t, g, unknown or other
  misc_feature (169)..(169): n is a, c, g, or t
  modified_base (191)..(191): a, c, t, g, unknown or other
  misc_feature (191)..(191): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgaccacggaagactgtgtnacgcagtctccagcncctgtcttgctccgagggaaancgccaccctctctgcgaggccagtcagaacttcgttaaccaacgtacggttcgtacgcctaggtaccagacaacggaaaccgttcggcctaccggttacccacgtcctcctactacttacgtagttcggtaataccgtacccgtaccggaacgggccctaactcgggacaacctacccacggaactcggttagacggttggacctagggccggtacgtcgggaacacgtaccgttccacctcgttacaaccgtactccgaacgtacacggtaccgttcgggactaccggtaagtaacgttcgttttaggccgtaaggtttacttaagttaaccggtcgtaacgtacaccgtaagttaccggttaggtaccgtcgttaacggaaccggttacggttccggaaccggaaacggggtaccgtaaagggtaacggaaactaaaccggtaaacgggtactacgggttcgaccgtacgttacgaactacgttccgtcgttacctactacccgttactacccggttccgtaagtttcccgg

SEQ ID NO: 245032 - DNA, 806 bp, Homo sapiens
  misc_feature: GYAE6OF01BAGO8.5.59.F04.1.454.CMB.1.raw
  modified_base (191)..(191): a, c, t, g, unknown or other
  misc_feature (191)..(191): n is a, c, g, or t
  modified_base (707)..(707): a, c, t, g, unknown or other
  misc_feature (707)..(707): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagactgtgttgacgcagtctcaggcacctgtcttgtctcgagggaaancgccaccctctcctgcgagggccagtacgagaactcggttaaccaagtacggttcgtagtccgtaggtaccagacgaacgtaaaccgtcggaccgtacggttacccacggtcccttaccacgtacttacgttaacggttacggttaacttaccgtaccccggaaccgtaccggggtaccctaccggtcggtacctaacccgttcccaaggtaccgtacggttaccgtaaggtcgacgtagggtccggtacgttacggggactacgtacccgtttcgtaaccctccgtaaccctaaccgtaacgtaccgaagaccgtaacggtaccggtttacgggaccgtacgttaagggtaacgtttaacgtttcggtacgtagttacgttaacgttcgtacgtccttaagaccttaagttagtcggttaacgaccgttaccgggtaacgggtaccggtaccggtaaccgaaccgggtaacgtaacgggtaaggtaaaccgaaccgtaaaggtcgtaccgggtanaccgggtactaccgggaaccttacggtacccgtttaaccgggttaccttacccggtaccgttaccccgttttacccgtaaacccgtcgtttaacccggg

SEQ ID NO: 245033 - DNA, 801 bp, Homo sapiens
  misc_feature: GYAE6OF01DLGOF.5.59.F04.1.454.CMB.1.raw
  modified_base (59)..(59): a, c, t, g, unknown or other
  misc_feature (59)..(59): n is a, c, g, or t
  modified_base (161)..(161): a, c, t, g, unknown or other
  misc_feature (161)..(161): n is a, c, g, or t
  modified_base (197)..(197): a, c, t, g, unknown or other
  misc_feature (197)..(197): n is a, c, g, or t
  modified_base (384)..(384): a, c, t, g, unknown or other
  misc_feature (384)..(384): n is a, c, g, or t
tcagatcagacacgcacgaccggtgctcgatttagtacacacacttagggattggggtnctcagttaggacccagagggaaccatggaaacccagcgcagcttctcttcctcctgctactctggcctccagatcgccaaccggaaagactgtgttagacgnagtctccagctacctgtcttgtactcgaaggggaancgcctaacctctcctgcgagggccagtcaagaacttcggtaacaacgtaggtcgtacgcctaggtaccatcgaaagtaaacctgggaccacggttcccaacgccttcctaccaattctaagttggtaacttactacccgaaccgagggcccaacgtcggacctacgtacccaggtaactacggttanaacggtacggacagggtaccgggttcgtacggggaactacggtaacctttcaaaccttcggaaccaacctaagtacccgaagactacggtactacggggaactaccgtaggaaagttgttttacgagttacgttaagttaatttacggtatcgtaaacgtacgttaaggttaagtacggggaacgttcctaacgggtaaacccgggtcggtttaaccgggaacccggaaaccggggtaaccggttaaaggttaagggtaaacccgttaaaacgggtaaaaaccggtaacggtttaccgggtaacgggtaccggttaaacgtaaccccggtaacttaaaccggttttacctaaccgggtttttacctacgttaaacccgtttacccccgtttaacccgtacgtaaacccgtttaccgg

SEQ ID NO: 245034 - DNA, 212 bp, Homo sapiens
  misc_feature: GYAE6OF01CFVJP.5.59.F04.1.454.CMB.1.raw
  modified_base (131)..(131): a, c, t, g, unknown or other
  misc_feature (131)..(131): n is a, c, g, or t
  modified_base (199)..(212): a, c, t, g, unknown or other
  misc_feature (199)..(212): n is a, c, g, or t
tcagatcagacacgcacgaccggtgctcgatttagtacacacacttagggattgggcacggtgggcatgtgtgagttttgtcacaagatttgggctcaactttcttgtccaccttggtgttgctgggcacngcggccctgggctgcctggtcaaggctacttcccgtgtctgatctgagcgggctggcaggcgcatagnnnnnnnnnnnnnn

SEQ ID NO: 245035 - DNA, 762 bp, Homo sapiens
  misc_feature: GYAE6OF01A0BAA.5.59.F04.1.454.CMB.1.raw
  modified_base (294)..(294): a, c, t, g, unknown or other
  misc_feature (294)..(294): n is a, c, g, or t
  modified_base (604)..(604): a, c, t, g, unknown or other
  misc_feature (604)..(604): n is a, c, g, or t
  modified_base (743)..(743): a, c, t, g, unknown or other
  misc_feature (743)..(743): n is a, c, g, or t
  modified_base (755)..(755): a, c, t, g, unknown or other
  misc_feature (755)..(755): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgccaccggaaagactgtgttgacgcagtctccaggccacccttgttctttgtcctaccgaaggggtaaacacgccccacccttctcctagccgacgggccagtaccaaggtaattcgttaaccaacgtacggtttaccgtacgccgtacggtaacccgngtaccaacggtaaaccgttcggacccgttaacggttcccccacgtccccttaccctactaacttccgttaagttcggtaactacctaccccggaccggacggggtaccctacggtaggaccctaaccgtccccggtaagaccggtacggtttcgaacggttcggaccggtacgggtccgggggttaccgtaggggaaccctaggtacccttcctacgtaccctaccaacctgtaccgaagccaaaggtccgtaggacctcgttaagtaactttgttacgaccgttagttacttaggttacttcgtaaccnggttaccgtaaggttggtcggtacctacgtacggtaccggtacggtacccggaacgtaacgggtaacgtacggaaactaacggtaccgaaagtaccggtgtaacggctaccggtactaccggttatcgtcttcttaacnccgtaccctcgnttcgtcg

SEQ ID NO: 245036 - DNA, 1127 bp, Homo sapiens
  misc_feature: GYAE6OF01B566U.5.59.F04.1.454.CMB.1.raw
  modified_base (199)..(199): a, c, t, g, unknown or other
  misc_feature (199)..(199): n is a, c, g, or t
tcagatcagacacgcacgaccggtgctcgatttagtacacacacttagggattggggtgctcagttaggacccagagggaaccatggaaaccccagcgcagcttctcttcctcctgctactctgctccagatgccaccggaaagctggtgttggacgcagtctccaggcaccctgttctttgtcctccgaaggggaaanacgcccacctcctaccgtgcgacgggcctagtcaagtaacttcgttaaaccaacgtacgggttacgtaccgccgtaagggtaccagtacgaacgtaaaccctcgggaccctaacgggttccccacgtcccgttaccctaccgtaacttccgtttaacgttacgggttaacttaaccgttaccccggaaaccccgtaaccgggggtaccccgtaacccgttacgggggacccctaaccgttcccccggaaaacggtaaccggtaccgggtttaccgtaacggggttaccgggtacgtaccgggggttaccgggggttccggtacggggggtaacccgtacggttaaccgttttacccggtaaacccggttaccccttaaccccgtaacccgggttaaacttttaccccggaaacggtacccggttaaaaccggggacccgtttaacgggggggtaaccggtaccccggtttaaaacggggtttaaacggttttaacccggttttttaaggggaaaccccgtttaaggggttttaacccggtttaaaaccgtttttaaccgggtttaaccggtttacccgttaaaacggggttaaccccgttaaggggttttaaccgggtttaacggggtttaacccggtttaaccgggtttaaccccgggttaaccgggggtttaaccccgggttaacccggttaaacccggggggtaaaacccggggttaaacccggggttaaaacgggggttaacccggggtaaaacggggtttaaacccgtaaaaaaccgggggtttaccgttaaaccggggttaccgggtaaccgtttacccgggtaaccgtaaacccgtttaccggtttaacccgttacggttccgtttaaccccgttaccgtttacccccttaccccggtaaccccgtttagtttaccccggg

SEQ ID NO: 245037 - DNA, 716 bp, Homo sapiens
  misc_feature: GYAE6OF01EXEHL.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccaggccaccctgtctttgtcctccgaggggaagacgcccaccctctcctgcgacgggccagtcagaatcgttaaccaacgtacggttccgtacgtccgtggtaccagtacaagaaacctcggacccgtacggttaccccacgtcccttacctaccacgttcttacgttacggttaacttaccgtaccccaccggacggggtacccaccggttacgggaccctaaccgtccccgaagtaccgtacggtttaccgaggtaccgggcgtacgggtcgggttacgtacggggactaggtaccttacgaccttctaccactacgacgaagccgaaggtacgtcgggtacgtacccggttaggtaacgttacgttttacgacgttaggtttacgttatttacgttgtacgtacgtacgtagttaggtgtacgtcgtacgtaccggtacgtaccggaacggaacggacgtacgggtaagtaacgtaacgaacgtacgtgtacggtcgtacgactacgtcttacgtacttcgttacctaccttcctcccgccttcgtacg

SEQ ID NO: 245038 - DNA, 823 bp, Homo sapiens
  misc_feature: GYAE6OF01BS4D0.5.59.F04.1.454.CMB.1.raw
  modified_base (813)..(813): a, c, t, g, unknown or other
  misc_feature (813)..(813): n is a, c, g, or t
tcagatcagacacgcacgaccggtgctcgatttagtacacacacttagggattgggggtgctcagttaggacccagagggaaccatggaaaccccagcgcagcttctccttcctcctgctactctggcctcccagatcgccgaaccggaaagactgtgttagacgctagtcctcacggaccacccttgttctttacggtcctacccggaaagggggaaacgaccgccctaccccttcctccgtacgccggacgggaccaacgtactaaggtaacgttaccgttaaccgaaccggttacgggttaccggtaccgttacccgtacgggtaaccgacggaaccgtaaaccggtaaacccggtccgggtacccgtacccggttaccccgacgtccccttccaccttaccttacgttaacgttacgttaacctaaccgtacccccgaccggtacccgggaccctaaccgtcggaccctaccgtaccccgaagtaaccggttcggttaacgaggtaccggcgggtacgggtacggttcgggaacggtaccagttacccttcctaaccttccgtaaccacgtacgaccgacgtaacgacggtacgtacgggacctacggttaaggtacgttacgttacgacggttaattacgtaccttagtccaaggtacggtactaggtcgttacggacgtccgtacgggtaacggtccggtaaccgaccgggtaaacgggtaacgaacggtataacgaacgaacggtagtccgtaacgtcaacgtacctaccgtacgtcttacgtcccttagtcccttaccgtacccncgttgtcccg

SEQ ID NO: 245039 - DNA, 875 bp, Homo sapiens
  misc_feature: GYAE6OF01BESSH.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgttctttgtctccgaggggaaagacgccaccctctcctgcgacgggccagtcaagtaattcgttaacccaacgtacgggtttacgtacgtcccgtagggtaacccaggaccaaacggtaaaaccctcgggaccctaacgggtttaccccaacgtccccttcctcattcgtatggtaactactcccgaaccgacgggtaccaaccgtcggaccacctaccccgaaggtaaccgtacggtttcgaggtcgggcgacgggtccggggttcgtacgggaacacggtaccttccgacgttccctaccgaacctacgtacgacgtaccgacggttacgtcggggaaccgtcccggttaaggtaaaccggttttactttttagggaaccgttaaggttttacggtttaaactttaccggtttagggtaaccgtaaacggttaccgttaaaggtttcggttaacgggttacggtacccggtttaccgggtaacccgggttaacccgggtttacccgggaaacccgggtaaaccggggtaaccggttaaacgggggtaaccggttaaaacggtaacccgtaaaacgggttaaaccggtttgggtacccggggtacgtaacccggtaccccgtaaccgttacgttcccgttacgttacccggtttacctaacccgtttcccgtttacccccgacgtttacgttacccgg

SEQ ID NO: 245040 - DNA, 871 bp, Homo sapiens
  misc_feature: GYAE6OF01EZU0U.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggcctcccagatgcccgaaccggaaagtacgtgtgttgacgcgagtctccgaggccgacccttgttctttcgtcctaccgaaggggaaagtacgtacctaccccttccgtccgtacgcggaaccgggaccgagtacgaacgtaaacgttacggttaaaccctaaaccgttaacggttacggttaccgtacccgtaacggtaaccgaggtaccgaaacgtaaacccgtaccggtacccgtaaccggtttaccccaaccgtcccgttaccctacctattacttaacggttagttaaccttaacctacccgaaccggccgggtacctacgtcggtaccaccgtacccgaagtacgttaggttacgaggtcgggacgtcggtcgggtcgacggtaacgacgttaccgtacctacgtacccaccacctacgtacgacgcgacgtacgtacgggactaccgtagttaagttacgtttagtacttaaggttactttacgttacgtacgttacgaacggttagtacggttaagttaccgggtactaccggtaccggtaaaccggggttcccgggtaacccggaaaccggggtaaacggaaccggttaaacgggtaaaccggtaaaccgtaaacgttaaacgggtaacggttaccgggttacgtaacgtaccgtaaccccttaaagccgttttaacgtcccgtttaacgttaccctttacccgttaaccccgtttacggcccgtttaacgtacccgg

SEQ ID NO: 245041 - DNA, 808 bp, Homo sapiens
  misc_feature: GYAE6OF01D326F.5.59.F04.1.454.CMB.1.raw
  modified_base (800)..(800): a, c, t, g, unknown or other
  misc_feature (800)..(800): n is a, c, g, or t
tcagatcagacacgcacgaccggtgctcgatttagtacacacacttagggattggggtgctcagttaggaccagagggaaccatggaaaccccagcgcagcttctcttcctcctgctactcgtcggctcccagatcgccgaaccggaaagactggtgttcgacgcagtcctccgaagcctacccgttgttctttcgtctaccggaaggggaaacacgccctaccctctaccgtcgacgacgggcctagtaccaagtaacgttacgttaaaccgaacgtacggttcgtacgtccgtacggtaccgacgacgaacgtaaccgtggaaccctacggttacccagttcccttacctactacttaccgtaagttacggtaaccttacgtaccccgtaaccggacgggtaccctacggtacggtaccaccggtaccctaaaggtaacccgtacggtttacggacggttaccgggtaccgtacgggttccggggttccggaaggggtacctacgggttaccttaccgtaacctcccttaccgaaaccgtagtaccgcgaacgtaccggtagtacggaccgtaaccgtaaggttaaacgtttgttaacggcttaaggttactttaacgttaccgtgtaacgtacgtagttagtacggttaacgtcgtccgtaacggaaccggttacgggtaaccgaacggggtaaacggtacgtaaagggtaacaacggttaaccaaacggtagtcggtacggttcaaccggtactaacgtcttaacggttctaaccgttctaagtcccctaccgtcncggttaac

SEQ ID NO: 245042 - DNA, 798 bp, Homo sapiens
  misc_feature: GYAE6OF01BE806.5.59.F04.1.454.CMB.1.raw
  modified_base (604)..(604): a, c, t, g, unknown or other
  misc_feature (604)..(604): n is a, c, g, or t
tcagatcagacacgcacgaccggtgctcgatttagtacacacacttagggattggggtgctcagttaggacccagagggaaccatggaaaccccagcgcagccttctcttcctcctgctactctggcctcccagatcgaccgaaccggaaagacgtgtgttgacgctagtctaccgaggtaccacccgtgttctttcgtcctaccggaagggggaaaactcgacccctacccgttcctaccgtacgaccgaacgggccagttaccaagtaacttcggttaacccaagtacgggtttacgtacgccgttacggtaaccaggaccaacggtaaccgtcgggacccttacgggttccccaagtcccttcctatacttacgtacgtggtaacttcctacccgaacgtacgggacctacgtcggacacctaccgacggtactaggttaccaggttcgacgtacgggtccggtacgtacgggaacctacgttaccttaccaccggttacctaccgaacctaagtccgaacgtacgaccgtaacgtacgggactaccgttaagtaaccgtttgtttgaccggttagtttacgtaacctttcgacggtaacncgtaacggtagttacgttacggtaacgtccgttaacgggtacggttaacccggttacggaaccgttaacgggaacttaaacgggaacgttaaacgtaccgtaaaccggttacgtagggtaaccgcggtacctaaccgtactacgtttcgtacgttacgttaacctcccgttaccgtccccgaatcggtttaccg

SEQ ID NO: 245043 - DNA, 707 bp, Homo sapiens
  misc_feature: GYAE6OF01EB8KS.5.59.F04.1.454.CMB.1.raw
  modified_base (213)..(213): a, c, t, g, unknown or other
  misc_feature (213)..(213): n is a, c, g, or t
  modified_base (539)..(539): a, c, t, g, unknown or other
  misc_feature (539)..(539): n is a, c, g, or t
  modified_base (652)..(652): a, c, t, g, unknown or other
  misc_feature (652)..(652): n is a, c, g, or t
tcagatcagacacgcacgaccggtgctcgatttagtacacacacttagggattggggtgctcagttaggacccagagggaaccatggaaaccccagcgcagcttctcttcctcctgctactcgtggcctcccagatcgcccaaccggaaagtctgttgttgacgcagtcctccgaggccacccttgttctttcgtcctaccggaaggggaaancgccctaccccttctccgtggccgacgggcctagtacaagtaacttacgttaaccaacgtacggttcgtacgtccgttacggtaccaggacctaacggaaaccgtcggaccgttaccgggttcccacgtcccttacctctaacttctagttcggtaacttaccgtaccccgaacgacgggtaccctaacggtcggacctaaccgtcccgaaggtaacgttacggttcgaggtcggacgtacgggtcgggtacgacgggactacgtaccttccgactctaccaactacgtcgaagacgtacgtacgacggtacacgtagtaacgttntttacggagttagttacgttacttcgtacgtatacgtacgttagtcgtggacttcggacgacgttaccggacgacggaacgggtatacgggaataacggactaaggcgtcggngacgtctactaacgtgttcctagttccctactacttccccgacgtcttacgtccg

SEQ ID NO: 245044 - DNA, 887 bp, Homo sapiens
  misc_feature: GYAE6OF01C84JA.5.59.F04.1.454.CMB.1.raw
  modified_base (131)..(131): a, c, t, g, unknown or other
  misc_feature (131)..(131): n is a, c, g, or t
  modified_base (210)..(210): a, c, t, g, unknown or other
  misc_feature (210)..(210): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccanatgccacggaaagtactgtgttgacgcacgtcctccgaggccacccgttgttactttcgtactaccggaaggggaaacnccgccctacccttctcgcgacggacggtccagtacgaagtaacgttacgtaaaccgaacgtacgggttacgtacgtccggtacgtaccgacggactaaacgaaccgttcggaccgtaccggttacccaccgtccccttacgtactacgttacgttacgttaacggtacttaccgtccccgaaaccgggacgggtaccctaacggtcggtaacctaacccgtacccggtaaacgtacggtttacgggttacggaccgggttaccggacgggtacccggggttacggggtacggtaccgggtaaaccgtaccgtttaacgttacccgttaaccttcccgtaacccgtaacttccgtaaaccggtacggaacccgttaacgggtaccgtaacgggtccggttaaccgttaagtttaacgtttacggttttaccgaaggtttaccggtttaagtttaacccgtttaaggtccgttaacggtaggttaaccgtaggtttacgggtacgtttaccggaccgttacccggggacgttaaccgggtaccgaaccgggtaaagggtaaccgtaagggtaaaccaacggttaaccgaacggtcgttacgggaccgttaacgacgttacccacgtttcgtcgttaccgttcttaaccctacgttccccgtacccgtattcccggtacg

SEQ ID NO: 245045 - DNA, 867 bp, Homo sapiens
  misc_feature: GYAE6OF01AH6SP.5.59.F04.1.454.CMB.1.raw
  modified_base (106)..(106): a, c, t, g, unknown or other
  misc_feature (106)..(106): n is a, c, g, or t
  modified_base (159)..(159): a, c, t, g, unknown or other
  misc_feature (159)..(159): n is a, c, g, or t
  modified_base (166)..(166): a, c, t, g, unknown or other
  misc_feature (166)..(166): n is a, c, g, or t
  modified_base (860)..(860): a, c, t, g, unknown or other
  misc_feature (860)..(860): n is a, c, g, or t
tcagatcagacacgcacgaccggtgctcgatttagtacacacacttagggattggggtgctcagttaggacccagagggaaccatggaaaccccagcgcagcttcncttcctcctgctactctggcctcccagatcgccgaccgaaagctgtgttgacncagtccncaggccacctgtcttcgtctaccgaaggggaaatcgccctaccgtctcctcgacgaagggtcccaacgtacgaagtaaacgttcggttaaaccaaacgttacggggttcgtaaccggtcctaagggttaacccgtaacggaacctaaacggtaaacccggtccgggtccgaaccgggtttccccaaggtccccttacccttacggtacctttcgtaaacgttcggttaatacccgtacccctaacggtccggggacccctaacgtcggacctaacctccccgtaaggaccgtacgggtttacgaaggttcgggactccgggtacgggtacggttccggggaaacaaccgttccgttacgtaccccgttacccttcgaaacccgttgtaacccgacgaacccggtggaaccgtttacgggacgttacccggttaaggtaaccgttgttttacgacgtttaacggttacgttaactttaacgtcggttacgaaggtacctagggtttaaccgtacggttacggcccgttaacggtaaacccgggttccgggtttaaccgggtaaacccggtaacggggtaacggtaaccggttaaaccgggtaactaaaccggtaacggtaactcggggtttaagcccgttacgaaccacgttacggttcgttaccttctccgttacggttaccctcggttaaccncgttcgg

SEQ ID NO: 245046 - DNA, 871 bp, Homo sapiens
  misc_feature: GYAE6OF01CGDE8.5.59.F04.1.454.CMB.1.raw
  modified_base (203)..(203): a, c, t, g, unknown or other
  misc_feature (203)..(203): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatcgccaaccggaaagactgtgttgacgcagtctcgaggccacctgttctttgctaccgaaggggaaacncgccctaccctctcctacggcgacgggacctaggtacaagtaaacttaccgttaaacccaaacgttaacgggtttccgtaacggtcccgttacggggaaaccacggaccgaaacgtaaaccggtcggaccgtacggttacccacgtcccttacctactaattaccgtagttacggttactaaccttacccgaaccggtaacgggccctaacgtcggacctacgtacccagtaccgtaacggttcaggttcggacgtacggtcggggtcgtagggactacggttacctactaacttccgtaccgaaccctagtaccgaacggcgtaaaggtccggtaacgggacgtacccgtaaggtaaggtttagtttacggtagttaacggtttacgtttaacgtttacccgttaggttaccgtaaggtaccgttaaggttaacgtcgggttaacgtaccgttaccggtaacggttaaccggttaacccggtaaaccgggtaaccgggtaaaccgtaaacgggttaaacggtaaacgtaaaccgggaaaacgttaaccggttaacggtaaccggtaccgttaaccggtaaccctaacggttaaccgtttaccggttcgtttaacccgttccgttaaaaccgtttccccgttaccccgttacgtaccggtttacccgg

SEQ ID NO: 245047 - DNA, 865 bp, Homo sapiens
  misc_feature: GYAE6OF01DOATO.5.59.F04.1.454.CMB.1.raw
  modified_base (203)..(203): a, c, t, g, unknown or other
  misc_feature (203)..(203): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatcgccaaccgggaaagactgtgttgacgcagtctccaggcacccttgtctttgtctccgaaggggaaanacgccctaccctctcctgcgagggccagtcaagaactgttaaccaacgtaggttcgtagccttgggaaccagcaaagaaacccgtggaccctacgggttcccacggtcccttacctactatccgtaattcgggtaacttacgtacccaaccggaacggggtccctacggtcggacctaacctcccgaaggtaaccgtacgggttacaggttcggacgacgggtccggggtcgtagggaacaacggtacctttcgaaccttccgtaccaacccagttaccaacggtactaacggtaaccgttggggaaccgtaccgttaggaaagtttcgttttacgacgttacgttaacgttaactttaccgttacgtacggtaacgtaacgtaggttaacggtttcggtaacggttaccgttacggtaaaccggggttacccgggtttaaccccggggaaaccgggtaaaccgggggtaaaaccgtaaacggggttaacgggtaaaaccgtaaaccggttaaaaaccccggtaacgggttacgggttaccgggtaaccgttaaccgggtaaccctaacccggtttacgtaaccggttttcccgtttaacccggtttaccttaaacccgttttccccgttttaacccccccgcgtttaaccgtttacccggg

SEQ ID NO: 245048 - DNA, 743 bp, Homo sapiens
  misc_feature: GYAE6OF01E355E.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggccaccctgttctttgtctccgaggggaaancgccaccctctcctgcgacgggccagtcaaggtaacttcgttaacccaagtacgggttccgtaacgcccgttaggtaacccaggaccaacggaaacctcggcccgtacggttccccacgtccctccgtcattctagtggtaactacgtccgaccggacggcctaacgtcggaccactacccaagtaccgtacgttcgacgtgggcgacgggtcgggtcgaggaactacgtaccttaccaccgttcctaaccgaacctacgtacgacggacgacggtaccgtagggtacctaccggtaaggttaacgttagtttacgacgttaggttacgttacttaccgttgacgtagtacgtaacggttacggtacgtacgtccgttacggaaccgggttaccggttaaccggacggtaaaccgggaacggtaacgggtaaacgtaaacgtaaccgtaaacggacgttaccgggtacgtacgtacgacccgtaacgttcgtaccgttcggtttaccctacgttacccttcccggttcccacccgttcgttaccg

SEQ ID NO: 245049 - DNA, 929 bp, Homo sapiens
  misc_feature: GYAE6OF01AZT72.5.59.F04.1.454.CMB.1.raw
  modified_base (234)..(234): a, c, t, g, unknown or other
  misc_feature (234)..(234): n is a, c, g, or t
  modified_base (883)..(883): a, c, t, g, unknown or other
  misc_feature (883)..(883): n is a, c, g, or t
tcagatcagacacgcacgaccggtgctcgatttagtacacacacttagggattggggtgctcagttaggacccagagggaaccatcggaaaccccagcgcagtcttctcttcctcctgcctactcgtggcctcccagatcgaccgaaccggaagacttggtgtacgaacgcacgtcctccgaaggtcctacccttgttccgtttcggtacccttaccggaaaggggggtaaacnccgtaccccgtacccttccgtacccgtggaccgggacgggaccctacgttacgaaggtaaccgtttcggttaaccaacggttacgggtttaccgtaacgggccctttaacgggtaacccaggttaaccgaacgggtaaaccccgtgggtacccgtacggttttaccccgaaccgtcctttacccacttaagtcttaaccggttaggtaccttacgtaacccccggacgtaacggggaccctaccggttacggacctaaccggtaccccacgggtaacgttaccggggacgttaagggccgggccggtaccgggttaccgggggttacaaccggggtaacgtacgtaaccctttacccgaccggttaccttacccggggaaaactctaccgggggaaacctttacggacgggtttaaaccggttcggggaccttaccggtaaggttaaccgggtttaacgtttcggtacggtaaccggtttcgtttaacggtaccgttagggtaccggtacggtaacgtttacggtaacggttcggtaaaccgtccggtaaccggttcccggttacggtaccgggtaacgtaccgggttaaccgaaacggtacgtaaacgacgttaaacggtccgaggtccgtacgtaccgtaaccggtntaccgttcggttataccgttctaacgccgtacccgtattcggtacg

SEQ ID NO: 245050 - DNA, 904 bp, Homo sapiens
  misc_feature: GYAE6OF01BG0IG.5.59.F04.1.454.CMB.1.raw
  modified_base (227)..(227): a, c, t, g, unknown or other
  misc_feature (227)..(227): n is a, c, g, or t
  modified_base (409)..(409): a, c, t, g, unknown or other
  misc_feature (409)..(409): n is a, c, g, or t
  modified_base (589)..(589): a, c, t, g, unknown or other
  misc_feature (589)..(589): n is a, c, g, or t
tcagatcagacacgcacgaccggtgctcgatttagtacacacacttagggattggggtgctcagttaggacccagagggaaccatggaaaccccagcgcagcttctcttcctcctgctactctgcctccagatcgaccgaaccggaaagtacttgtgttacgacgcagtcctccaggccctacccgttgttcttttcgtacccgttaccggaagggggaaaacgccncccccgtaccccttccttcccgtcggccggtaacggggccctacggtaccaaggtaactttacgttaacccgaaacggttacggtttccggtacggtcccgttacggtaaccgtacgaaccgtaacggaaaccccgttcggaccccgttaacgggttaccccctaacgttcccctttaaccncttacttacgttaacgttaggttaacctacccgtacccgaaacccggtacgggtccctaaccggcggtaccctaaccgtaccccggaagtaccggtaggtttacgacgggtcgacggtaccgggtcggggttacgtacggaaccgttagttaccctacgtaccttacctaccaacccgtnttacccgacgaccgtaaggtacccggtaacgggtaccgtacggttaaacggttaagtttccggtttaacgttaccgtagttttacttacgtttacgttcgtacgtacgttacggtagtttaggtcgttaccgtaccggttaaccgtcgggtaaccgtaccgggtaacgtaaaccgggtacgtaaacggtaagtaaccggaacttaaccggtacgtacggtccggtaacgtacccgttacctacggtacccttttacgttaccggttacctttaacccgttcccgtttacccgtccccttacgtcctttaaccggg

SEQ ID NO: 245051 - DNA, 668 bp, Homo sapiens
  misc_feature: GYAE6OF01A3KDY.5.59.F04.1.454.CMB.1.raw
  modified_base (201)..(201): a, c, t, g, unknown or other
  misc_feature (201)..(201): n is a, c, g, or t
  modified_base (626)..(626): a, c, t, g, unknown or other
  misc_feature (626)..(626): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgccaaccggaaagactgtgttgacgcagtctccaggcaccctgttctttgctccgaaggggaaacncgccacccttctcctgcagggccagtcagaactgttaaccaataggttcgtacgcctagggtaccagaccaagaacctggaccctacggttcccaggtccctcctcattctagtggtatactccgaccgtacgggcctacgtcggacctactccccgaagaccgtaagggtttcaggttcggacgtaacgggtccggggttacgacggggaactacggtacctttacaccgttctaccaacctatcgacgcgaaaggtacgtgggacgtcctaggtaattacgttttcgacttagtagtttaacttacgtggtactagcgtagtagttgtacgtcgtacgacggtacgtccggacgtaacgggacgtaaggtagaacgtacgaaacgtacggttagtacggtacgtacgactaactcgttacgtnttacccttacgtaccttcccgtttacccgtccgtgttacccg

SEQ ID NO: 245052 - DNA, 905 bp, Homo sapiens
  misc_feature: GYAE6OF01BF1LD.5.59.F04.1.454.CMB.1.raw
  modified_base (205)..(205): a, c, t, g, unknown or other
  misc_feature (205)..(205): n is a, c, g, or t
tcagatcagacacgcacgaccggtgctcgatttagtacacacacttagggattggggtgctcagttaggacccagagggaaccatggaaaccccagcgcagcttctcttcctcctgctactcgtgcctccagatcgaccaccggaaagctgtgtagacgcagtctcgaggtccacccttgtctttcgtcctacggaagggtaaancgccctacccgtctcccgtggaccgacgggcctaaggtacaacggtaacgttacgttaaacccgaacggttagggtttaccggtaacggtcccgttaacgggtaaccctaggaaccgtaaaaccggtaaacccggttccggggaacccgttaaccgggtttacccccgaaacggttaccccgtttacctaaccgtaacttacgttacgttaacggttaattaacccgttacccgaaccggtaacgggccctaacgtcgaccttaacgtaccccggaaggaaccgttacgggttacacgggttacggacgtaccgggtacggttcggtaacgggaacgtaccgtaacgtaccgtacccgtacgtacccgaacttaccgtacgacgtaaccgaaggttaccgacgggtaccgtaccgtaagttaacggtttacgtttacggactttaaacggttcgttaaacgttcgaacggttcaacgggtagtaacgttacgtacggttcgaaccgttcggacccggtaacggttacccgaaccgggtaaaacgggtaacggtaacggtaacggtaaaccgtaacggttaaacccggtaagggttaccgacggggttccctaacggttacccgtaaacgttacgtttacccgtacgttttaccgtaccgttaccccgttaacccggttcccgtaacgttcggttacccgg

SEQ ID NO: 245053 - DNA, 523 bp, Homo sapiens
  misc_feature: GYAE6OF02F1RKB.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttcccagcctcctcatctatggtatatccaccagggccactggcatcccagacaggttcagtggcaggcgggtctgggacagacttcactctcaccatcagcagactggagcctgaagattttgctagtgtattactgtcagctagtatggtagctcgacggacgttcggccgaagggaccgaaggtaggaaagtacgaaacgaactagtaggctgacaccatctgtcttctacttccttcccgccatcg

SEQ ID NO: 245054 - DNA, 541 bp, Homo sapiens
  misc_feature: GYAE6OF02GUDC5.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgagcctggtaccagcagaaacctggccaggttcccagcctcctcatctatggtatactccaccgagggccactggcactcccagacaggttcagtggcagcgggtctggggacagacttcactctcaccatcagcagactggagcctagaagtatttgctagtgtattactgtacagctagtatggtagctcgacggtacgttcggaccgaacgggtaccgaagggtaggaaactaacgaaacgtaacgtagtcggcgtggacaccgtatctgtacttcacttcctcccgtcctatccg

SEQ ID NO: 245055 - DNA, 595 bp, Homo sapiens
  misc_feature: GYAE6OF02F2A9P.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaacctggccaggttcccagcctctcatctatggtatatccaccaggccgactggcactccacgacgtacgttacgagtggcgaggcgggtcgtgggacgagacttctactctcaccactcacgcgacgacgtggacgactgaagtagtttgtcgagtagttattacgtcgtcgtagactagtagtagtagtctacgtacggtacggttcggtaccgaacgggtaaccgtaaggtaggtaaacgtaacgaaaccggtaacgtaggtaggacgtcggaccgaacctaacgttacgttcgttactttacgttaccgttccccgtacctacttcgtacg

SEQ ID NO: 245056 - DNA, 521 bp, Homo sapiens
  misc_feature: GYAE6OF02G3DYD.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagtattttgctagtgtattactgtcagcagtatggtagctcgacggacgttcggaccgaagggaccgaaggtaggaaatacgaaacgaacgtagtaggcgtgcacatctgtcttctactccttcccgtccatcg

SEQ ID NO: 245057 - DNA, 519 bp, Homo sapiens
  misc_feature: GYAE6OF02I5V86.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgagcctggtaccagcagaaacctggccaggttcccagcctcctcatctatggtatatccaccagggccactggcatccccagacaggttcagtggcagcgggtctgggacagacttcactctcaccatcagcagactggacgcctagaagtattttggactagtgtattactgtacagcagttatgtagctacgacggacgttcgaccgaagggaccgaaggtaggaaatacgaaacgatgtagcgtgacacatctgtacttcatcctccgtccatc

SEQ ID NO: 245058 - DNA, 522 bp, Homo sapiens
  misc_feature: GYAE6OF02IK31E.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcggtctgggacagacttcactctcacatcagcagactggagcctgaagattttgctagtgtattactgtcagcagtatgtagctcgacggtacgttcggacgaacgggaccaagggtacggaaatacgaaacgaacgtgtaggcgtgaccaccatctgtcttctactcttacccgcctatcg

SEQ ID NO: 245059 - DNA, 511 bp, Homo sapiens
  misc_feature: GYAE6OF02JE71Z.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaacctggccaggttcccagcctcctcatctatggtatatccaccagggccactggcatcccagacaggttcagtggcagcgggtctgggacagacttcactctcaccatcagcagactggagcctgagatttgctagtgtattactgtcagcagtatggtagctcacggacgttcggccgaagggaccgaaggtaggaaatacaacgaacgtgtggcgtgacaccatctgtcttcatcttcccgcctatcg

SEQ ID NO: 245060 - DNA, 518 bp, Homo sapiens
  misc_feature: GYAE6OF02JAGXH.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatccccagacaggttcagtggcagcgggtctgggacaggacttcactctcaccatcagcagactggagcctgaagattttgcagtgtattactgtcagcagtatggtagctcacggtacgttcggccgaagggaccgaaggtaggaaactacgaaacgaacgtgtaggcgtgacacatctgtcttcactctcccgccatccg

SEQ ID NO: 245061 - DNA, 745 bp, Homo sapiens
  misc_feature: GYAE6OF02FH2XD.5.59.F04.1.454.CMB.1.raw
  modified_base (158)..(158): a, c, t, g, unknown or other
  misc_feature (158)..(158): n is a, c, g, or t
  modified_base (164)..(164): a, c, t, g, unknown or other
  misc_feature (164)..(164): n is a, c, g, or t
  modified_base (181)..(181): a, c, t, g, unknown or other
  misc_feature (181)..(181): n is a, c, g, or t
  modified_base (267)..(267): a, c, t, g, unknown or other
  misc_feature (267)..(267): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagacttgtgtgacnagtccncgagccacctgttcttntcctcggaagggaagcgaccctacctctcgtcgacgacggcagtcaagtattcgtaaccaagtcggttacgacgtcgtacgtaccngacgaaacgtaaccgtcggaccgttaccggtacccacgtcccttcctactacttactaggttaggttaattaccctaccccaaccgggaccggaccctacggtcggacctaccctacccggaacgaacggttacggttacgagggtcggacgacggggtccgggttcggtacgggaacgtaacgttaccttacacccttccgtacccaacctactacgacgacgtaccgtcgtacgaccgacgtccgtagtacgtacgtacttcggttaaacgttaactttaacgttacgtaccgaaccctaaattaattaaacttaaagtttaagtttacggttacgggttaaccggtccggaaccgggtaacgggtaaaccgtaacgggttaacgtaaagtcggaacgaacgtacgttgggacgtcgtacgacctaacgtcgttcgttacgttctacgtacctttcccgccccgtactacttacgg

SEQ ID NO: 245062 - DNA, 519 bp, Homo sapiens
  misc_feature: GYAE6OF02I8S1A.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagtatttgctagtgtattactgtctagcagttagtggtagctcacggacgttcggaccgaacgggaccgaggtaggaaatacgaacgacgtgtggcgtgacacgatctgtcttctacttcctcccgtccatcg

SEQ ID NO: 245063 - DNA, 525 bp, Homo sapiens
  misc_feature: GYAE6OF02IVO0P.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttctagcctggtaccagcagaaacctggccaggttcccagcctcctcatctatggtatatccaccagggccactggcatcccagacaggttcagtggcagcgggtctgggacagacttcactctcaccatcagcagactggagctgaagatttgctagtgtattactgtcagcagtatggtagctcgacggtacgttcggaccgaagggaccgaagggtaggaaagtacgaaacgaacgtagtaggcgtgcacatcgtgttcttactacttccttcccgcctatccg

SEQ ID NO: 245064 - DNA, 539 bp, Homo sapiens
  misc_feature: GYAE6OF02GEEVM.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaacctggccaggttcccagcctcctcatctatggtatactccaccagggccactggcatcccagacaggttcagtggcaggcgggtctgggacagacttcactctcacatcagcagactggagcctagaagtatttgctagtgttattactgtctagcagtagtgtagtctacgacggacgttcggaccgaagggaccgaagggtacggaaagtacgaaacgaacgtagtaggcgtagaccaccgatctgttcttactacttccttcccgtcctatccg

SEQ ID NO: 245065 - DNA, 513 bp, Homo sapiens
  misc_feature: GYAE6OF02GDRDR.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctggggacagacttcactctcaccatcagcagactggagcctgaagattttgcagtgtattactgtcagcagtatggtagctcacggacgttcggccgaagggaccgaaggtggaaatacaaacgaactagtggcgtgcaccatctgtcttcacttctcccgtccatc

SEQ ID NO: 245066 - DNA, 526 bp, Homo sapiens
  misc_feature: GYAE6OF02JE621.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctntcctgcagggccagtcagaatgttaccggaacaggttcgtagcctggtaccagcagaacctggccaggttcccagcctctcatctatggtatatccacagggccacgtggcatcccagacaggttcagtggcagcggtctgggacagacttcactctcaccatcagcagactggacgctgaagtatttgctagtgtattactgtcagtcagtatgtagctcgacggtacgttcgacgaacgggaccgtaaggtaggaaagtacgaacgacgtagtacggcgtcgaccactactcgtagtctctactccgtccgtactagtcg

SEQ ID NO: 245067 - DNA, 570 bp, Homo sapiens
  misc_feature: GYAE6OF02IDFT2.5.59.F04.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgtctttgtctccgaggggaaangccaccctctcctgcagggccagtcagaatgttaccaanaggttcgagcctggtaccagcagaacctggccaggttcccagcctcctcatctatggtatatcccaccgagggccacgtggcactcccagactaggttcagtggcaggcggtctgggacagacttcactctcaccatcagcagactggagcctagaagtatttgctagtgtattacgtgtcagctagtagtggtagctcgacggtacgttccggaccgaacgggaaccgtaagggtacggaaacgtacgaaacgaacgtaggtaggtacgtaggtaccaccgtacttaccgttagttccttacgtacttcccgttacccgtacctacgttccg

SEQ ID NO: 245068 - DNA, 562 bp, Homo sapiens
  misc_feature: GYAE6OF02G1XOV.5.59.F04.1.454.CMB.1.raw
  modified_base (195)..(195): a, c, t, g, unknown or other
  misc_feature (195)..(195): n is a, c, g, or t
  modified_base (236)..(236): a, c, t, g, unknown or other
  misc_feature (236)..(236): n is a, c, g, or t
  modified_base (283)..(283): a, c, t, g, unknown or other
  misc_feature (283)..(283): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaangccaccctctccgtgcagggccagtcaggaatgttaccaanaggttcagcctggtaccagcagaacctggccaggttcccagcctccncatctatggtatactcccaccgagggccacgtggcatcccagacaggttcaggtggcaggcggtctgggacagacttcactctcacatcagcagactgacgctagaagtatttgactagtagttacttacgtgtactagtctaagttagtggtagctacgacggtaccgttcggaccgaacgggaccgaagggtacggaaacgtacgaacgacgtagtggtacgtcggactaccgagtcgttacgttacttcgtacttcccgttcccgaccgtactccg

SEQ ID NO: 245069 - DNA, 505 bp, Homo sapiens
  misc_feature: GYAE6OF02IY8GS.5.59.F04.1.454.CMB.1.raw
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctctcatctatggtatatccaccagggccactggcatcccagacaggttcagtggcagcggtctgggacagcttnactctcaccatcagcagactggancctgaagnttttgcagtntattactgtcagcagtatggtagctcgacggacgttcggccaagggaccaagggtggaaatacaaacgaactgtggcgtgcacatctgtcttcatcttccgccatcg

SEQ ID NO: 245070 - DNA, 550 bp, Homo sapiens
  misc_feature: GYAE6OF02JCP4D.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagtatttgtagtgtattactgtcagctagtatggtagtctcgacgggtacgttcggaccgtaaaggggaccgaagggttaggaaactacgtaaaacgaacttcggtaggcgtagcacctatcttcgtacgttcacttcccgttacccgcctacgttcctacgg

SEQ ID NO: 245071 - DNA, 538 bp, Homo sapiens
  misc_feature: GYAE6OF02H8H37.5.59.F04.1.454.CMB.1.raw
  modified_base (195)..(195): a, c, t, g, unknown or other
  misc_feature (195)..(195): n is a, c, g, or t
  modified_base (369)..(369): a, c, t, g, unknown or other
  misc_feature (369)..(369): n is a, c, g, or t
tcagatcagacacgcacgaccggtgctcgatttagtacacacacttagggattgggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctgggtaccagcaagaaacctggccaggttcccagcctcctcatctatggtatatccaccagggccactggcatcccagacaggttcagtggcaggcgggtctggggacaggacttcactctcncatcagccagactggagcctgaagtattttgctagtgtattactgtcagtctagtatggtagctcgacggtacgttcggaccgaagggaccgtaaggtacggaaacgtacgaaacgaactaggtaggacgtcgacacactctcgtcttcacttccttcccgccattccg

SEQ ID NO: 245072 - DNA, 509 bp, Homo sapiens
  misc_feature: GYAE6OF02GRBYZ.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttcccagcctcctcatctatggtatatccaccagggccactggcatccagacaggttcagtggcagcggtctgggacagacttcactctcaccatcagcagactggagcctgaagattttgctagtgtattactgtcagcagtatggtagctcgacggacgttcggccaagggaccaaggtggaaatacgaaacgactagtggacgtgcacatctgtcttcacttctcccgcatcg

SEQ ID NO: 245073 - DNA, 530 bp, Homo sapiens
  misc_feature: GYAE6OF02G3X7I.5.59.F04.1.454.CMB.1.raw
  modified_base (196)..(196): a, c, t, g, unknown or other
  misc_feature (196)..(196): n is a, c, g, or t
  modified_base (422)..(422): a, c, t, g, unknown or other
  misc_feature (422)..(422): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgagcctggtaccagcagaaacctggccaggttcccagcctcctcatctatggtatatccaccagggccactggcatcccagacaggttcagtggcagcgggtctgggacagacttcatctcacatcagcagactggagcctgaagtatttgctagtgtattactgtcagctagtatggtanctcacggacgttcggaccaagggacgaaggtggaaatacgaaacgaactggtaggcgtacgacaccgattcgtacgttcttactacttccgttcccgtcctacttccg

SEQ ID NO: 245074 - DNA, 510 bp, Homo sapiens
  misc_feature: GYAE6OF02HHBZK.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttcccagcctcctcatctatggtatatccaccagggccactggcatcccagacaggttcagtggcagcggtctgggacagacttcactctcaccatcagcagactggagcctgaagattttgctagtgtattactgtcagcagtatggtagctcacggacgttcggcaagggaccaagggtggaaatacgaaacgaactagtaggcgtgcaccatctgtcttcattctcccgcatcg

SEQ ID NO: 245075 - DNA, 534 bp, Homo sapiens
  misc_feature: GYAE6OF02H1IYF.5.59.F04.1.454.CMB.1.raw
  modified_base (236)..(236): a, c, t, g, unknown or other
  misc_feature (236)..(236): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaanaggttcgtagcctggtaccagcagaaacctggccaggttcccagcctcctcatctatggtatatccaccagggccactggcatcccagacaggttcagtggcagcgggtctggggacagacttcactctcaccatcagcagactggagcctagaagtatttgctagtgtattactgtcagcagtatggtagctcgacggtacgttcggaccgaacgggaccgtaaggtaggaaatacgaaacgaactagtggcgtggaccaccgatcgtgtcttactacttctttccctcgtcctacg

SEQ ID NO: 245076 - DNA, 550 bp, Homo sapiens
  misc_feature: GYAE6OF02H4GRF.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaagagccaccctctcctgcagggccagtcagaatgttaccaacaggttcgtagcctggtaccagcagaacctggccaggttcccagcctcctcatctatggtaatactcccaacgagggcccactggcactcccagacaggttcagtcggcaggcgggtctgggacagacttcactctacaccatcagcagactgagctgaagtatttgctagtgtattactgtactagcagttagtggtagctcgacggtacgttcgaccgaaggaccgtaagggtacggtaaagtacgaaacgtaacgtagtacggtacgtgacgtacacgttcgtagttcttctacttcctccgtacctataccg

SEQ ID NO: 245077 - DNA, 536 bp, Homo sapiens
  misc_feature: GYAE6OF02G9YPM.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaacctggccaggttcccagcctcctcatctatggtatactccaccgagggccacgtggcactcccagacaggttcagtggcaggcggtctgggacagacttcactctcacatcagcagacgtggacgctagaagtatttgctagtgtattacgtgtcagtactagtatggtagctacgacggtacgttcggaccgaacgggaccgtaagggtaggaaactacgaaacgactaggtggacgtgacacctatcgtgtcttcacttcctcccgtctatcg

SEQ ID NO: 245078 - DNA, 563 bp, Homo sapiens
  misc_feature: GYAE6OF02H1869.5.59.F04.1.454.CMB.1.raw
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
tcagatcagacacgcacgaccggtgctcgatttagtacacacacttagggattgggtggcgtcagttaggaccagagggaaccatggaaacccagcgcagcttctctcctcctgctactctgctccagatgccaccggaaagactgtgttgacgcagtctccaggcaccctgtcttgtctccagggaaagagcaccctctcctgcagggccagtcagaatgttacaanaggtctaagctggacagcagaactggcaggtccagcnccncatccatggtatatccacaggccaatgcntcccagcaaggttcaagtggcagacggtcngggtanaacggnttacacgttcncaccaacttcacgcaagcctaggacnccgtgaaaacgttnttagcgtagtgtaattacgtagacgttagacagttagtaggtagactcgaacggtcgtacgtaccgaacgtaacggaacggtaaggaaactaaacgaaacgtaacgtacgtggtaacgtacggacgacacgttacgtcgttacgttcctattaccgtttccgaccctactacg

SEQ ID NO: 245079 - DNA, 540 bp, Homo sapiens
  misc_feature: GYAE6OF02IC5QG.5.59.F04.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
tcagatcagacacgcacgaccggtgctcgatttagtacacacacttagggattgggtgctcagttaggacccagagggaaccatggaaaccccagcgcagcttctcttcctcctgctactctggctccagatgccaccggaaagactgtgttgacgcagtctccaggcaccctgtctttgtctccaggggaaangccaccctctcctgcagggccagtcagaatgttaccaacaggttcagcctggtaccngcagaacctggccaggttcccagcctcctcatctatggtatatccacagggccactggcatcccagacaggttcagtggcaggcgggtctgggacaggacttcactctcaccatcagcagactggacgctagaagtattttgctagtgttattactgtcagctagtatggtagctcgacggtacgttcggaccgaagggaccgtaaggtaggaaacgtacgaaacgacgtaggtacggcgtcgactaccgattcgtgttacttctacttccgttcccgtcctacttccg

SEQ ID NO: 245080 - DNA, 521 bp, Homo sapiens
  misc_feature: GYAE6OF02F9Q03.5.59.F04.1.454.CMB.1.raw
  modified_base (197)..(197): a, c, t, g, unknown or other
  misc_feature (197)..(197): n is a, c, g, or t
  modified_base (420)..(420): a, c, t, g, unknown or other
  misc_feature (420)..(420): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttctagcctggtaccagcagaaacctggccaggttcccagcctcctcatctatggtatatccacagggccactggcatcccagacaggttcagtggcagcggtctgggacagacttcactctcacatcagcagactggagcctgaagtatttgcagtgtattactgtcagcagtatggtanctcgacggacgttcggaccgtaagggaccaagggtacggaaatcgaaacgacgtgtaggacgtgacaccgattctgtcttctactccttcccgcctatccg

SEQ ID NO: 245081 - DNA, 520 bp, Homo sapiens
  misc_feature: GYAE6OF02IKTDM.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctggggacagacttcactctcacatcagcagactggacgcctgaagattttgctagtgtattactgtcagtcagtatggtagctcgacggtacgttcggacgaagggaccgaaggtaggaaatacgaaacgactagtaggcgtgcacatctgtcttctatccttccgcctatccg

SEQ ID NO: 245082 - DNA, 556 bp, Homo sapiens
  misc_feature: GYAE6OF02IPWFR.5.59.F04.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (429)..(429): a, c, t, g, unknown or other
  misc_feature (429)..(429): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctntcctgcagggccagtcagaatgttaccaacaggttcgtagcctggtaccagccagaaacctggccaggttcccagcctcctcatctatggtatatccaccagggccactggcatcccagacaggttcagtggcagcggtctggggacagacttcactctcaccatcagcagactggagcctagaagtattttgactagtgtattactgtcagcagtatggtanctcgacggtacgttcggaccgacgggaccgaagggtacggaaataccgaaacgtaacgtagtacggtacgtggaccaacctagtccttggttaccttctacttcccgttcccgtaccctacgttccg

SEQ ID NO: 245083 - DNA, 533 bp, Homo sapiens
  misc_feature: GYAE6OF02H94OL.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaccaacaggttcgtagcctggtaccagcagaacctggccaggttcccagcctctcatctatggtatatccaccagggccactggcatcccagacaggttcagtggcagcgggtctgggacagacttcactctcaccatcagcagactggagcctagaagtatttgctagtgttaattacgtgtcagctagtatggtagctcgacggtacgttcggaccgaagggaccgaaggtaggaaatacgaaacgactagtaggtacgtgacacctacttactgttcttactacttccttcccgacctatcg

SEQ ID NO: 245084 - DNA, 522 bp, Homo sapiens
  misc_feature: GYAE6OF02HN51Z.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaaagttaccaacaggttcgtagcctggtaccagcagaaacctggccaggttcccagcctcctcatctatggtatatccacagggccactggcatcccagacaggttcagtggcaggcgggtctgggacagacttcactctcaccatcagcagactggagcctgaagtattttgctagtgtattactgtcagcagtatggtagctcacggacgttcggccgaagggaccgaaggtagaaagtacaaacgaacgtgtagcgtgacaccatctgtcttcactccttcccgacctactctcg

SEQ ID NO: 245085 - DNA, 533 bp, Homo sapiens
  misc_feature: GYAE6OF02JB8QO.5.59.F04.1.454.CMB.1.raw
  modified_base (197)..(197): a, c, t, g, unknown or other
  misc_feature (197)..(197): n is a, c, g, or t
  modified_base (344)..(344): a, c, t, g, unknown or other
  misc_feature (344)..(344): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaaccaacaggttcgagcctggtaccagcagaaacctggccaggttcccagcctcctcatctatggtatatccaccaggccactggcatcccagacaggttcagtgcagcgggtngggacagacttcactctcaccatcagcagactggacgcctagaagtattttgactagtgtattacgtgtcagctagtatggtagctcgacggacgtcggcgaaggacgaaggtaggaaatacgaacgacgtagtacggcgtcgacacacgttcgtagttcttactacgtccgtcccgtaccgtataccg

SEQ ID NO: 245086 - DNA, 536 bp, Homo sapiens
  misc_feature: GYAE6OF02HDFVS.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctctaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccacgtggcatcccagacaggttcagtggcaggcgggtctgggacagacttcactctcaccatcagcagactggagctgaagtatttgctagtgtattactgtcagctagtagtggtagctcgacggtacggttcggaccgaagggaccgaagggtaggaaacgtacgaaacgaacgtagtaggtacgtcgacacctagtctgttcttctactccttcccgctactcg

SEQ ID NO: 245087 - DNA, 520 bp, Homo sapiens
  misc_feature: GYAE6OF02FQD6L.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccacagggccactggcatcccagacaggttcagtggcagcggtctgggacagacttcactctcaccatcagcagactggagcctgaagtattttgcagtgtattactgtcagctagtatggtagctcgacggtacgttcggaccgaagggaccgaaggtaggaaatacgaaacgacgtagtacggacgtgcaccatctgtcttcagtccttccgcctatcg

SEQ ID NO: 245088 - DNA, 535 bp, Homo sapiens
  misc_feature: GYAE6OF02GB1AC.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaanaggttcgtagcctggtaccagcagaacctggccaggttcccagcctcctcatctatggtatatccaccagggccacgtggcatcccagacaggttcagtggcagcggtctgggacagacttcactctcaccatcagcagactggagcctagaagtatttgctagtgtattactgtcagctagtatggtatcgtcgacggtacgttcggacgaacgggacgaagggtagaaacgtacgaaacgaacgtgtggacgtgaccaccgtatcgtgttcttactacttccgttcccgtcctatccg

SEQ ID NO: 245089 - DNA, 520 bp, Homo sapiens
  misc_feature: GYAE6OF02I7BP4.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctcctcatctatggtatatccaccagggccactggcatcccagacaggttcagtggcagcggtctgggacagacttcactctcaccatcagcagactggagcctgaagattttgctagtgtattactgtcagcagttatggtagctcgacggtacgttcggaccgaagggaccaaggtaggaaactacgaacgaactgtaggcgtgacacatcgtgtacttctactctccgtcctatcg

SEQ ID NO: 245090 - DNA, 568 bp, Homo sapiens
  misc_feature: GYAE6OF02JODRV.5.59.F04.1.454.CMB.1.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (341)..(341): a, c, t, g, unknown or other
  misc_feature (341)..(341): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagatgttaccanagttcgtagcctggtaccagcagaacctggccaggttcccagcctcctcatctatggtatatcccacagggccactggcatcccagactaggttcagtggcaggcggtntgggacagccttcactctcaccgtatcgagcaagtactggagccgtagaagtagtttacgctagtgtacttacgtagttcagtacagtagtaggtagcgtacgtacggtacgttcggtaccgaacggtaacgaaggtaggaaacgtacgaaacgtaacgtacgtacggtacgtcgtacgacgtaacgtacgttagtacgttactacttcgtacccgtccgtacgtcg

SEQ ID NO: 245091 - DNA, 543 bp, Homo sapiens
  misc_feature: GYAE6OF02ICHV9.5.59.F04.1.454.CMB.1.raw
  modified_base (196)..(196): a, c, t, g, unknown or other
  misc_feature (196)..(196): n is a, c, g, or t
  modified_base (362)..(362): a, c, t, g, unknown or other
  misc_feature (362)..(362): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgagcctggtaccagcaagaaacctggccaggttcccagcctcctcatctatggtatatccacagggccactggcactcccagacaggttcagtggcaggcggtctgggacagactcactcncaccatcagcagactggagcctgaagtatttgctagtgtattactgtacagctagtatggtagctagacggtacgttcggaccgaagggaccgaagggtaggaaactacgaaacgactaggtacggtacgtcggaccaccacgttctagttcttacacttccgttcccgtacctattaccg

SEQ ID NO: 245092 - DNA, 600 bp, Homo sapiens
  misc_feature: GYAE6OF02FGFEL.5.59.F04.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctccaggggaaangccaccctctcctgcagggccagtcagaatgttaccaanaggttcgtagcctggtaccagcagaaacctggccaggttcccagcctcctcatctatggtatatcccacaggccactggcatcccagacaggttcagtcggcaggcgggtctgggacaggacttcactctcaccatcagcagactggacgctgaagtattttgactagtagttattacgtgtcagctagtagtggtagtcgtcgacggtacgttccgggaccgaaacggggtaaccgtaagggtaacggtaaacgtaacgaaaccggtaacgttacggtaggtaccgtacggaccgaacccgtaacttaccgtacggtttccgttaccttaccgttcccgtttaccccggtaccctacgttacccg

SEQ ID NO: 245093 - DNA, 586 bp, Homo sapiens
  misc_feature: GYAE6OF02JTAM5.5.59.F04.1.454.CMB.1.raw
  modified_base (196)..(196): a, c, t, g, unknown or other
  misc_feature (196)..(196): n is a, c, g, or t
  modified_base (234)..(234): a, c, t, g, unknown or other
  misc_feature (234)..(234): n is a, c, g, or t
  modified_base (327)..(327): a, c, t, g, unknown or other
  misc_feature (327)..(327): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgtaccaanaggttcgagcctggtaccagcagaacctggccaggttcccagcctcctcatcctagtggtatactcccacaggccacgtggcactcccagacnggttcagtcggcaggcggtctgggactagaccttcacgtctacacctatcacgcacggactggacnccgtagaagtntttcgactagtgtattacgtgtacagtctagttagtggtagctacgtacggtacgttacggaccgtaagggaccgaagggtacggaaacgtaacgaacggtaacgtcgtacggtcgtacggactaccgtacttacgttcgttacctttccgaacgtttcccgtacccgtacctacgttaccg

SEQ ID NO: 245094 - DNA, 517 bp, Homo sapiens
  misc_feature: GYAE6OF02GOM58.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttccagcctcctcatctatggtatatccaccagggccactggcatcccagacaggttcagtggcagcgggtctgggacagacttcactctcaccatcagcagactggagcctgaagtattttgctagtgtattactgtcagctagtatggtagctcgacggtacgttcggaccgaagggaccgaaggtagaaatacaaacgacgtgtaggcgtcgcacatctgtcttcattcctcccgccatcg

SEQ ID NO: 245095 - DNA, 534 bp, Homo sapiens
  misc_feature: GYAE6OF02GHEHL.5.59.F04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctntcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagtattttgctagtgttattacgtgtcagcagtagtgtagctcgacggtacgttcgggaccgaagggaccgaaggtaggaaacgtacgaaacgaacgtaggtaggcgtgacaccagtctgtcttactacttcctcccgtaccatccg

SEQ ID NO: 245096 - DNA, 551 bp, Homo sapiens
  misc_feature: GYAE6OF02G1D39.5.59.F04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (420)..(420): a, c, t, g, unknown or other
  misc_feature (420)..(420): n is a, c, g, or t
tcagatcagacacgcacgaccggtgctcgatttagtacacacacttagggagttggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctntcctgcagggccagtcagaatgttaccaacaggttctagcctggtaccagcagaaacctggccaggttcccagcctctcatctatgtatatccacaggccactggcatcccagacaggttcagtggcagcggtctgggacagacttcactctcacatcagcagactggancctgaagtntttgctagtgtattacgtgtctagctagtatggtancttacgacgggtacgttcggaccgaacgggaaccgaagggtaggtaaataccgaaacgacgttaggtggacgtcggaccgaacctattccgtgttaccgttcacgttcccgttacccgtacctacttccgg

SEQ ID NO: 245097 - DNA, 507 bp, Homo sapiens
  misc_feature: GYAE6OF02I9EP3.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttctagcctggtaccagcagaaacctggccaggttcccagcctctcatctatggtatatccacaggccactggcatcccagacaggttcagtggcagcgggtctggggacagacttcactctcacatcagcagactgagctgaagtatttgctagtgtattactgtcagcagtagtgtagctcgacgtacgttcggccgaaggtaccgaaggtcggaaatcaacgaagtgtaggcgtgcacactcgtagtctctactcgtccgctctcg

SEQ ID NO: 245098 - DNA, 570 bp, Homo sapiens
  misc_feature: GYAE6OF02JJIRC.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaacctggccaggttcccagcctcctcatctatggtatatccaccagggccactggcactcccagacaggttcagtcggcagcgggtctgggacagacttcactcgtcaccatcagcagactggacgccgtagaagtactttgactagtgttatacgtgtactagcgtagtatggtagtctacgacggtacgttacggtaccgtaagggaccgtaacggtacggaaactacgaacgtaacgtagtacggtcgtacggactacgtacttcgtagttcgttacctacgttccgtacccgttaccacgttaccg

SEQ ID NO: 245099 - DNA, 554 bp, Homo sapiens
  misc_feature: GYAE6OF02H9WPX.5.59.F04.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
tcagatcagacacgcacgaccggtgctcgatttagtacacacacttagggattgggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaanaggttcagcctggtaccagcaagaacctggccaggttccagcctcctcatctatggtatatcccacagggccagtggcatcccagacaggttcagtggcaggcggtctgggacaggacttcactcacaccatcagcagctggancgtgaagtntttgactagtgttacttactgtacagtcgtagtagtggtatcgtcgaacgggtacgttcggaccgtaagggaccgtaaaggtacggaaataccgtaaacgaacgtaggtacggtacgtgtaccgactacgttacgttcgtcttctacttccttcccgtccacgttcg

SEQ ID NO: 245100 - DNA, 576 bp, Homo sapiens
  misc_feature: GYAE6OF02FZO81.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcaagaacctggccaggttcccagcctcctcatctagtggtatactcccaccgacggccacgtggcactcccagacctaggttcaggtggcaggtcgggtcgtggggacagtacttcgactctacacatcagcagacgtggacgtctagaagtagtttgcgtagttgttattacgtgtcgagcgtagttagtgtacgtctacgacggtacgttcggaccgaagggaccgtaaggtagaaacgtacgaaacgtaacgtggtacggtacgtgaccaaccgtatccgttgttcgttctaccttccgtacccgtacctacttccg

SEQ ID NO: 245101 - DNA, 545 bp, Homo sapiens
  misc_feature: GYAE6OF02HW58Q.5.59.F04.1.454.CMB.1.raw
  modified_base (196)..(196): a, c, t, g, unknown or other
  misc_feature (196)..(196): n is a, c, g, or t
  modified_base (321)..(321): a, c, t, g, unknown or other
  misc_feature (321)..(321): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttctagcctggtaccagcagaacctggccaggttcccagcctctcatctatggtatatcccacaggccatggcatcccagacnggttcagtgcagcggtctgggacagcttcactctacacatcagcagactgagctagagtatttgactagtgtattactgtctagtactagtagtgtagctacgacggtacgttcggaccgaacggaacgtaaggtacggaaagtacgaaacgtaacgtagtacggacgtgaccgacgtaacgtacgtcgttacttcgacttaccgttacccgtccgtacttccg

SEQ ID NO: 245102 - DNA, 522 bp, Homo sapiens
  misc_feature: GYAE6OF02FTIG4.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaanaggttcgtagcctggtaccagcagaacctggccaggttcccagcctcctcatctatggtatatccacagggccacgtggcatccagacaggttcagtggcagcggtctgggacagacttcactctcacatcagcagactggagcctagaagtatttgctagtgttattactgtcagctagtagtgtagctcgacggtacgttcgccgaaggacgaaggtagaacgtacgaaacgtacgtgtggcgtgacaccgattcgtgtccttctacttccttcccgcctatccg

SEQ ID NO: 245103 - DNA, 549 bp, Homo sapiens
  misc_feature: GYAE6OF02IGXQE.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgagcctggtaccagcaagaaacctggccacggttcccagcctcctcatctatggtatactccaccacgggccacgtggcactcccagacaggttcagtcggcagcgggtctgggacagacttcactctcaccatcagacagactggacgctagagtatttgctagtgttattacgtgtcagtcagttatggtagctcgacggtacgttcggacgaacgggacgaaggtaggaaatacgaaacgtacgtaggtcggtcgtagaccacctagtacgttagttcttctacttaccttcccgacctatccg

SEQ ID NO: 245104 - DNA, 534 bp, Homo sapiens
  misc_feature: GYAE6OF02GJPQP.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttctagcctggtaccagcagaaacctggccaggttcccagcctcctcatctatggtatatccaccagggccactggcatccagacaggttcagtggcagcggtctgggacagacttcactctcaccatcagcagactggacgctagaagtatttgctagtgtattactgtcagtcagttagtggtagtctcgacggtacgttccggccgaacgggaccgaagggtaggaaacgtacgaaacgactaggtggcgtcgacaccatcgtgttcttctactccttcccgcctacttccg

SEQ ID NO: 245105 - DNA, 527 bp, Homo sapiens
  misc_feature: GYAE6OF02GJ16E.5.59.F04.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaanaggttcgtagcctggtaccagcagaacctggccaggttcccagcctcctcatctatggtatatccaccagggccactggcatcccagacaggttcagtggcaggcggtctgggacagacttcactctcacatcagcagactggagcctgaagtatttgctagtgtattactgtcagcagtatggtagctcgacggtacgttcggaccgaagggacaagggtaggaaatacgaacgaacgtgtaggcgtgacaccgactcgtagttcttcacttccgttcccgtcctatccg

SEQ ID NO: 245106 - DNA, 516 bp, Homo sapiens
  misc_feature: GYAE6OF02IN50O.5.59.F04.1.454.CMB.1.raw
  modified_base (196)..(196): a, c, t, g, unknown or other
  misc_feature (196)..(196): n is a, c, g, or t
  modified_base (422)..(422): a, c, t, g, unknown or other
  misc_feature (422)..(422): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgtaccaacaggttcgtagcctggtaccagcagaaacctggccaggttcccagcctctcatctatggtatatccacagggccacgtggcactcccagacaggttcagtggcagcggtctgggacagcttcactctcacatcagcagactggagcctagaagtatttgctagtgtattactgtcagacagtagtgtanctcgacggtacgttcggacgaagggaccaaggtaggaaatacgaaacgaacgtgtgcgtgacactatcgtagtcttcacttcctcccgctatcg

SEQ ID NO: 245107 - DNA, 523 bp, Homo sapiens
  misc_feature: GYAE6OF02FRBRC.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttcccagcctcctcatctatggtatatccaccagggccactggcatcccagacaggttcagtggcaggcgggtctggggacaggacttcactctcaccatcagcagactggagcctgaagattttgcagtgttattactgtcagctagtatggtagctcacggacgttcggccgaagggaccaagggtaggaaactacgaaacgactagtaggctggccacctatctgtcttcatccttcccgctactcg

SEQ ID NO: 245108 - DNA, 543 bp, Homo sapiens
  misc_feature: GYAE6OF02II3XT.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (281)..(281): a, c, t, g, unknown or other
  misc_feature (281)..(281): n is a, c, g, or t
  modified_base (380)..(380): a, c, t, g, unknown or other
  misc_feature (380)..(380): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctntcctgcaggccagtcagaatgttaccaanaggttcagcctggtaccagcagaaacctggccaggtcccagcctcctnatctatggtatatccacaggccactggcactcccagacaggttcagtggcaggtcggtctgggacaggacttcgacttcacaccatcagcagctggacncctgaacgtatttgctagtgtattactgtcagcagtagtgtagcgtacgacggtacgtcggtaccgaacggaaccgaggtaaggaaagtaacaaacgaacgtgtaggtacgtgacgacctagtacttgtacgttcctactaccgttcccgtaccgtattaccg

SEQ ID NO: 245109 - DNA, 526 bp, Homo sapiens
  misc_feature: GYAE6OF02IVATJ.5.59.F04.1.454.CMB.1.raw
  modified_base (196)..(196): a, c, t, g, unknown or other
  misc_feature (196)..(196): n is a, c, g, or t
  modified_base (424)..(424): a, c, t, g, unknown or other
  misc_feature (424)..(424): n is a, c, g, or t
tcagatcagacacgcacgaccggtgctcgatttagtacacacacttagggattggggtgctcagttaggacccagagggaacaatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctcctcatctatggtatatccacagggccactggcatcccagacaggttcagtggcagcgggtctgggacagacttcactctcaccatcagcagactggagcctgaagtatttgctagtgtattactgtcagcagtatggtanctcgacggtacgttcggaccgaagggaccaagggtaggaaatacgaaacgaacgtgtaggcgtgacacgatcgtgtacttctacttccttcccgtcctatcg

SEQ ID NO: 245110 - DNA, 519 bp, Homo sapiens
  misc_feature: GYAE6OF02HWH99.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaagagccaccctctcctgcagggccagtcagaatgttaccaacaggttcgtagcctggtaccagcagaaacctggccaggttcccagcctcctcatctatggtatatccaccagggccactggcatccagacaggttcagtggcagcggtctgggacagacttcactctcacatcagcagactggagcctgaagtatttgcagttgtattactgtcagctagtatggtagcgtgacggtacgttcggccgaagggacgaaggtaggaaatacgaacgacgtagtgacgtgaccacacgtctgtcttacactccttcccgcctactcg

SEQ ID NO: 245111 - DNA, 515 bp, Homo sapiens
  misc_feature: GYAE6OF02GP1KR.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttctagcctggtaccagcagaaacctggccaggttcccagcctcctcatctatggtatatccaccagggccactggcatcccagacaggttcagtgcagcggtctgggacagacttcactctcaccatcagcagactggagcctgaagtattttgcagtgtattactgtcagcagtatgtagctcgacggacgttcggaccgaagggaccgaaggtacggaaatacgaaacgactgtggcgtgacaccatctgtcttcacttcctcccgcctactcg

SEQ ID NO: 245112 - DNA, 562 bp, Homo sapiens
  misc_feature: GYAE6OF02GY0WJ.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctcctcatctatggtatatcccacgagggccacgtggcactcccagacaggttcaggtggcaggcggtctggggacagaccttcactctacaccatcagcagactggagctagaagtatttgctagttgtattactgtcagctagtagtggtagcgtcgacggtacgttcggaccgaacgggaaccgaagggtaacggaaagtaacgaaacgaacgtaggtaggacgtcgaccaccgactcgttagttcttacgtacttcccgttcccgtcctacgtaccg

SEQ ID NO: 245113 - DNA, 529 bp, Homo sapiens
  misc_feature: GYAE6OF02GLIPY.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgagcctggtaccagcagaaacctggccaggttccagcctcctcatctatggtatatccacagggccactggcatcccagacaggttcagtgcagcggtctgggacagacttcactctcaccatcagcagactggagcctgaagtattttgctagtgtattactgtcagtctagtagtggtagtcgtacgacggtacgttcggaccgaacgggaccaagggtaggaaatacgaaacgacgtagtggacgtggacacattcgtgttcttctactccttcccgtccatccg

SEQ ID NO: 245114 - DNA, 521 bp, Homo sapiens
  misc_feature: GYAE6OF02G5NTS.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccacagggccactggcatcccagacaggttcagtggcagcgggtctggggacagacttcactctcaccatcagcagactggagcctgaagattttgcagtgttattactgtcagctagtattggtagctcgacggtacgttcggaccgaagggacgaaggtaggaaagtacgaaacgaacgtgtaggcgtgccacactctgtcttctatcctcccgctatcg

SEQ ID NO: 245115 - DNA, 536 bp, Homo sapiens
  misc_feature: GYAE6OF02HMW8P.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctggggacagacttcactctcaccatcagcagactggagcctagaagtatttgctagtgtattactgtcagcagtatggtagctcgacggtacgttcgggaccgaagggaccgaagggtacggaaacgtacgaaacgaacgtagtacggacgtgacacctatctagtcttcacttccttcccgcctatccg

SEQ ID NO: 245116 - DNA, 541 bp, Homo sapiens
  misc_feature: GYAE6OF02I6GBC.5.59.F04.1.454.CMB.1.raw
  modified_base (195)..(195): a, c, t, g, unknown or other
  misc_feature (195)..(195): n is a, c, g, or t
  modified_base (325)..(325): a, c, t, g, unknown or other
  misc_feature (325)..(325): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaccaacaggttcgtagcctggtaccagcagaaacctggccaggttcccagcctcctcatctatggtatactccacgaggccactggcactccagacnggttcagtggcagcggtctgggacagcttcactctcacatcagcagactggacgcctagaagtacttttgctagtagtattactgtcagactagtatggtagcctcgaccgggtacgttcggacgaacgggaccgaaggtacggtaaactacgaaacgtaactggtacggcgtcgactaccgatcgtgttctcgacttccgtcccgtcctacgtcg

SEQ ID NO: 245117 - DNA, 529 bp, Homo sapiens
  misc_feature: GYAE6OF02HEURW.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagtattttgctagtgtattactgtcagcagttatgtagctcgacggtacgttcggaccgaagggaccgaaggtaggaaatacgaaacgacgtagtggacgtgacacctagtacctgtcttctacttccttcccgcctatcg

SEQ ID NO: 245118 - DNA, 665 bp, Homo sapiens
  misc_feature: GYAE6OF02JWGPF.5.59.F04.1.454.CMB.1.raw
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctccaggggaangccacctntcctgcagggccagtcagaatgttaccaacnggttcgtagcctggtaaccngcagaacctggccaggttcccagcctcctcatcctatggtatactcccaacgagggacccacgtggcctaactccccgaagtacctacgggttaccaggttggccagggccgggttactaggggaaccaggacctttcactcgtaccaaccgatccgaagtccagaccgttggacgtcctacggtaagttacgtttcgacgtagttagttaacgtttaccgtagtacaacggtcgtaaggttagtacgggtacgtcgttaccggaaccgggtacggttccggaaccgtaacgggtaaccgtaacgggtaggaaacgttaacgaaacggtaacgtggtaggtaccgtcggtaccgaccgtacgttaccggttcgtaccgtttctacgttcccgttacccggtactaccgttccg

SEQ ID NO: 245119 - DNA, 540 bp, Homo sapiens
  misc_feature: GYAE6OF02ILZL6.5.59.F04.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
tcagatcagacacgcacgaccggtgctcgatttagtacacacacttaggggagttggggtgctcagttaggacccagagggaaccatggaaaccccagcgcagcttctcttcctcctgctactctggctcccagatgccaccggaaagactgtgttgacgcagtctccaggcaccctgtctttgtctccaggggaagngccaccctntcctgcagggccagtcagaatgtaccaacaggttcgtagcctggtaccagcaagaaacctggccaggttcccagcctcctcatctatggtatatccacgtagggccactggcatcccagacaggttcaggtggcaggcggtctgggacagcttcactctcaccatcagcagcgtggacgcctagaagtattttgctagtgtattacgtgtcagtctagtagtggtagcgtacgacggtacgttcggaccgaagggacgaaggtagaaagtaacgaacgtacgtgtggctgaccactactcgtgttacttctacttcctcccgtacctattccg

SEQ ID NO: 245120 - DNA, 853 bp, Homo sapiens
  misc_feature: GYAE6OF02H8HN8.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaanagccaccctctcctgcagggccagtcagaatgttaccaacaggttcgagcctggtaccagcaagaacctggaccaggttccccagtccctcctcatcctagtcggtaatactcccaccgtagggccctaacgtcggccaacgttcccccaaggtaacctaacggggtttcccaagggttcgggacctaacggggtccgggggttacctacggggggaacctaagggtacccttttaccgaaccgtttccgtacccaaccccgtaatttcccgaaagggccctaaacgggtaccccggttaggggaaccggtaccccgttagggtaaacggtttacgttttttacgggaccgtaacgggtttaaggtttaaccgttttaaccggttaggtttaccgaaacggtccgtaaaggtttaacggttacggggttacgtacccggtttaccggtaacccggggttaccgggttacccgggtacccgggtaaaccggggtaacccggttaaacggggttaacggggtaaaacgtaaaccggtaaaaccggtaaacccggtacgggttacgggaccgttacggtaacccgtaaccgtaaccgttacgttaccgttaccgtttaccgttaccgtaccccgttttacccgtacccgttacttacccgg

SEQ ID NO: 245121 - DNA, 544 bp, Homo sapiens
  misc_feature: GYAE6OF02JAS0Y.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaacctggccaggttcccagcctcctcatctatggtatatccaccagggccactggcatcccagacaggttcagtggcagcgggtctgggacagacttcactctcaccatcagcagactggacgccgtagaagtattttgctagtgtattactgttcagcagtagtggtagcgtcgacggtacgttcgggaccgaacgggaccgaaggtagggtaaacgtacgaaacgtaacgtggtaggcgtaggcaccgtatcgtgttacttctactcttcccgcctactccg

SEQ ID NO: 245122 - DNA, 638 bp, Homo sapiens
  misc_feature: GYAE6OF02FVBA0.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagcgccaccctctcctgcgacgggccagtcaagaatcgttaaccaaacgtaggttcgtacgccgttagggtaacccagccaagaaaccctggaccctacggttccccaagtcccttcctcacttctagtggtaatactcccaccgacggccacgtggcactcccagactaggttcaggtgcaggcggtctgggacagtacttcactctcacatcagcagacgtggacgctagaagttatttgacgtagtgttacttacgtgtacgagtacgtagtagtggtacgtccgtacgacggtaccggttaccggaccgtaacgggaccgtaagggtaacgtaaacgtaccgaaacgtaacgtaggtacggtaccgtcggacctaaccgtacgttaccgttacgttaccgttaccgtaaccttcccgttaccccgtaccgtattacccgg

SEQ ID NO: 245123 - DNA, 562 bp, Homo sapiens
  misc_feature: GYAE6OF02H4T2X.5.59.F04.1.454.CMB.1.raw
  modified_base (194)..(194): a, c, t, g, unknown or other
  misc_feature (194)..(194): n is a, c, g, or t
  modified_base (375)..(375): a, c, t, g, unknown or other
  misc_feature (375)..(375): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaangccaccctctcctgcagggccagtcagaatgttaccaacaggttcgagcctggtaccagcagaacctggccaggttccagcctctcatctatggtatatcccacagggccatggcatcccagacaggttcagtgcagcgggtctgggacagacttcactctcaccatcagccagactggancctgaacgtatttgactagtagtattacgtgtcagctagtattggagcttacgacggtacgttcggaccgtaaagggaccgtaaagggtggaaaactacgtaaaaccgtaacgtaggtacggtacgtacgacctaaccgtaattccgtagttccgttaccacctttccgtttccccgcctattaccg

SEQ ID NO: 245124 - DNA, 589 bp, Homo sapiens
  misc_feature: GYAE6OF02HYOGD.5.59.F04.1.454.CMB.1.raw
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttctagcctggtaccagcagaaacctggccaggttcccgctctcatctatggtatactccacagggccacgtggcactcccagactaggttcagtggcaggcgggtntgggacagacttcactctcaaccntcagcagactgggacgctagaagtatttgctagtgtattactgtacagtcgtagtagttaggtagtctacgacggtaccgttacggaccgaacgggaaccgaagggtacggaaacgtaacgaaacgtaacgtacggtaggacgttacggacgtaccgtagttccgttacgttcgtttacgtacgttacccgtttaccccggtactaccgttcgttacgg

SEQ ID NO: 245125 - DNA, 620 bp, Homo sapiens
  misc_feature: GYAE6OF02H615T.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccagggaaanagccaccctctcctgcagggccagtcagaatgttaccaacaggttcgtagctggtaccagcaagaacctggccaggttccagcctctcatctatggtatactcccacagggccagtggcactcccagacaggttcagtggacaggcggtctgggacagtacttcactctcacatcagcagacgtggagccgtagaacgttatttgacgtagtagttaacttacgtagttcgaacgtcagttagtggtagtcctacggtaacggtaccggtttccgaaccgtaaacggggtacccgtaaaagggttacggaaaacgttaaccgaaaccgtaacgttacggtacggtaccgtacgacccgtaaccgtacgtttaccgtcggtttactttccgtaacctttcccgtttccccgtacccgtattacccgg

SEQ ID NO: 245126 - DNA, 521 bp, Homo sapiens
  misc_feature: GYAE6OF02JD76W.5.59.F04.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (429)..(429): a, c, t, g, unknown or other
  misc_feature (429)..(429): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccgaaggggaaangccaccctctcctgcagggccagtcagaatcgttaccaanggttcgagcctggtaccagcaagaaacctggccaggttcccagcctctcatctatggtatatcccaaccagggccactggcatcccagacagttcagtggcaggcggtngggacngtactcactctcacatcagcagactggacgccgtagaagtatttgctagtcgttattactgtacagctagtatggtancttagacggtacgttcggaccgaaggaccgaaggtagaaacaacgaagactgtacgcgtacgcacatctgtcttcacttccgtccgccatcg

SEQ ID NO: 245127 - DNA, 531 bp, Homo sapiens
  misc_feature: GYAE6OF02HTRM7.5.59.F04.1.454.CMB.1.raw
  modified_base (200)..(200): a, c, t, g, unknown or other
  misc_feature (200)..(200): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (347)..(347): a, c, t, g, unknown or other
  misc_feature (347)..(347): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
tcagatcagacacgcacgaccggtgctcgatttagtacacacactttaggggagttggggtgctcagttaggacccagagggaaccatggaaaccccagcgcagcttctcgttcctcctgctactctggctcccagatgccaccggaagactggtgttgacgcagtctccaggcaccctgtctttgtctccaggggaaangccaccctctcctgcagggccagtcagaatgttaccaacnggttcagcctggtaccngcagaacctggcagttccagcctctcatcatggtatatccactagggccactggcatcccagacaggttcagtggcagcggtctgggacngacttcactctcacatcagcagctganctgaagtntttgctagtgtattactgtcagtactagtacgtgtagctcgacggtacgttcggacgaacgggaccgaaggtaggaaataacgaacgaacgtagtaggtcgtcgacacgattacgtcgttacttcgtactccgttacccgtcctatccg

SEQ ID NO: 245128 - DNA, 719 bp, Homo sapiens
  misc_feature: GYAE6OF02HVP2Y.5.59.F04.1.454.CMB.1.raw
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
tcagatcagacacgcacgaccggtgctcgatttagtacacacactttaggggattgggggtgctcagttaggacccagagggaaccatgggaaaccccagcgcagcttctcttcctcctgctactctggctcccagatgccaccggaagactgtgttgtacgcagtctccaggcaccctgtctttgtctccgaggggaaanagccaccctctcctgcgagggccagtcagaatggttaccaacaggttcgagcctggtaccagcagaacctggccagttcccagcctctcatctatggtatactccaccgagggccactggcactccccgagacgaggttcaggtggcaggcgggtntgggacagtacttcaacgtctaccgactaatcaagtcgaagacgttgggacgccgtaggaaacgttagttttacgcgtaaggtttacgtaatttaaccgtacgttaacgaacggtacgtaaacggttaagttagggttacgtaccgttaccgtaaaccgggtaaccggtttaccgggaacccggtaaacggggtaacccggtaaacggggttaacggggaaaaacgttaaccggtaaaaaccggtaaccggttagggttacgggtaccggtacggtaacccgtaaccgtaacgtttccgtttacggttaccgtttaccgtaaccgtttccccgtttaacccccgtacccgttaacttcccgg

SEQ ID NO: 245129 - DNA, 557 bp, Homo sapiens
  misc_feature: GYAE6OF02FX8ED.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatactccaccgagggccactggcatcccagacaggttcagtggcagcggtctgggacagtacttcactctcaccatcacgcacgactggacgcctagaagtagtttgactagtgttattacgtgtacagctagtagtgtagtctcgacggtacgttccggacgaacgggaccgtaaggtaggaaacgtacgaaacgacgtacgtaggtacgtcgaccgacctagtacttcgtacttctacgttccttacccgtcctactccg

SEQ ID NO: 245130 - DNA, 203 bp, Homo sapiens
  misc_feature: GYAE6OF02HRKT8.5.59.F04.1.454.CMB.1.raw
  modified_base (201)..(203): a, c, t, g, unknown or other
  misc_feature (201)..(203): n is a, c, g, or t
tcagatcagacacgcacgaccggtgctcgatttagtacacacacttagggattgggcacggtgggcatgtgtgagttttgtcacaagatttgggctcaactttcttgtccaccttggtgttgctgggcacagcggccctgggctgcctggtcaaggactacttcccgtgtctgatctgagcgggctggcaaggcgcatagnnn

SEQ ID NO: 245131 - DNA, 549 bp, Homo sapiens
  misc_feature: GYAE6OF02I8YJ1.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaacctggccaggttcccagcctcctcatctatggtatactccaccgagggccacgtggcatccccagacaggttcaggtggcaggcgggtctgggacagacttcacgtctcaccatcagcagctggacgcctagaagtattttgagttgtattactgtcagtctagttatggtacgctacgacggtcgttccggacgaagggaccgtaagggtaggaaactacgaaacgtacgtgtacggactgccactacgtctcgtccttctacttccgttcccgcctatccgtacgg

SEQ ID NO: 245132 - DNA, 535 bp, Homo sapiens
  misc_feature: GYAE6OF02FMJEK.5.59.F04.1.454.CMB.1.raw
  modified_base (426)..(426): a, c, t, g, unknown or other
  misc_feature (426)..(426): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagatgttaccaacaggttcgtagcctggtaccagcagaaacctggccaggttcccagcctcctcatctatggtatatccaccagggccactggcatcccagacaggttcagtggcaggcggtctgggacagacttcactctcaccatcagcagactggagcctagaagtattttgctagtgtattactgtcagcagtatggtancgtcgacggacgttcggaccgaaacgggaccgaagggtaggaaacgtacgaaacgtaacgtagtaggcgtgccacctattcgtgttcttcacttcttcccgtactatcg

SEQ ID NO: 245133 - DNA, 554 bp, Homo sapiens
  misc_feature: GYAE6OF02HAKXO.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngcccaccctctcctgcagggccagtcagaatgttaccaacaggttcgtagcctggtaccagcagaaacctggccaggttcccagcctcctcatctatggtatactccaccaggccacgtggcactcccagacaggttcagtggcaggcggtctgggacagacttcactctcacatcagcagactggacgctagaagtatttgctagtgtattacgtgtcgagcgtagtagtggtagtctcgacggtacggttccggaccgaacgggacgtaagggtaggaaactacgaaacgtaacgtagtggtacgtcgactaccgattcgtacgttcttactacttccgttcccgacctactccg

SEQ ID NO: 245134 - DNA, 522 bp, Homo sapiens
  misc_feature: GYAE6OF02GG6E5.5.59.F04.1.454.CMB.1.raw
  modified_base (196)..(196): a, c, t, g, unknown or other
  misc_feature (196)..(196): n is a, c, g, or t
  modified_base (380)..(380): a, c, t, g, unknown or other
  misc_feature (380)..(380): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttctagcctggtaccagcagaacctggccaggttccagcctctcatctatggtatatccaccagggccactggcatcccagacaggttcagtggcagcgggtctgggacagacttcactctcaccatcagcagactggagcngaagatttgctagtgtattactgtcagcagtatgtagctcgacggacgttcggaccaagggaccaaggtaggtaaacgtacgaaacgaacgtagtcggacgtcgaccacaactctgtcttacacttcctcccgtcctatccg

SEQ ID NO: 245135 - DNA, 580 bp, Homo sapiens
  misc_feature: GYAE6OF02I5CJK.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaacctggccaggttcccagcctcctcatctatggtatactcccaccgagggcctacgtcggccatccccagactaggttcaggtcggcaggcgggtctgggacaggtacttcactctcaccatcagcagactggacgcctagaagtatttgactagtgttattactgtacagtctagtataggtagcgtacgacggtacgttacggaccgaacgggaccgaagggtacggaaacgtaacgaaacgaacgtagtaggtacgtcggacctaccgtattaccgttcgttacttactaccttaccttccccgtacctacgtaccg

SEQ ID NO: 245136 - DNA, 560 bp, Homo sapiens
  misc_feature: GYAE6OF02GNCKT.5.59.F04.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctntcctgcagggccagtcagaatgttaccaanaggttcagcctggtaccagcaagaacctggccaggttcccagcctcctcatctatggtatactccaccgagggccacgtggcactcccagacaggttcaggtggcaggcgggtctggggacaggacttcactctacacatcagcagactggagcctagaagtatttgcgtagtgtattacgtgtcagtcgtagtagtggtagtctacgacggtacggttaccggacgtaacgggaccgaaggtaacggaaacgtaacgaaacgaacgtggtacggacgtcgaccactacgtctacgtcttactacttcctcccgtactactccg

SEQ ID NO: 245137 - DNA, 559 bp, Homo sapiens
  misc_feature: GYAE6OF02FIIR7.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatccagacaggttcagtggcagcgggtctggggacagacttcactctcaccatcagcagactggagcctgaagtattttgctagtgtattactgtcagcagtagtggtagcgtcacggtacgttcggaccgaagggaccgaagggtacggaaagtaccgaaacgtaactaggtaggacgtacggaccaaccgtacttccgttagttccgttctacgttcctttccccggtacctacgttaccg

SEQ ID NO: 245138 - DNA, 532 bp, Homo sapiens
  misc_feature: GYAE6OF02HWNPN.5.59.F04.1.454.CMB.1.raw
  modified_base (196)..(196): a, c, t, g, unknown or other
  misc_feature (196)..(196): n is a, c, g, or t
  modified_base (383)..(383): a, c, t, g, unknown or other
  misc_feature (383)..(383): n is a, c, g, or t
  modified_base (427)..(427): a, c, t, g, unknown or other
  misc_feature (427)..(427): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccacagggccatggcactcccaagcaggttcaggtggcaggcgggtctggggacagacttcactctacacatcagcagctgganctagagtatttgcgtagtgtattacgtgtcagtcagtatggtancgtcgacgggtacgttcggaccgaacgggacgaaggtaggaaatacgaaacgtagtgtaggtcgtgaccacgtatcgtagtcttcacttcctaccgtcctagtcg

SEQ ID NO: 245139 - DNA, 542 bp, Homo sapiens
  misc_feature: GYAE6OF02F53JC.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaanaggttcgtagcctggtaccagcagaaacctggccaggttcccagcctcctcatctatggtatactccaccgagggccacgtggcactcccagacaggttcagtggcagcggtctgggacagacttcactctcacatcagcagactggagcctgaagtattttgctagtgttattactgtctagctagtagtggtagcgtacgacggtacggttcggaccgaacgggaccgtaaggtagaaacgtacgaaacgtacgtagtcggcgtcgcactactcgtagttcttctacttccttcccgtcctatcg

SEQ ID NO: 245140 - DNA, 565 bp, Homo sapiens
  misc_feature: GYAE6OF02IGS03.5.59.F04.1.454.CMB.1.raw
  modified_base (196)..(196): a, c, t, g, unknown or other
  misc_feature (196)..(196): n is a, c, g, or t
  modified_base (370)..(370): a, c, t, g, unknown or other
  misc_feature (370)..(370): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcaagaacctggccaggttcccagcctcctcatctatggtatatcccaccgagggccacgtggcactcccagacaggttcagtggcaggcgggtctgggacagtacttcactcncaccatcagcagtacgtggagcctagtaagtattttgactagttagtattactgtacgagctagttagtggtagctcgacggtacggttcggaccgaacgggacgaagggtacgaaagtaaccgaaacgtacgtaggtcggtacgtcgaccacctagttctagttccttctaccttccgttaccccgcctatccg

SEQ ID NO: 245141 - DNA, 801 bp, Homo sapiens
  misc_feature: GYAE6OF02J1X7U.5.59.F04.1.454.CMB.1.raw
  modified_base (192)..(192): a, c, t, g, unknown or other
  misc_feature (192)..(192): n is a, c, g, or t
  modified_base (201)..(201): a, c, t, g, unknown or other
  misc_feature (201)..(201): n is a, c, g, or t
tcagatcagacacgcacgaccggtgctcgatttagtacacacacttagggattgggtgctcagttaggacccagagggaaccatggaaacccagcgcagcttctcttcctcctgctactctggcctcccagatgccaccggaagactgtgttgacgcagtctccaggcacctgtcttgtctacgaggggaanagccacctntcctgcagggccagtcaagatcgttaccacaggttcgtagccgttaggtaccagccaagaacctggaccacggttccccagccgttacctcgacttcgtaactgggtactaacgttcccaaccgtacgggacccacgtgggacctaacgttcccccgaagtacccgagggtttaccaacggttcggaccgtaacgccggggggttaaccttcgggggaaccgaaggtaacctttccacgttcctaccgtaccgaacttacgacggtacaacgggacctagggtaacgacctggtaaacgttcgttttaacggaccgttaagtcgtttaacgtttaccgtaggttaccgaacggttcgtaaacggttcgttaggggttacctaccggttaccggtaccggtaaaccggggttttccggtaacccggtaaacggggtacccggtaaaagggttaccgggtaaacgttaaacccggtaaaacggccgtttaacgggtacggtcggttaaaccggacctaaacccgtacgtttacccgggtttattacccgggtttactaaaccgtttacccgggttaccccggtaccttacccgtttaaccgg

SEQ ID NO: 245142 - DNA, 529 bp, Homo sapiens
  misc_feature: GYAE6OF02INCDO.5.59.F04.1.454.CMB.1.raw
  modified_base (197)..(197): a, c, t, g, unknown or other
  misc_feature (197)..(197): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
  modified_base (432)..(432): a, c, t, g, unknown or other
  misc_feature (432)..(432): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttcccagcctctcatctatggtatatccaccagggccacgtggacactcccagacaggttccagtggcaggcggtctgggacagacttcgactctcacatcgagcagactggacnctagaatntttgctagtgtattactgtacagacagttatggtanctagacgtacgtcggacagggacgaggtagaaatacgaacgacgtagtaggctgacaacagttactgttacttcgacgttacctcccgtaccatccg

SEQ ID NO: 245143 - DNA, 571 bp, Homo sapiens
  misc_feature: GYAE6OF02I8WKE.5.59.F04.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccaggggaaangccaccctntcctgcagggccagtcagaatcgttaaccaacgaggttcgtagcctggtaaccagcaagaaacctggcctaagttcccagcctcctcatctatggtatactccaccacggccactggacactcccagacaggttcaggtgctagcggtctgggacagtacttcgactctcaacatcagacagacgtggacgtcctagaagtactttgcgtagtacgttattaacgtgtacgtaagtcagttagtgtagcgtacgtacggtacgttcgggaaccgaacggacgaaggtaagaaacgtacaaacgaactgtggtacgacgtaccacgtactcgtacgttctacttacgtccgtcccgtactactacg

SEQ ID NO: 245144 - DNA, 535 bp, Homo sapiens
  misc_feature: GYAE6OF02IIL2J.5.59.F04.1.454.CMB.1.raw
  modified_base (196)..(196): a, c, t, g, unknown or other
  misc_feature (196)..(196): n is a, c, g, or t
  modified_base (424)..(424): a, c, t, g, unknown or other
  misc_feature (424)..(424): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttctagcctggtaccagcagaaacctggccaggttcccagcctcctcatctatggtatatccacagggccactggcatccagacaggttcagtggcagcgggtctgggacaggacttcactctcacatcagcagactggacgcctagaagtatttgctagtgtattactgtcagcagtatggtanctcgacggtacgttcggacgaagggaccgtaaagggtaggaaactcgaaaacgtacgtagtaggctaggaccacgtaatcgtgttcttacacttccttacccgcctatccg

SEQ ID NO: 245145 - DNA, 522 bp, Homo sapiens
  misc_feature: GYAE6OF02GE4O7.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctggggacagacttcactctcaccatcagcagactggagcctgaagtattttgcagtgtattactgtcagcagtatggtagctcacggtacgttcggccgaagggaccgaagggtaggaaatacgaaacgaacgtagtggacgtgacacatctgtcttcacttccttcccgcctatcg

SEQ ID NO: 245146 - DNA, 536 bp, Homo sapiens
  misc_feature: GYAE6OF02I82JD.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagatgttaccaacaggttcgtagcctggtaccagcagaacctggccaggttcccagcctctcatctatggtatatccaccagggccactggcatcccagacaggttcagtgcagcggtctgggacaggacttcactctcacatcagcagactggacgcctagaagtattttgctagttgttattacgtgtcagcgtagtagtggtagctacgacggtacgttcgaccgaaggaccgaaggtaggaaacgtacgaaacgaacgtgtaggctgacctaccacgttactagtcttactacttccttcccgacctatcg

SEQ ID NO: 245147 - DNA, 549 bp, Homo sapiens
  misc_feature: GYAE6OF02I28D8.5.59.F04.1.454.CMB.1.raw
  modified_base (196)..(196): a, c, t, g, unknown or other
  misc_feature (196)..(196): n is a, c, g, or t
  modified_base (365)..(365): a, c, t, g, unknown or other
  misc_feature (365)..(365): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctcctcatctatggtatatccaccagggccactggcatccccagacaggttcagtggcagcgggtctgggacagacttcactcncaccatcagcagactggagcctagaagtattttgctagtgttattactgtcagcagtatggtagctacgacggtaccgttcggaccgaacgggaccgaaggtaggaaagtaacgaaacgaacgtagtaggtacgtcgtaccaccgtaactcgtacgttcttcgtattccttcctccgtcctacg

SEQ ID NO: 245148 - DNA, 523 bp, Homo sapiens
  misc_feature: GYAE6OF02FKHO8.5.59.F04.1.454.CMB.1.raw
  modified_base (196)..(196): a, c, t, g, unknown or other
  misc_feature (196)..(196): n is a, c, g, or t
  modified_base (398)..(398): a, c, t, g, unknown or other
  misc_feature (398)..(398): n is a, c, g, or t
  modified_base (498)..(498): a, c, t, g, unknown or other
  misc_feature (498)..(498): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctcctcatctatggtatactcccaccgagggccactggcactcccagacaggttcagtggcaggcggtctaggaacagacttcactctacacatcagcagactggacgctagaagtntttagctagttgtattactgtactagctagtatgtagctcgacggtacgttcgaccgaaggacgaaggtagaaatacgaaacgagtgtagcgtaggcacntctgtcttcattcctccgctactcg

SEQ ID NO: 245149 - DNA, 520 bp, Homo sapiens
  misc_feature: GYAE6OF02FGI1E.5.59.F04.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccgggaaagactgtgttgacgctagtctccaggcaccctgtctttgtctccaggggaaagngccaccctntcctgcgagggccagtcagatgttaccaacaggttcgtagcctggtaccagcagaaacctggccaggttcccagcctcctcatctatggtatatccaccgaggccactggcatcccagacaggttcagtggcaggcggtctgggacagacttcactctcacatcagcagctggagctagagtatttgctagtgtattactgtcagcagtatgtagctacgacggtacgttcggaccgaacgggaccgaaggtagaaacgtacgaacgaactgaggcgtgcaccatctgttcttctacttctcccgcctatcg

SEQ ID NO: 245150 - DNA, 635 bp, Homo sapiens
  misc_feature: GYAE6OF02JCWQ8.5.59.F04.1.454.CMB.1.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaanaggttcgtagcctggtaccagcagaacctggccaggttcccagcctcctcatctatggtatactcccaaccgagggcccacgtggaccatccccagaccgtaggttcaggtggcaggcgggtctgggacagacttcgactcgtacaccatcagcagactggacgcctgaagtattttgctagttagttacttactagttacagtacgtagttacgtagggttacgtacgttaccgtacgggttaccggttaccgggtaccgaaacggggtaacccgtaaagggtaacgggtaaacgtaacgaaaccgtaacgtaggtacggtacgtcggtaccaaccgtaacgttaccgttacgttccgtttacgtaccttacccgttccccggtaccctacgttaccg

SEQ ID NO: 245151 - DNA, 514 bp, Homo sapiens
  misc_feature: GYAE6OF02F86XI.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctcctcatctatggtatatccacagggccactggcatcccagacaggttcagtgcagcggtctgggacagacttcactctcaccatcagcagactggagcctagaagattttgctagtgttattactgtacagctagtatggtagctcgacggtacgttcggaccgaagggaccgaagggtagaaatacgaaacgactgtaggctgacacatctgtctcactctcccgctatc

SEQ ID NO: 245152 - DNA, 556 bp, Homo sapiens
  misc_feature: GYAE6OF02GOORM.5.59.F04.1.454.CMB.1.raw
  modified_base (197)..(197): a, c, t, g, unknown or other
  misc_feature (197)..(197): n is a, c, g, or t
  modified_base (397)..(397): a, c, t, g, unknown or other
  misc_feature (397)..(397): n is a, c, g, or t
  modified_base (438)..(438): a, c, t, g, unknown or other
  misc_feature (438)..(438): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttctagcctggtaccagcagaacctggccaggttcccagcctcctcatctatggtatatcccaccgagggccactggcactcccagacaggttcagtcggcaggcgggtctggggacagacttcactctcaccatcagcagactggacgctagaagtntttgcgtagtgttaattacgtgtactagctagtagtaggtnctacgacggtacgttcggaccgaagggtacgaaggtagtaaacgtacgaacgacgtagtacggtcgtacgaccaccgtagtcgttcgtctttcgacttaccgttcccgtacctatccg

SEQ ID NO: 245153 - DNA, 639 bp, Homo sapiens
  misc_feature: GYAE6OF02G3RI4.5.59.F04.1.454.CMB.1.raw
  modified_base (195)..(195): a, c, t, g, unknown or other
  misc_feature (195)..(195): n is a, c, g, or t
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (277)..(277): a, c, t, g, unknown or other
  misc_feature (277)..(277): n is a, c, g, or t
  modified_base (392)..(392): a, c, t, g, unknown or other
  misc_feature (392)..(392): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctccgaggggaaangccacctctcctgcagggccagtcagatgtacanaggttctancctggaccagcagaacctggccaggttcccagcctcctnatctatggtatactccacgacggcctacgtggcactccagactaggttcaggtgcaggcggtactgggacagtacttcactctacacatcagcagacgtggacgtctagaagttntttagacgtagttacgttacttacggtcgtaacgagtacgtaaggttagttagggtactacgttaccggtaaccgggttaaccggtttccgggaacccggtaaacggggtaaccgttaaaggggttaaacgggtaaaaccttaaccgaaaacgggtaccttagggtacggtaccgtacggtaaccgtaccgtacgttacgttacgttactttccgtactttccccgttaccgtaccgtacttaccgg

SEQ ID NO: 245154 - DNA, 517 bp, Homo sapiens
  misc_feature: GYAE6OF02GPOJP.5.59.F04.1.454.CMB.1.raw
  modified_base (196)..(196): a, c, t, g, unknown or other
  misc_feature (196)..(196): n is a, c, g, or t
  modified_base (433)..(433): a, c, t, g, unknown or other
  misc_feature (433)..(433): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatactcccaccagggccacgtggcactcccagacaggttcagtggcaggcggtctgggacagacttcactctcacatcagcagactggacgcctagaagtatttgactagtgtattactgtcagctagtagtaggtanctacgacggtacgtcgaccgaaggacgaaggtgaaatacgaacgactgtgcgtgacacatctgtctcacttcctcccgctatcg

SEQ ID NO: 245155 - DNA, 550 bp, Homo sapiens
  misc_feature: GYAE6OF02F4JKE.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgctagtagtattactgtcagctagtagtggtagtctcgacggtacgttcggacgaacgggacgaaggtagaaacgtacgaaacgaacgtaggtaggtcgtgaccaaccgtatcgttagttacttcgtacttccgttaccccgtacctacttaccg

SEQ ID NO: 245156 - DNA, 629 bp, Homo sapiens
  misc_feature: GYAE6OF02JC2HD.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcaagaatcgttaaccaactagggttctagcctggtaccagcacgaaacctggaccaggtcccagcctcctcatctatggtatatcccaccgagggccacgtggcactcccagaccagttcagtcgcaggcggtctgggaccagtaccttacactctcaactatccgaacgcacgtacgtaggactccgtagaacgttactttcggactaggttagttaacttacgtgttcgaagtactaagtacgtgggtacgacgttaccgtacgggtaccggttacggacccggaaagggtaaccggtaaagggttaacggtaaacgtaacgtaaaccggtactacgggttaggaccgtacggacctacaacgttcttacgttcctcgtaccgttccttaccccgtcttccgtaccgg

SEQ ID NO: 245157 - DNA, 545 bp, Homo sapiens
  misc_feature: GYAE6OF02JFJX3.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (343)..(343): a, c, t, g, unknown or other
  misc_feature (343)..(343): n is a, c, g, or t
  modified_base (377)..(377): a, c, t, g, unknown or other
  misc_feature (377)..(377): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctntcctgcagggccagtcagaatgttaccaacnggttcgagcctggtaccagcagaaacctggccaggttcccagcctcctcatctatggtatatccaccagggccactggcatcccagacaggttcagtggcagcggtcngggacagacttcactctcacatcagcagctggancctgaagtagtttgctagtgtattactgtcagcagtatggtagctacgacggtacgttcggaccgaagggaccgaagggtacggaaactacgaaacgtacgtgtaggcgtacggaccaaccgtagtcgtacgttcttacctacgttcccgttacccgtcctacgtccg

SEQ ID NO: 245158 - DNA, 779 bp, Homo sapiens
  misc_feature: GYAE6OF02GNPB4.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaaangccacctctcctgcagggccagtcagaatgtaccaatggttcagcctggtaccagcaagaaacctggaccaggttcccagcctacctcatctagtggttaatactcccgaaccgacgggtcccaacgttggacctaacgtccccgaaggtacgtagggtttcaggttcggcctaagggtccgggtctaggggactaacggtacctttacgactccgttacgaaacccgtataccgaacgaccgaacggtaacgttcgggaacgtacccgtaaggtaaacgttaacgtttttacggaccgttaaaggtttcgttaaacgttaaccgttggttaccggtaagtaccgtaaggtttaagtacgggttacgtacccgttacggaaccggggttaaccggtttaccgggaacccgtaaagggggaacccgttaaacggggtaacgtaaaacggtaaccgtaaaaccggtaacggttacgggtacggttaccggttaccggaaccgtaaccgtaaccggttccgtttaacggtttacccttaccgttaaccggttccccgttttaccccggaccttaacggttacccgg

SEQ ID NO: 245159 - DNA, 691 bp, Homo sapiens
  misc_feature: GYAE6OF02JSLFL.5.59.F04.1.454.CMB.1.raw
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (369)..(369): a, c, t, g, unknown or other
  misc_feature (369)..(369): n is a, c, g, or t
tcagatcagacacgcacgaccggtgctcgatttagtacacacacttagggagttggggtgctcagttaggacccagacgggaaccagtcggaaaccccaggaccgcagcttctcttcctcctgcctactctggctcccagactgccaccggaaagactgtgtgacgcagtctccaggcacctgtctttgtctccgaggggaaangaccaccctctcctgcaggccagtcagatgtacangtcagctggacngcagaactgcagtccagcctctcatctatggtatactcccgacgtagggaccacgtcggactaacgtccccgaagaccgtaaggtttccaagggttcggagacgggtcggggttacgnggggtaaccaggtacctttacgacttctaccgactatccgaagtccaagtaccgtagggacgccgttagaagttacgtttacgacttaggttacggtttacttaacgttacgttacgaacgtagttacggttaacttagggtaccgtcgttaccgggtaccgggtaacccgtttacgggaccgtaaaccggggacgtaacgggtaacggtaaaactaccggtaaaacgtaaccgtaggtaacgggtcgtacgtaccgtaaacctacgttacgttacgttctttaccgtaccggttacccttacccgtaccgttaaccgttcg

SEQ ID NO: 245160 - DNA, 546 bp, Homo sapiens
  misc_feature: GYAE6OF02IDY3F.5.59.F04.1.454.CMB.1.raw
  modified_base (195)..(195): a, c, t, g, unknown or other
  misc_feature (195)..(195): n is a, c, g, or t
  modified_base (362)..(362): a, c, t, g, unknown or other
  misc_feature (362)..(362): n is a, c, g, or t
  modified_base (425)..(425): a, c, t, g, unknown or other
  misc_feature (425)..(425): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaangccaccctctcctgcagggccagtcagaatgttaccaacaggttcgagcctggtaccagcagaacctggccaggttcccagcctcctcatctatggtatatcccaccagggccacgtggcatcccagacaggtcagtggcaggcgggtctgggacagacttcactcncacatcagcagactggagctagaagtatttgctagtgtattacgtgtacagctagtatggtancgtcgacggtacgttcgaccgaacgggaccgtaaggtaggaaactacgaaacgacgtaggtacggtacgtggaccgaaccagttcctgttcttcgtacttcccgttcccgtaccctatccg

SEQ ID NO: 245161 - DNA, 973 bp, Homo sapiens
  misc_feature: GYAE6OF02JITXL.5.59.F04.1.454.CMB.1.raw
  modified_base (207)..(207): a, c, t, g, unknown or other
  misc_feature (207)..(207): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccgggaaagacctggtgttggacgcaggtcctccgaggccaccctgttctttgtctccgaaggggaaancgccacccttctcctgccgagggccagtcaagtaactcgttaaccaacgtaggttcgacgccctggtaacccaggaccaacggtaaaacccttggacccgtaacgggtttcccccaaggtccccttccgtacgtacttaccgttacgttcgggttaacttaacccgttacccgacccggtaaggggtcccctaaccgttcgggacctaaccgtaccccggaaacggtcccgtaacggggtttccgtaaacgggttcgggtaccacggggttcccggggttacgttacgggggaacctaacgtaacccgtttccgaaccggttccttacccgaaacccgttacgttcccggtaaacggtcccgtaaacgggtaccgttaacgggggtaccgtacccggttaacgggtaaacgtttaccggtttttaccggaccggttaaacgggtttacggttaaccgttttaaacgttccggttacggtaaccggttccgttaaacggtttaacggttcgggtttaaccgtaccggtttaaccggtaaccggggttacccgggttacgggtaaccccgggtaacgggttaacccggtaaacgggttaacggggtaaaccgtaaacccggtaaacgggttaaaccgttacgggttaaccgggtacccgttaacgggttaacccgtaaccggttaaccgtttaccggttaccgggtttacccgttaccgtttaccggtttacccggtttaccccgtacccggttacgtttaacccggg

SEQ ID NO: 245162 - DNA, 565 bp, Homo sapiens
  misc_feature: GYAE6OF02H7UUO.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctggggacagacttcactctcaccatcagcagactggacgcctgagtattttgcagtgtattactgtcagtctagtagttggtagtctcgaccggtacgttccggaccgtaacggggaaccgaagggtaggaaaacgtacgaaaacgaactggtaggtacgtggaccaaccgtataccgttgttactttcgacttcctttaccccgtaccctacgttaccg

SEQ ID NO: 245163 - DNA, 562 bp, Homo sapiens
  misc_feature: GYAE6OF02GPBDT.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaacctggccaggttcccagcctcctcatctatggtatactccgaccagggccacgtggccactcccagacaggttcaggtgcaggcgggtctgggacagtcttcactctcaccatcagcagacgtgacgctagaagtatttgactagttgtattactgtcagctagtagtggtagctacgacggtaccgttcggaccgaaggaccgtaaggtacgaaactaccgaaacgtacgtaggtacggacgtacgaccaaccgtattcgttagtacttactaccttcccgttacccgacctacgttccg

SEQ ID NO: 245164 - DNA, 689 bp, Homo sapiens
  misc_feature: GYAE6OF02I5MHZ.5.59.F04.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctccgagggaaanacgccaccctctcctgcagggccagtcagatcgtaccaanaggttcgagcctggtaccagcaagaacctggccaggttcccagtcctcctcactctatggtatactcccaccgaggcctacgtggccaactcccgaagaaccgtaggtttaccgaggttcggacgtacgggtccgggtacgtacggggaacgtaacgtaccgttaccacgttcctaccaacctaactccgaagcctaacgtacgtacggacgtactaggtaacgttagttttacgacgttaggttagttaacttacgtgtaacgagtacgtaggttacgtagggtacgtacgtaccgtacgggtaccgttacgggaaccggtaaacgggaacgtaagggtaaacggaaacgttaacgtaaacggtaacggtaggtacggtactacggtaccctaacgtacgttaccgttgttaccgttaccgtacctttacccttcccgtacctacgttcccgg

SEQ ID NO: 245165 - DNA, 611 bp, Homo sapiens
  misc_feature: GYAE6OF02G38E1.5.59.F04.1.454.CMB.1.raw
  modified_base (195)..(195): a, c, t, g, unknown or other
  misc_feature (195)..(195): n is a, c, g, or t
  modified_base (280)..(280): a, c, t, g, unknown or other
  misc_feature (280)..(280): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaccaacaggttctagcctggtaccagcagaacctggccaggtcccagcctcncatctatggtatatcccaccgaggccacgtggcactccccgagacctacgggttacacggtggacctacggcggggttctagggggacaggtaccttcacttctcaacctatcgagccagacgtggacgtccgtagaagttagtttcgacgtagttgttattacgtgtacgtacgctaggttagtcggtacgtcgtacgacggtacgttaccgggacgtaacgggacctaagggtacggaaactacgaacgtacgtggtacggtacctggtaccaaccgtacgttccgttcgttaccgttctaccgttcccgtttacccgctacgttccgg

SEQ ID NO: 245166 - DNA, 547 bp, Homo sapiens
  misc_feature: GYAE6OF02GRTLY.5.59.F04.1.454.CMB.1.raw
  modified_base (197)..(197): a, c, t, g, unknown or other
  misc_feature (197)..(197): n is a, c, g, or t
  modified_base (355)..(355): a, c, t, g, unknown or other
  misc_feature (355)..(355): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaanagccaccctctcctgcagggccagtcagaatgttaccaacaggttcgagcctggtaccagcagaaacctggccaggttcccagcctcctcatctatggtatatcccacgagggccacgtggcatcccagacaggttcagtggcaggcggtctgggacngacttcactcacacatcagcagctggagcctagaagtatttgcgtaggtgttacttactgtacagctagttatggtagctcgacgggtacgttcggacgaacgggacgaaggtagtaaagtacgaacgtagtagtcgacgtcgactaccgtattacgtcgttcttactacgtccgtttcccgacctattccg

SEQ ID NO: 245167 - DNA, 583 bp, Homo sapiens
  misc_feature: GYAE6OF02J1Q63.5.59.F04.1.454.CMB.1.raw
  modified_base (196)..(196): a, c, t, g, unknown or other
  misc_feature (196)..(196): n is a, c, g, or t
  modified_base (360)..(360): a, c, t, g, unknown or other
  misc_feature (360)..(360): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgagcctggtaccagcagaaacctggccaggttcccagcctcctcattctatggtatactcccaccagggtccacgttggcactcccagacaggttcaggtcgcaggcgggtctgggacngtactcgactctacaccatcagcagtactggacgcctaggtaagttactttggactagtgttacttacgtgtactagcgttaagtagttggtacgtcgttacgacggtcggtacggacgtaacgggaacgtaacggtacgtaaacgtacgaacgaacgtggtacggtcgacgtccgtacagttcctacgttctacctacgttacccgtccgtaccgtattccg

SEQ ID NO: 245168 - DNA, 606 bp, Homo sapiens
  misc_feature: GYAE6OF02F6WMT.5.59.F04.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagacttgtgttgacgcagtctccaggcaccctgtctttgtctccaggggaaangccaccctctcctgcagggccagtcagatgttaccanggttcgagcctggtaccagcagaaacctggccaggttcccagcctcctcactctatggtatacgtcccaccgagggccacgttggacctaactccccgaagaccgaggtttcaaggtggacaggcgggttcgtaggggactaggacctttacacctctacaacctatcgaacgcaacgactggacgacctaggtaagtagtttgactagttgtaattactgtactagtacgagtagtaggtagtcgtacgacggtacggttaccggacgaacgggaaccgtaaggtaaggaaactacgaaacgtacgtagtacggacgtacgactaccgtactacgttgttcgttacacgttacctcccgtactacgttccg

SEQ ID NO: 245169 - DNA, 663 bp, Homo sapiens
  misc_feature: GYAE6OF02IIXHB.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcctaccctctcctgcagggccagtcagaatcgttaaccaacgtaggttcgtagccctggtacccagccaagaaacctggaccaggttcccagtccctcctcatctatcggtatactccaccacgggccacgtggaccacttccccgaagtaccgtaggttccaaggttcggaccgacgggtcgggtacgtcgggggaaccagtaaccctttcgtaacctcctcgaaccgtatcaggctacggacttagggacgtccgtaggtaagtacgttttgccgtagttagttattacgtgtacgtacgactagtagtggtagcgtaccgtacggtaccgttacgggaccgaagggtaccgtaaggtaacggtaaacgtaaccgtaacgtaacttggtacggtacggtcgtaccgtaaccctacgttcgttacgttcgttacgtaccgttaccgtcccgtaccacgttacgg

SEQ ID NO: 245170 - DNA, 555 bp, Homo sapiens
  misc_feature: GYAE6OF02HHDK1.5.59.F04.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaagngccaccctctcctgcaggccagtcagaatgttaccaacnggttcgtagcctggtaccagcagaaacctggccaggttcccagactcctcatctatggtatatccaccagggccactggcatcccagacaggttcagtgcaggcggtctggggacagacttcactcncaccatcagcagctggacgcctagaagtntttgctagtgtattactgtcagctagtagtgtagctcgacggtacgttcggaccgaacgggaccgaagggtacggaaataccgaaacgtaccgtaggtaggaccgtaggaccaccgtattcgtcgttacttctaccgttcccgtaccccgtcctacttaccg

SEQ ID NO: 245171 - DNA, 535 bp, Homo sapiens
  misc_feature: GYAE6OF02G2TTL.5.59.F04.1.454.CMB.1.raw
  modified_base (196)..(196): a, c, t, g, unknown or other
  misc_feature (196)..(196): n is a, c, g, or t
  modified_base (345)..(345): a, c, t, g, unknown or other
  misc_feature (345)..(345): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaaacctggccaggttcccagcctcctcatctatggtatatccaccagggccactggcatcccagacaggttcagtgcagcggtcngggacagacttcactctacaccatcagcagactggacgcctgaagtatttgactagtgtattacgtgtcagactagttatggtagctcgacggtacgttcggaccgaagggaccgaaggtaggaaactacgaaacgacgtagtaggtacgtgacaccgatcgtgtcttcgtactccgttcccgcctatcg

SEQ ID NO: 245172 - DNA, 525 bp, Homo sapiens
  misc_feature: GYAE6OF02IVPHH.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (426)..(426): a, c, t, g, unknown or other
  misc_feature (426)..(426): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaanaggttctagcctggtaccagcagaaacctggccaggttcccagcctctcatctatggtatatccacagggccactggcatcccagacaggttcagtggcagcgggtctgggacagacttcactctcaccatcagcagactggacgcctgaagtattttgctagtgtattactgtacagactagtatggtanctcgacggtacgttcggaccgaacgggtaccgaaggtaggaaatacgaaacgacgtgtaggcgtgacacatctagtcttctacttcgtcccgtcatacg

SEQ ID NO: 245173 - DNA, 566 bp, Homo sapiens
  misc_feature: GYAE6OF02JA5J6.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccaccctctcctgcagggccagtcagaatcgttaccaacaggttcgtagcctggtaccagcaagaaacctggccaggttcccagcctcctcatctatggtatatccaccagggccactggcatcccagacaggttcagtggcaggcgggtctggggacagaccttcactctcaccatccagcagctggagcctagaagtattttgctagtgtattactgttacagtcaggtatggtagcgtacgaccggtacggttcggaccgtaacgggaccgtaaagggtaggaaacgtacgaaacgtaacgtggtaggccgtgaccacctacgtacttacgttacttcgtacttcccttacccgtcctattccg

SEQ ID NO: 245174 - DNA, 760 bp, Homo sapiens
  misc_feature: GYAE6OF02HJCEC.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaancgcccaccctctcctgcagggccagtcagaatcgttaccaacaggttcgagcctggtaccagcaagaacctggaccaggttcccagccctcctcatctatggtatactcccaccgagggcccacgtggacctactccccgaagacctaggttcaggttcggccgacgggtcggggttacgtggggaaccacggtaccttccaacgttcctaccgaaccctaagttccgaacggtccaagggtaccgtacgggacgtacccgttaggtaaacgttacgttttacggaccgttaggtttacgttaacgtttacgttcggtaccgtacgtacgtaacggttaagttacgggttaacgtaccgttaccggtaaccgggttaccggtttaccgggaaccggtaaacggggtaacccggtaaacggggttaacggtaaaacgtaaccggtaaaccggtaaccggttacggtacgggtaccgttacggaacccgtaaccgtaacgttaccgttacggttaccgtttaccgtaaccgtttacccgttaccccggtaccctaccgttaccgg

SEQ ID NO: 245175 - DNA, 569 bp, Homo sapiens
  misc_feature: GYAE6OF02I9C5S.5.59.F04.1.454.CMB.1.raw
  modified_base (196)..(196): a, c, t, g, unknown or other
  misc_feature (196)..(196): n is a, c, g, or t
  modified_base (516)..(516): a, c, t, g, unknown or other
  misc_feature (516)..(516): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaaangccaccctctcctgcagggccagtcaagaatgttaaccaacgaggttcgagcctggtaccagcaagaacctggaccaggttcccagtcctcctacatctagtggtatactccacgaggccactggcactcccagacaggttcagtcgcaggcggtctgggacagtacttcacgtctacacctatcagacagacgtggacgtaccgtagaagttagtttacgacgtagttagtaacttacgtgtacagctaagtagtgtagctacgacggtaccgtacggaccgaacgggacaagggtagaaagtacgaacgacgttacgnggtacgcgtacaccgacgtcgtatcgttactacgtacctcccgtactacgtcg

SEQ ID NO: 245176 - DNA, 588 bp, Homo sapiens
  misc_feature: GYAE6OF02I3ZQB.5.59.F04.1.454.CMB.1.raw
  modified_base (199)..(199): a, c, t, g, unknown or other
  misc_feature (199)..(199): n is a, c, g, or t
  modified_base (346)..(346): a, c, t, g, unknown or other
  misc_feature (346)..(346): n is a, c, g, or t
  modified_base (390)..(390): a, c, t, g, unknown or other
  misc_feature (390)..(390): n is a, c, g, or t
  modified_base (457)..(457): a, c, t, g, unknown or other
  misc_feature (457)..(457): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccgaggggaaagngcccacctctcctgcgagggccagtcaagaatgttaaccaactaggttccgtagcccgttggtaacccagccaagaaacctggaccaggttaccccagcctcctcatctaatggtatatccacgaggccacgtggacatcccagacnggttcacgtggcagcggggtactggggacagtacttcacttcgnaccagtcagcgagacgtgacgcctgaagtgttttagacgtagtagttagttactgtcagtcagtagngttagctacgacggtacgttacgaccgaacgggacgaaggtagaaacgtaaccgaacgtaacgtgtacggcgtacgacgtaaccgagttccgtagttcttacgtaccttccgttacccgtccgtattaccg

SEQ ID NO: 245177 - DNA, 587 bp, Homo sapiens
  misc_feature: GYAE6OF02HYI1J.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgttaccaacaggttcagcctggtaccagcaagaaacctggccaggttcccagcctcctcatctatggtatatccaccagggccacgtggcactcccagacaggttcagtggcaggcggtctgggacagcttcactctacacatcagcagactggacgcctagaagtatttgactagtgtattacgtgtacagtacgtagtagtaggtagtcgtacgacggtacggttccgggtaccgaaacgggaccgaaagggtacggtaaaacgtaacgaaacgtaacgttacggtacggtacgtcggacctaaccgtacgttaccgtagttaccgttctacgttcccgttacccgtacctacgtccg

SEQ ID NO: 245178 - DNA, 689 bp, Homo sapiens
  misc_feature: GYAE6OF02HU85A.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatcgttaccaacgaggttcgtagcctggtaccagccaagaaccgtggcctacggtcccagcctcctcatctatggtatactcccacgacgggccacgtcggcactcccagactaggttcaggtcggcgaggtccggggttcgtggggaactaggtaccttcgactcctaccaaccgtactcgaacggccaagtacgtacgggacgtccgtagtaagttacttttaggactaggttacgttaatttacgttgtacgtaacggtactaaggttagttagggtacgtaccgtacggtaaccgggttaccggttaccgggaaccggtaaacggggtaaccgtaaagggtaacggtaaaacgtaaccgtaaaacggtaacgttcggttacggtaccgtacggaacctaccgtaacgttaccgttacgttccttacgtaccgttcccgtacccgtaccctacgttaccgg

SEQ ID NO: 245179 - DNA, 595 bp, Homo sapiens
  misc_feature: GYAE6OF02I5C6F.5.59.F04.1.454.CMB.1.raw
  modified_base (198)..(198): a, c, t, g, unknown or other
  misc_feature (198)..(198): n is a, c, g, or t
  modified_base (390)..(390): a, c, t, g, unknown or other
  misc_feature (390)..(390): n is a, c, g, or t
  modified_base (421)..(421): a, c, t, g, unknown or other
  misc_feature (421)..(421): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccgaggcaccctgtcttgtctccgaaggggaaancgccaccctctcctgcagggccagtcagaactcgttaaccaacgtaggttcgtagcctggtaccagaccaagaaacctcggaccaggttcccaagtcctcctcatctataggtatactccgaacccgacgggccacgtggacctaactccccgaagactacggttctaggtcggcgaggcggtcgtgggacngacttcactctacaccatcagcagctggacncgagtaagtntttgntagtntattcattacgangtagtagtggtacgtcgtacgacggtcgttacggacgaacgggtacgagggtaacggaaacgtaacgaaacgtaacgaggttcggtacgtgtaccaacgtagtccttagttcttactacgttacccttcccgactactccg

SEQ ID NO: 245180 - DNA, 629 bp, Homo sapiens
  misc_feature: GYAE6OF02JGODT.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgagcctggtaccagcagaacctggccaggtccagcctcctcatctatggtatatcccaccagggccactggcatcccagacaggttcaggtggcagcgggtctggggacagaccttcacgtctcaccatcacggctagactggacgcctaggaacgtattttcgactacgtgttacttacgtgttcaggtctaggttagtggtaacgcgttaccgacgggtacggttaccggaccggtaaacggggtacctaaagggtacggtaaacgttaaacgaaaccgtaacggttcggtttagggaccgtacggaccgtaacccgtacgttaaccgttcggttacccgtttacgtaaccgtttacccgtttaccccgtaccgtacgttacccgg

SEQ ID NO: 245181 - DNA, 530 bp, Homo sapiens
  misc_feature: GYAE6OF02GKHPS.5.59.F04.1.454.CMB.1.raw
  modified_base (196)..(196): a, c, t, g, unknown or other
  misc_feature (196)..(196): n is a, c, g, or t
  modified_base (234)..(234): a, c, t, g, unknown or other
  misc_feature (234)..(234): n is a, c, g, or t
  modified_base (377)..(377): a, c, t, g, unknown or other
  misc_feature (377)..(377): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgtaccaanaggttcagcctggtaccagcagaacctggccaggttcccagcctcctcatctatggtatatccaccagggccacgtggcatcccagacaggttcagtggcagcggtctgggacagcttcactctcacatcagcagactggacnccgtagaagtatttcgactagtgttattacgtgtcagctagtatgtagctcgacggtacgttcggaccgaagggtaccgtaaggtacgaaatacgaaacgacgtgtaggacgtgacctacgatcgtcgttctactactcctcccgactatccg

SEQ ID NO: 245182 - DNA, 556 bp, Homo sapiens
  misc_feature: GYAE6OF02FUZ84.5.59.F04.1.454.CMB.1.raw
  modified_base (196)..(196): a, c, t, g, unknown or other
  misc_feature (196)..(196): n is a, c, g, or t
  modified_base (365)..(365): a, c, t, g, unknown or other
  misc_feature (365)..(365): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttctagcctggtaccagcagaacctggccaggttcccagcctcctcatctatggtatatccaccgaggccactggcatcccagacaggttcagtggcaggcggtctgggacagacttcactctcacntcagcagctggacgccgtagaagtatttgcgtagtgtattacgtgttacgagctagtagtggtagtcgtacgacggtacgttcggaccgaacgggaccgtaagggtacggtaaacgtacgaaacgtacgtggtacggacgtcgaccaccacgtcttagttccttactacttaccttccccgtactattccg

SEQ ID NO: 245183 - DNA, 693 bp, Homo sapiens
  misc_feature: GYAE6OF02HVFDD.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcgagggccagtcagaatgttaccaactaggttcgagcctggtaccagcaagaaacctggtcacggttcccagcctcctcatctatggtatactccacagggccaacgtggcctactcccgaagtaccgtaggttccaggtcggacgacgggtcggggtcgtcggggaacacggtacttcacttcctacaacctatcagcaagtcgtagggacgtccgtaagtaacgttgttttacgactaaggttagttaacgttacttcgtactacggtactaaggttagttaggtacggtaccgttacggaaccgggttacggttaccgggaacccggtaaacgggtaaccgttaaaggggtaaacggtaaacgtaaacgaaaccggtaaacggttgggtaacggtcgtaaacggccctaaaccgtacgttaccgttagtttaccttaccgtaaccgtttccccggttaccccgtaccgtacgttaccgg

SEQ ID NO: 245184 - DNA, 557 bp, Homo sapiens
  misc_feature: GYAE6OF02IG74I.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcaagaaacctggccaggttcccagcctcctcatctatggtatatccacagggccactggcatcccagacaggttcagtgcagcggtctgggacaggacttcacgtctcaccatcagcaagctgagccgtagagtatttgctagtgtattactgtcagcagttagtggtagctacgacggtacggtttcggaccgaacgggtaaccgaaagggtacggaaactaacgaaacgaacgtacgtggacgtggaccaccgtactcgtacgttcttaccgtactcctttaccccgcctacttaccg

SEQ ID NO: 245185 - DNA, 518 bp, Homo sapiens
  misc_feature: GYAE6OF02FL903.5.59.F04.1.454.CMB.1.raw
  modified_base (197)..(197): a, c, t, g, unknown or other
  misc_feature (197)..(197): n is a, c, g, or t
  modified_base (476)..(476): a, c, t, g, unknown or other
  misc_feature (476)..(476): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtacccagcagaaacctggccaggttccccagcctcctcatctatggtatatccaccagggccactggcatcccagacaggttcagtggcaggcgggtctgggacagacttcactctcaccatcagcagactggagcctgaagtatttgcagtgtattactgtcagcagtatggtagctcgacggacgtcggaccgaagggacaaggtagaaatacaacgaactgnggcgtgcaccatctcgtcttacacttcctacccgtccatccg

SEQ ID NO: 245186 - DNA, 566 bp, Homo sapiens
  misc_feature: GYAE6OF02HY4BM.5.59.F04.1.454.CMB.1.raw
  modified_base (194)..(194): a, c, t, g, unknown or other
  misc_feature (194)..(194): n is a, c, g, or t
  modified_base (409)..(409): a, c, t, g, unknown or other
  misc_feature (409)..(409): n is a, c, g, or t
  modified_base (454)..(454): a, c, t, g, unknown or other
  misc_feature (454)..(454): n is a, c, g, or t
  modified_base (496)..(496): a, c, t, g, unknown or other
  misc_feature (496)..(496): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccaggcacctgtctttgctccgaggggaaangccaccctctcctgcagggccagtcagaatgtaccaataggttcagcctggtaccagcaagaacctggcctacggttcccagcctcctcatctatggtactactcccacgacgggccacgtcggaccactcccgaagacgtaggttcaggtggcaggcgggtcgtagggacagtacttcactcacacatcagcgagacgtgacgcgtagaagttntttgacgtagttagttattcgtgtacagtacgaggttatcggtanctcgacggtacgttacggacgaacgggacaagggtacgaaanacgtaaacgacgtgtacggtcgagaccaactagtcgttgttactacgtacttcccttaccgtctacttcg

SEQ ID NO: 245187 - DNA, 593 bp, Homo sapiens
  misc_feature: GYAE6OF02GEK3E.5.59.F04.1.454.CMB.1.raw
  modified_base (193)..(193): a, c, t, g, unknown or other
  misc_feature (193)..(193): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccaggggaangccaccctctcctgcagggccagtcagaatgttaccaactaggttcagcctggtaccagcagaacctggcccaggttcccagccctctcatctatggtatatccaccgagggccacgtcggcactcccagactaggttcagtggcaggcggtcngggacagacttnactctcaccatcagcagacgtggacgctgaagtatttagacgtagttgtattacgtgtcgtagcgtagttacgtaggtactcgtacgacggtaccggttacggtaccggtaacgggaaccgtaacgggtaggaaacgtaaccgaaacggtaacgtaggtacggtcgtacggacctaccgtacttccgttacgttacttctaccgttcccgtttaccccgtacctacgttacccg

SEQ ID NO: 245188 - DNA, 623 bp, Homo sapiens
  misc_feature: GYAE6OF02GI38I.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgttaccacaggttcgagcctggaccagcagaaacctggccaggttcccagcctcctcatctatggtatatccaccagggccacgtggcactcccagacaggttcaggtgcagcgggtctgggacagacttcactctcaccatcagcacgactaggacgtccgtagtaagtacgttttgacgtagtagttattacgttcgtactaggtctaacggttagttaggtacgtccttacgaacgggtaccggtttcgggaacccgtaaacggggaacccgtaaaggggtaacggaaacgttaaccgaaaaccgtaacgttacggtacggtacgtacggacctaaccgtacgttccttacggttccttactacctttcccgttccccgtacctacgttaccg

SEQ ID NO: 245189 - DNA, 545 bp, Homo sapiens
  misc_feature: GYAE6OF02FQ3UI.5.59.F04.1.454.CMB.1.raw
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
tcagatcagacacgcacgaccggtgctcgatttagtacacacacttagggattggggtgctcagttaggacccagagggaaccatggaaacccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacnggttcgtagcctggtaccagcagaacctgccaggttcccagcctctcatctatggtatatccaccaggccactggcaatcccagacaggttcagtggcaggcggtctgggacagacttcactctcaccatcagccagactggagcctagaagatttgcagtgtattactgtcagcagtagtggtagctcgacggtacgttcggaccgaaagggaccgaagggtagaaagtcgaaacgaacgtacgtacggcgtacggacctaccattccgtcgttacgttctacttccttcccgtacctagttaccg

SEQ ID NO: 245190 - DNA, 613 bp, Homo sapiens
  misc_feature: GYAE6OF02F789G.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaanagccaccctctcctgcagggccagtcagaatgttaccaacaggttcgagcctggtaccagcagaacctggccaggttcccagcctctcatctatggtatactccaccgagggccacgtggcactcccagacaggttcagtggcaggcgggtctgggacagacttcactctcaccatcagcagacgtcggacgcctagaacgtagtttgacgtagttgttattacgtcgtacgagtactaggttagtcggtacgtccgtacggtaaccgggtacggttaccgggaccgtaacggggtaaccgtaaacggggtaacggtaaacgtaacgaaaccggttaacgtcgggtacggtacggtacggaccaccgtaacgttcgttacgttacttcctaccttcccgttacccgtacctacgtccg

SEQ ID NO: 245191 - DNA, 560 bp, Homo sapiens
  misc_feature: GYAE6OF02F2J0P.5.59.F04.1.454.CMB.1.raw
  modified_base (196)..(196): a, c, t, g, unknown or other
  misc_feature (196)..(196): n is a, c, g, or t
  modified_base (347)..(347): a, c, t, g, unknown or other
  misc_feature (347)..(347): n is a, c, g, or t
  modified_base (396)..(396): a, c, t, g, unknown or other
  misc_feature (396)..(396): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatccaccagggccacgtggcatcccagacaggttcagtggcaggcgggtntgggacagcttcgactctcaccatcaggcagactggacgtcctgaagtntttgctagtgtattacgngtcgagctagtntggtanctcgacggtacgttcggaccgaaagggacctaagggtacgaaataccgaaaacgtaacgtggtaggtacctggacctaccgacgttcctaggttccttactacttcccgtacccgtacctacttaccg

SEQ ID NO: 245192 - DNA, 543 bp, Homo sapiens
  misc_feature: GYAE6OF02IJBB1.5.59.F04.1.454.CMB.1.raw
  modified_base (196)..(196): a, c, t, g, unknown or other
  misc_feature (196)..(196): n is a, c, g, or t
  modified_base (347)..(347): a, c, t, g, unknown or other
  misc_feature (347)..(347): n is a, c, g, or t
  modified_base (401)..(401): a, c, t, g, unknown or other
  misc_feature (401)..(401): n is a, c, g, or t
  modified_base (406)..(406): a, c, t, g, unknown or other
  misc_feature (406)..(406): n is a, c, g, or t
  modified_base (435)..(435): a, c, t, g, unknown or other
  misc_feature (435)..(435): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgagcctggtaccagcaagaaacctggccaggttcccagcctcctcatctatggtatactccaccagggccatggcatcccaagcaggttcaggtggcaggcgggtntgggactagacttcactctcaccatcagcagcgtaggacgctagaagtatttgntagtnttaattactgtacagtctagttatggtanctcgacggtacgttcggacgaagggaccgtaaggtagaaactacgaaacgtacgtaggtagtacgcgacctactattcgtgttctactacttccctcccgctacttcg

SEQ ID NO: 245193 - DNA, 648 bp, Homo sapiens
  misc_feature: GYAE6OF02I2WNH.5.59.F04.1.454.CMB.1.raw
  modified_base (255)..(255): a, c, t, g, unknown or other
  misc_feature (255)..(255): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagagcccaccctctcctgcacgggccagtcagaatgttaccaacaggttcagcctggaccngcagaacctggccaggttcccagccctctcatctagtggtatactcccaccgagggcccacgtcggccacgtccccagacgtaggttccaagggttcggaccgaggtccggggttctacgggggacctaaggtacctttcgaccttacctccaacctattaccaagccgacgaaccgtgggaccgccgttaggaagttacgttttcggcgtaggttacgttaattaccgtgttacgagtacgtagtagttaggtagtcgttacgacgggtaccggttcggaccgtaaggtaccgtaaggtacggaaacgtacgaacgtacgtagtcggtacgtacggacctacgtacgttaccttcgttacgtacgtacttcccgtcccgtaccgtacttccg

SEQ ID NO: 245194 - DNA, 650 bp, Homo sapiens
  misc_feature: GYAE6OF02HXBLC.5.59.F04.1.454.CMB.1.raw
  modified_base (339)..(339): a, c, t, g, unknown or other
  misc_feature (339)..(339): n is a, c, g, or t
  modified_base (377)..(377): a, c, t, g, unknown or other
  misc_feature (377)..(377): n is a, c, g, or t
  modified_base (401)..(401): a, c, t, g, unknown or other
  misc_feature (401)..(401): n is a, c, g, or t
tcagatcagacacgcacgaccggtgctcgatttagtacacacacttagggattggggtgctcagttaggacccagagggaaccatggaaaccccagccgcagcttctcttcctcctgctactctggctcccagatcgccaaccggaaagacctgtgttgaccgcagtctccaggccaccctgtctttgtcctccgaaggggaaagacgacccaccctctcctgcagggccagtacaagtaatcgttaaccaaacgaggttcgacgcctagggtaccagcaagaaacctggccagttcccagccctctcatctagtgttaactctaccaccgaggccagnggccatacccaggactagggtcagtggcaggcggttcngggacagtactcactctacgactntaccagacagacgtggacgaccgtgaaagttctttgagtagttagttaattaccgtgtacgacgtacgaaggttagtacggtacgtaccgtacgtaaccgggtaacggttaccgggaacccgtaacgggtaaccgaaagggtaacggtaaaaccgtaacgtaaaaccggtaccgtaacgtggtacgacgtaacccaacttacgtacttggtacccttacgtaccttcccgtaccctccctagttacccg

SEQ ID NO: 245195 - DNA, 590 bp, Homo sapiens
  misc_feature: GYAE6OF02HAPMT.5.59.F04.1.454.CMB.1.raw
  modified_base (194)..(194): a, c, t, g, unknown or other
  misc_feature (194)..(194): n is a, c, g, or t
  modified_base (233)..(233): a, c, t, g, unknown or other
  misc_feature (233)..(233): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtcttgtctccaggggaaangccaccctctcctgcagggccagtcagaatgttaccaanggttcagcctggtaccagcagaacctggcctaggtccccagcctcctcatctagtgtatactcccaccgagggccacgtcggaccactcccgagactaggttcaggtcggcgaggcgggtctgggacaggtcttcactctacacatcagtcacgacgtggacgtcctagaagtactttgactagtgttattacgtgtctagtctaagtagtagtacgctacgacggtacgtacggaccgaacgggaccgaagggtacgaaacgtaacgaacgtaacgtcggtacggaccgttaccgacttactccgttacgttccgtttacctacgttcccttacccgaccttacgttcgttaccgg

SEQ ID NO: 245196 - DNA, 749 bp, Homo sapiens
  misc_feature: GYAE6OF02H63G4.5.59.F04.1.454.CMB.1.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
tcagatcagacacgcacgaccggtgctcgatttagtacacacacttagggattgggtgctcagttaggacccagagggaaccatggaaaccccagcgcagcttctcttcctcctgctactctggctcccagatgccaccggaaagactgtgtgacgcagtctccaggcaccctgtctttgctcgagggaangccaccctntcctgcagggccagtcagatcgtacaactaggttcagcctggtacagcaagaaccgtggccaggttcccagtcctcctactatcctattggtaactactccccaaccgacgggtcccaacgtcggcctaactccccgaaggtacctagggttccaaggtcggccacgggtcgggtacgtcggggaacacggtacttcgaccgttcctacgaccctaattccgaacgccgaaggtaccgttgggacgtcccgttaggtaaacggttacttttacggacgtaaggttacgttaactttacggttacgtacgtaacggtaccgtaacggttaacgttcgggtaagtccgtacggtaaccggggtacccggtttacgggaacccgggtaaacggggtaaacccggtaagggtaaccgggtaaaacgtaaccggttaaaccggtaaaccggttaggttaccgggtaccggttacggtaacccgtaaccgtaccgttacgttcgttaccgttaaccgtcgtttaaccccgtttcccgtacccgttaagttcccgg

SEQ ID NO: 245197 - DNA, 554 bp, Homo sapiens
  misc_feature: GYAE6OF02FV3ID.5.59.F04.1.454.CMB.1.raw
  modified_base (196)..(196): a, c, t, g, unknown or other
  misc_feature (196)..(196): n is a, c, g, or t
  modified_base (370)..(370): a, c, t, g, unknown or other
  misc_feature (370)..(370): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatcccaccagggccactggcactcccagacaggttcagtggcaggcgggtctgggacagacttcactctcacntcagcagactggacgcctagaagtattttgctagttgttattacgtgtacagtctagttagtggtagctcgacggtacggttcggaccgaacgggaccgtaagggtacggaaactacgaaacgacgtaggtacggtcgtgaccacctatcgtagtcttacgtaccttccttcccgtcctatccg

SEQ ID NO: 245198 - DNA, 546 bp, Homo sapiens
  misc_feature: GYAE6OF02HR7W0.5.59.F04.1.454.CMB.1.raw
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
  modified_base (428)..(428): a, c, t, g, unknown or other
  misc_feature (428)..(428): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagatgtacacnggttcagctggcagcagaactgcaggtccagcctctcatctatggtatactccaccgagggccactggccactccccagacctaggttcaggtcggcaggcgggtctgggacagtacttcactctacactatcagcagacgtggacgccgtagaagttatttgctagtgtattacgtgtcgagcagttagtggtancgttacgacggtacgtcgggaccgaagggtaccgaaggtaggaaactacgaaacgagtggtacggacgtcgaccacgtattcgtcgttcttactaccttcccgttcccgacctattcg

SEQ ID NO: 245199 - DNA, 752 bp, Homo sapiens
  misc_feature: GYAE6OF02IEKFD.5.59.F04.1.454.CMB.1.raw
  modified_base (193)..(193): a, c, t, g, unknown or other
  misc_feature (193)..(193): n is a, c, g, or t
  modified_base (322)..(322): a, c, t, g, unknown or other
  misc_feature (322)..(322): n is a, c, g, or t
  modified_base (360)..(360): a, c, t, g, unknown or other
  misc_feature (360)..(360): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagactgtgttgacgcagtctccaggcacctgtcttgtctcgaggggaaangccaccctctcctgccagggccagtcagaattcgttaaccaagtagggttcgagcctaggtaccaggcaaggaacctgggacctaggttcccaggtccctcctcatctagtggtaactactcccaacgngggaccctagtcggcctactcccaagacgtaggtttcnggtaggcgacggtccggggttctacggggaacctagggtaccttccgaacttctaccgaacctattcccgacggtacctaagggtacccttaggtacgtccgtaaggtaacgttaacgttttacggacttaggtttacgttacgtttacgttcggttactacggttacgttaagggttagttacggggtaacgtccggttacggtaaccgggttacgggttacccgggaccggtaaacgggtaacccggtaaagggttaacggaaacgtaaccgtaaacggtaccggttacgggttacggtaccgtacggtaccgtaacgtaccgtttaccgttacgtttacctttaccgtaaccgtttccccgtttaccccgtacccgtacgtttacccgg

SEQ ID NO: 245200 - DNA, 835 bp, Homo sapiens
  misc_feature: GYAE6OF02G0L9R.5.59.F04.1.454.CMB.1.raw
  modified_base (198)..(198): a, c, t, g, unknown or other
  misc_feature (198)..(198): n is a, c, g, or t
  modified_base (236)..(236): a, c, t, g, unknown or other
  misc_feature (236)..(236): n is a, c, g, or t
  modified_base (286)..(286): a, c, t, g, unknown or other
  misc_feature (286)..(286): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaangccaccctctcctgcagggccagtcagaatgtaccaanaggttcagcctggtaccagcaagaacctggcctaggttcccagcctcctnatctatggtatactccacgaggccacgtggacactcccagtactaggttcaggtggcaggtcgggtctgggactaggtaccttcgactctacacctagtacagtacacgtacgtacggacgtaccgttaggtaacggttacttttacggacgttaagggtttacgttaacgttttaaccggttacggttaaccgttacgggttaccgttaagggtttaacggttacgggggttaacgtaccggttaccgggtaacccgggggtttaacccgggttttacccgggggaaaccccggggtaaaaccgggggtaaaccccgggttaaaacgggggtttaaaccggggtaaaaacccgtttaaacccgggtaaaaaacccggggttaaccggtttaccggggttaaccggggtaacccggttaaccgggtaaccccgtaaacccgttaaccggtttacccggttttacgggtttaaccccgttttaccggttaaccccgttttacccccggtttaacccccccggttacccgtttaacccgggtttaccccgg

SEQ ID NO: 245201 - DNA, 607 bp, Homo sapiens
  misc_feature: GYAE6OF02I70DC.5.59.F04.1.454.CMB.1.raw
  modified_base (196)..(196): a, c, t, g, unknown or other
  misc_feature (196)..(196): n is a, c, g, or t
  modified_base (373)..(373): a, c, t, g, unknown or other
  misc_feature (373)..(373): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaaangccaccctctcctgcagggccagtcagaatgttaaccaacgaggttcgtagcctaggtaccagcaagaacctggaccacggttcccagccctcctcatctatggtatactccaccgagggccacgtggacactccagacaggttcagtggcaggcggtgtgggactagcttcactcncactatcagcagctggacgctagaatgtttgactagtagttattactgtacagtctagttagtaggtacgccttacggacggtaccgggttacggaccggtaaacgggaaccgtaaagggtaacggtaaacgtaaccggaaaacgtaacggtggtacggtacgtacggtaacccaaccgtacgttacgtttcgttaccttacgttaccttcccgtttcccgaccgtacttaccg

SEQ ID NO: 245202 - DNA, 579 bp, Homo sapiens
  misc_feature: GYAE6OF02F5684.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaaccaacgaggttcgtagcctggtaccagcaagaacctggccaggttcccagcctcctcatctatggtatactccaccgagggccactggcatcccagacaggttcagtggcaggcggtctgggacagacttcactctcaccatcagcagacgtggagctagaagtatttagtcgtagtgtattactagtcgtagacagtagtagtagtactacgtacggtacggttacggaccgaacgggaacgtaacggtaaggtaaacgtaacgtaaacgaacgtacgtaggtacgtacgacacgtacgtacgttacgttacttctacttccttcgtacccccccccccgtattaccg

SEQ ID NO: 245203 - DNA, 787 bp, Homo sapiens
  misc_feature: GYAE6OF02JRQBX.5.59.F04.1.454.CMB.1.raw
  modified_base (133)..(133): a, c, t, g, unknown or other
  misc_feature (133)..(133): n is a, c, g, or t
  modified_base (201)..(201): a, c, t, g, unknown or other
  misc_feature (201)..(201): n is a, c, g, or t
tcagatcagacacgcacgaccggtgctcgatttagtacacacacttagggattggggtgctcagttaggacccagagggaaccatggaaaccccagcgcagcttctctcctcctgctactctggcctccagtntcgccaccggaaagtctgtgttgacgcagtctccgaggccacctgttctttcgctaccgaggggaaancgcctaccctctctgcgacgggccagtcaagtactcgttaaccaagtacggttcgacgtctggtaaccagtaccaacgaaaccgttcggaccgtacgggtttccccaagtccccttacctacgacttacgtaacggttcggtaacttaccgtcccaaacccggacgggaccctaacgtcccggtactaaccgtaccccgaagtaaaccggtgtttaccgaacggttccggaacgtcgggtaccgggtccgtaggaacgtaacgtaccgttaccgtactaccggtcaaccgacgttacgaaccgtaccgtactaacgggttacgaccggtaacccgttaagggtaaacgtttcgttaacgacgttacgggttacttaacggttaaccgtacgtcgtaacggtcgttaaccgttattaaggggttaccaccggtttaccggtaaccggttacggttaccgtaacgggtaacggaaccggtaaagtaacgggttaaacacggttaaacgacggttggtacggtacgtacgtaccgtacgtacgttaccgtagttcgaccgttagttccccgtaacgtccgtattaccgg

SEQ ID NO: 245204 - DNA, 771 bp, Homo sapiens
  misc_feature: GYAE6OF02IIFIG.5.59.F04.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaagngccaccctctcctgcagggccagtcagaatgttaccaanaggttcgtagcctggtaccagcaagaacctggccaggttcccagcctcctcatctatggtatactccaccgagggccacgtcggcctactccccgaagtacgtaacgggtttcaaggttcggacgacgggtccggggttacgtacgggggaactaacggtacctttaccgaacctttaccgttaccaacccgtaacgttaacccgaggtacccgaagggtacccgttaggggaacggtcccgtaaggtaaacgtttaacgtttttcggacgttaaggttacgttaacgttttaaccgttgtaccgtaaggtaccgtaaggttacgttagggtaacgtccgttaccgggtaaccgggttaccggtttacccgggaaccggtaaaccggggtaaccggtaaagggttaacgggtaaaacgttaaccgtaaaacggtaacgtagggtacgggtaccgtacggtacctaacccgtaacgttccgttacggttacctttaccgttaccgttacccgtttacccgtaccttacgttaccg

SEQ ID NO: 245205 - DNA, 779 bp, Homo sapiens
  misc_feature: GYAE6OF02JX4QD.5.59.F04.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (252)..(252): a, c, t, g, unknown or other
  misc_feature (252)..(252): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctccagatgccaccggaaagctgtgttgacgcagtctccaggccaccctgtctttgctccgaggggaaancgccaccctntcctgcagggccagtcaagatgtaccaataggttcagcctggaccngcagaacctgccaggtccagcctctcatctatggtatactccaccgagggcctaacgtggacctacgtaccccgaagacctacgggtttcgaacggttgggaccagggttccgggggtcgtacggggaacctaaacgggtcctttaccgaacccgttccgttcccaaaccgtaacgttccgaaacggccgtaacgggtaacgttcggggaacgtacccggtaagggtaaacgtttaacgtttcggaaccgttaagggttacgtttaacgttaccgttacggtacctaacgggtacttaaggttaacgttacggggtaactaccggttacggtaaccgggttacggtttaccccggaacggtaaaccggggtaacgtaaacgggttaacggtaaacgttaaccgtaaaccgtaacggttggtaaccggtaccggtacggtaaccctaacggttaacgtcccgtttaaccggtttccttaaccgtacccggttttacccgtaccccggtttacgaccgtttaccccggg

SEQ ID NO: 245206 - DNA, 510 bp, Homo sapiens
  misc_feature: GYAE6OF02IPI9Q.5.59.F04.1.454.CMB.1.raw
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
  modified_base (399)..(399): a, c, t, g, unknown or other
  misc_feature (399)..(399): n is a, c, g, or t
  modified_base (458)..(458): a, c, t, g, unknown or other
  misc_feature (458)..(458): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctccgaggggaaancgccacccttctcctgcgagggccagtcagaatgttaccaanggttcagcctggaccagcagaacctggccaggttcccagcctctcatctatggtatatccaccagggtccagtggcatcccagaccaggttcagtcggcaggcggtctgggacngacttcactctcacntcagcagactggacgctagagtatttgctagtntattactgtacagtcagtatggtagctgacggtacgtcgacgaaggacaaggtggaaanacgaacgagtgtagcgtagcactagtactgtctacgcttctccgtctactcg

SEQ ID NO: 245207 - DNA, 582 bp, Homo sapiens
  misc_feature: GYAE6OF02H313Q.5.59.F04.1.454.CMB.1.raw
  modified_base (195)..(195): a, c, t, g, unknown or other
  misc_feature (195)..(195): n is a, c, g, or t
  modified_base (231)..(231): a, c, t, g, unknown or other
  misc_feature (231)..(231): n is a, c, g, or t
  modified_base (275)..(275): a, c, t, g, unknown or other
  misc_feature (275)..(275): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccaggcaccctgtctttgtctccaggggaaanagccaccctctcctgcaggccagtcagatgtacaanaggttcagctggaccagcagaacctggccaggttcccagcctcncatctatggtatatcccacagggccactggcatcccagacaggttcagtggcagcgggtctgggacagacttcactctcacatcagcagactggagcctagaagtatttgctagtgtattactgtcagtcagtacttggtacaccgttcgaacggtaccgttacgggaccgaaacgggtaaccgaagggtacggaaaacgttaccgaaacgtaacgtacgggttacggacgtacggacctaaccgtacgttaccgttacggttacctttaccgtacgttcccgtttacccgtacccgtattacccgg

SEQ ID NO: 245208 - DNA, 573 bp, Homo sapiens
  misc_feature: GYAE6OF02GJL0B.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgttaccaacaggttcgtagcctggtaccagcaagaaacctggccaggttcccagcctcctcatctagtggtatactccacgagggccacgtggcacgtcccgagacaggttcaggtgcaggcggtcgtgggactagaccttcgactcgtacacctatcgagcagacgtggactcgtagaagtatttgctagtgttatacgtgtactagtactagttagtggtatccgtacgacggtacgttcggacgaacgggtaccgtaaggtaggaaactaacgaacgtactaggtcgacgtacgaccacgtacttcgtgttccttacgtaccttccgtacccgactattaccg

SEQ ID NO: 245209 - DNA, 720 bp, Homo sapiens
  misc_feature: GYAE6OF02I3HGG.5.59.F04.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgccaccggaaagactgtgttgacgcagtctccaggcaccctgtctttgtctaccgaaggggaaancgcccaccctctcctgcgacgggccagtcaagtatcgttaaccaagtggttacgtagccgtaggtaccaggacaagaaaccgtggaccgacggttcccacggccttacctctaatcctaagtcggttactactacccaccgacgggccacgtcggacactacccgagacgtacgttcgaggtcggaccgaggtccgggtactacggggaactacggtaccttaccaacgtctaccaaccgtagtccgaacgtccaacgggtacgtacgggtaacgtaccttaagggaaacgtttacgtttcgacgttaaaggttcttaacgttacgtgtacgaacgtacgtaaggtttacgtgggtactacgtacggaaccggtaccggttacggaccggaaacgggtaacgtaaccgggtaaaggtaaacttaaccgaaacgtacggttacgggtcggtaacgtcggtacctaaccgacgtttacgacgttccgttactaccgttcccgtaccgtacccgtattaccgg

SEQ ID NO: 245210 - DNA, 531 bp, Homo sapiens
  misc_feature: GYAE6OF02GH9IT.5.59.F04.1.454.CMB.1.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (343)..(343): a, c, t, g, unknown or other
  misc_feature (343)..(343): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagatgtaccaanggttcagcctggtaccagcagaacctggccaggttcccagcctcctcatctatggtatactccaccgagggccacgtggcatccccagacaggttcagtggcagcgggtcngggacagacttcactcgcacatcagcagacgtggagcctagaagtagtttgctagtgttatactgtacagtatagtagtgtagtctacgacggtacgtcggaccgaacggacgtaggtagaacgtacgaacgacgtgtacgcgtcgtacacgatcgtgtacgttctacgttcctcccgtactattccg

SEQ ID NO: 245211 - DNA, 633 bp, Homo sapiens
  misc_feature: GYAE6OF02FW4BZ.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaancgccacctctcctgcaggccagtcagaatgttaccacaggttcgagcctggtaccagcaagaacctggaccaggttcccagccttctcatctatggtatactacccaccgagggccacgtcgacactcccagtactacggttcagtcggactagggtccggtcgtagggacacggtacttcgactctacaactatcgagcacgacgtggacgccgtagtaagttagtttgacgttaagttagttaacgtttacgtacggttacaagtacgttagtacgttagggtacgtcctacggtaccggtaccggttacggaacggtaacggtaaccggaaggtaacgaaacgtaacgtaaacgtagtacggtacgtacgtacaaccgtacgtacttacgttacttccgtacttaccgttcccgtacccgtaccttgtaccg

SEQ ID NO: 245212 - DNA, 564 bp, Homo sapiens
  misc_feature: GYAE6OF02HT1XQ.5.59.F04.1.454.CMB.1.raw
  modified_base (196)..(196): a, c, t, g, unknown or other
  misc_feature (196)..(196): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaaangcccaccctctcctgcagggccagtcagaatgttaccaacaggttcgagcctggtaccagcaagaacctggaccaggttcccagtcctctcatctatggtatactccaacgacggccactggcactcccagacaggttcaggtggcaggcggtcgtggacagacttcactcacacatcagcacgntgganccgtagtagtatttganagttatacttactgtacagtagagtagtgtagtctacgacgggtacgtaccggacgaaggaccgaaggtaaggaaactacgaaacgaacgtggtaacggacgtagacctaacgacttacgtacgttccttcgtaccttcccgtacccgtaccacgttaccg

SEQ ID NO: 245213 - DNA, 754 bp, Homo sapiens
  misc_feature: GYAE6OF02HIXTD.5.59.F04.1.454.CMB.1.raw
  modified_base (143)..(143): a, c, t, g, unknown or other
  misc_feature (143)..(143): n is a, c, g, or t
  modified_base (187)..(187): a, c, t, g, unknown or other
  misc_feature (187)..(187): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (300)..(300): a, c, t, g, unknown or other
  misc_feature (300)..(300): n is a, c, g, or t
tcagatcagacacgcacgaccggtgctcgatttagtacacacacttagggattggggtgctcagttaggaccagagggaaccatggaaacccagcgcagcttctcttcctcctgctactctggctccagatgccaccggaaanctgtgtgacgcagtctccagcacctgtctttgctcaggggaaancgccacctntcngcgacggcagtcaagtactcgtaaccaagtggttacgacgccgtaggtaaccagaccgtaaacgaaaccgtcggacctacggttaccacgtccttccgtanactcgttaagtacggtaactacctacccgaaccggtacgggaccctaacgtcggtaccaaccttacccgaagtacgtaacggttcgaaggtcggaccgtacgggtccggggttactacggggaactaacgggttacctttcgaaccgttcctaccgaaaccgtaactacgaacggtacctaagggtaacgtacgggtaaccgtaccggtaaggtaaacggttacgttttacggaacgttaacggttacggttaacgttaacgttacgtacgtaacgtacgtaaggttaagtaggtacgtacgtacgtacggtacggtacggtaccggtaacggtaaccggtaacggtaacggtaaagtaaacgtaaacgtaacgtacgtacggtacgtacggtacgtacgtaacgtacgttacgttacgttacgtaccgttaccgttaccgtaccgtacgtacg

SEQ ID NO: 245214 - DNA, 562 bp, Homo sapiens
  misc_feature: GYAE6OF02H6Y0O.5.59.F04.1.454.CMB.1.raw
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (372)..(372): a, c, t, g, unknown or other
  misc_feature (372)..(372): n is a, c, g, or t
  modified_base (427)..(427): a, c, t, g, unknown or other
  misc_feature (427)..(427): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagactgtgttgacgcagtctccaggcaccctgtctttgctccaggggaaangccacctctcctgcagggccagtcagatgttaccaanaggttcgagcctggaccagcagaacctggccaggttccagcctcctcatctatggtatactcccaccaggccactcggacatccccagactacggttcaggtggcgaggcggtcgtgggacagacttcactcacacatacngacagactggacgccgtagtaagtattttcgactagtattattacgtgtacagtnacgtagtggtagcctcgtacggtacgttcggacgaacggacgtaaggtacgtaaacgaacgaacgtaacgtgtacggtacgtcgacctacgtactcgttacgttcttactaccgttaccttcccgtactataccg

SEQ ID NO: 245215 - DNA, 598 bp, Homo sapiens
  misc_feature: GYAE6OF02GYPDI.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgtctccaggggaaangccaccctctcctgcagggccagtcagaatcgttaccaacgtaggttcgtagcctggtaccagcagaacctggccaggttcccagcctctcatctagtggtatactcccacgaggccacgtggcctactcccagacaggttcaggtggcaggccgggtcgtggggaacaggtaccttcactctcgaaccatcagacacgtacgtggacgtcgtagtaagtacgtttcgactagttagtattacgtgtacgtagtacgtagttagtggtacgtcgtacgacggtaccggttacggaccgaacgggtacgtaagggtacgaaacgtaacgaaacgtacgtaggtaggtacgtgaccaccgtagtcgttacgtcttacgtaccttccgttacccgtactacgtacg

SEQ ID NO: 245216 - DNA, 599 bp, Homo sapiens
  misc_feature: GYAE6OF02HRCVA.5.59.F04.1.454.CMB.1.raw
  modified_base (195)..(195): a, c, t, g, unknown or other
  misc_feature (195)..(195): n is a, c, g, or t
  modified_base (399)..(399): a, c, t, g, unknown or other
  misc_feature (399)..(399): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtcagaatgttaccaacaggttcagcctggtaccagcagaacctggccaggttcccagcctcctcatctatggtatatcccaccagggcccacgtcggcaactcccagacctaggttcaggtcggcagcgggtctgggacagacttcactctcacatcacgcagacctggacgcctgaagtntttgctagtgttattactgtcagtcagttagtggtagtcgtacgtacggtaccgttaccgggaccgtaaacgggaccgtaaagggttacggaaaacttcgaaaaccgtacgttacggtcgggaccgttggaccgtaccgtacgtttaccgtacggtttaccttccctacgtttacccttaccccggtccttaccgttccg

SEQ ID NO: 245217 - DNA, 651 bp, Homo sapiens
  misc_feature: GYAE6OF02F8WVD.5.59.F04.1.454.CMB.1.raw
  modified_base (197)..(197): a, c, t, g, unknown or other
  misc_feature (197)..(197): n is a, c, g, or t
  modified_base (240)..(240): a, c, t, g, unknown or other
  misc_feature (240)..(240): n is a, c, g, or t
  modified_base (313)..(313): a, c, t, g, unknown or other
  misc_feature (313)..(313): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgccgagggccagtcagaatcgttaccaacnggttctacgcctggtaccagcaagaacctggccaggttcccagccctcctcatctatggtatactccaaccgnggccacgtggaccactcccgagacgtaggttcaggttcggaccgtaggtccggggtctgggacagtaccttcgactctccaaccgatcgacgcgtagacgtcggacgtcctaggaagttagtttcggactaggttacgttattaccgtgtacgtagtacgttagttagtacgggttacgtccgttacgtaaccgggttacggttaccgtaccggtaacgggtaaccgtaagggtaacggaaacgtaaccgaaacgtacgtacggtaggtaccgtaggacctaaccgtcgttaactcgttaccgttacgtaccgttcccgtttcccgaccttccgtacg

SEQ ID NO: 245218 - DNA, 705 bp, Homo sapiens
  misc_feature: GYAE6OF02H6TIR.5.59.F04.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
tcagatcagacacgcacgaccggtgctcgatttagtacacacacttagggattggggtgctcagttaggacccagagggaaccatggaaacccagcgcagcttctcttcctcctgcctactctggctcccagatcgccaaccggaaagactgtgttgacgcagtctccaggccaccctgtctttgcctccgaggggaaancgccaccctctcgngcgaggccagtcagaatgttaccaaacnggttcagcctggtaaccaanagaaacctggaccacggtcccagcctcncgactctatggtaatactccacgacgggcctaacgtcgacactccccaagactaggttcaaggttcgcaaggcgggttcaggacacgtacgttacactctacgacctatcgaacgcacgtacgtggacgtacctaaggaaggttaacttttcggacgtaacgttagtttaacttaaccgtgttacgaataccgtaagtagttacgggtacgtacgtaccggaacgggttaacggttccgggaacccggtaaaacgggggttacccaaaaggggtttaccggaaaaacggttaccaaaaaacggtaaccgttagggtacgggtacggttaccgacggtaaacccgtagttacccgttagtacccgtttaacggacctttccgttaaccccccggtgtacccgttaccggttaacgg

SEQ ID NO: 245219 - DNA, 614 bp, Homo sapiens
  misc_feature: GYAE6OF02GP8NZ.5.59.F04.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (272)..(272): a, c, t, g, unknown or other
  misc_feature (272)..(272): n is a, c, g, or t
  modified_base (365)..(365): a, c, t, g, unknown or other
  misc_feature (365)..(365): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaaccggaaagctgtgttgacgcagtctcaggcacctgtctttgctcgagggaaancgccacctctctgcaggccagtcagatcgtacaanggttcagcctaggaccagcagaactggacctagtccagcctcctanatctagtgtaatactccacgaggccaacgtggcactccgaagacaggttcagtcggcaggtcggtctagggacagtacttacgactctcactntcagcagactggactacgtagaagttactttacgactagttacgttaattacgtgtacaacggtacttaaggtagtagggtatcccgtacgtaaccgggtacgttccgggaccgtaaacgggaaccgtaagggtaacggaaaacttaaccgaaaacggtacgttaggacggtacgtccgaactaacgtaacgttccgttaacgtaccgttaccgtaacttccccggttacccgtacgtacttacccggg

SEQ ID NO: 245220 - DNA, 559 bp, Homo sapiens
  misc_feature: GYAE6OF02IL4Y0.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccgaggggaaagagccaccctctcctgcagggccagtcagaatcgttaccaacaggttcgtagcctggtaccagcagaaacctggccaggttcccagcctcctcatctatggtactatccaccagggccactggcatcccagacaggttcagtgcagcggtctgggacagacttcactctcaccatcagacagactggacgtcctaggaagtattttgcgtagtgttacttactgtacagtacgagttatggtacgctcgacggtacgttccggtacgaacgggacgaaaggtacggaaataaccgaaacgtacgtagtaggacgtggacacctacgtctagttccttctacttccgttcccgtacctatccg

SEQ ID NO: 245221 - DNA, 603 bp, Homo sapiens
  misc_feature: GYAE6OF02JHDW4.5.59.F04.1.454.CMB.1.raw
  modified_base (195)..(195): a, c, t, g, unknown or other
  misc_feature (195)..(195): n is a, c, g, or t
  modified_base (423)..(423): a, c, t, g, unknown or other
  misc_feature (423)..(423): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgctccgaggggaaangcccaccctctcctgccagggcccagtcaagaattcgttaacccaacgtagggttcgtaagcccttagggtaacccaggccaagaaaacctgggccaggttcccagccctcctcatctatggtatactccaccgaggccacgtggccactcccgagacgaggttccaggtcggacaggcgggttcgtgggactagtaccttcactctcactatcgagcagactggacnccgtagaagtatttcgactagtgtattacgtgttcagactagtagtgtagctacgacggtaccgttcggaccgaagggaccgtaagggtagaactaacgaaaccgtagtcggtaggcgtacggacctaaccgtcgtacgttcgtacttacgtacttcccgttcccgtactacgttacccg

SEQ ID NO: 245222 - DNA, 692 bp, Homo sapiens
  misc_feature: GYAE6OF02H06CK.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaagngccaccctctcctgcagggccagtcagaatgttaccaacaggttcgagcctggtaccagcagaacctggccaggttcccagcctcctcatctatggtatactccaccgaggccacgtcggcactcccagacaggttcagtggcaggcggtctgggacagacttcactctccactatcacgacacgacgttagggacgtccgtaggaaacgttagttttacggaccgttaggttacgttaagtttaccgttacggttaccgaggtacttaaggtttaacgttcgggttaacgtccgttaccggtaaaccgggttacccgggtttacccgggaacccggtaaaaccggggtaaccgtaaacggggttaacggtaaaacgtaacgtaaaaccggtaacgttaggtacgggtacgtacggtaccctaaccgtacgttaccgttacggttacctttaccgtaacctttacccgtttaccccgtcccgtaacttacccgg

SEQ ID NO: 245223 - DNA, 799 bp, Homo sapiens
  misc_feature: GYAE6OF02I0463.5.59.F04.1.454.CMB.1.raw
  modified_base (196)..(196): a, c, t, g, unknown or other
  misc_feature (196)..(196): n is a, c, g, or t
  modified_base (241)..(241): a, c, t, g, unknown or other
  misc_feature (241)..(241): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaaangccaccctctcctgcgacgggccagtcagaattcgttaaccaacnggttcgagccgtggtaccagcaagaacctggccacggttcccagccctcctcactctatggttatactcccgaccacgggccactggccactccccagaccgtaggttcaggtcggcgaggtcggggtacgtggggactacgtccttacgactacctaccaccgtactaccgacgaccgtaacgtaccgtacggggtaaccgcggttaacggtaaacggttttacgttttacgggtacctaagggtttaacggtttaacgtttaaaccgttacgggttaactaacgggttaaccggtaacggtttaacgttaggggttaaaccggttaccgttacccgggtaaccggggttaacccgggtttacccggggaaacccgggtaaaaccgggggtaaccggtaaacgggggttaaaccggtaaaaccggttacgaaaaacccgggttaaccttacgggggttaccggtaaccgtcgggtaacctaacccggttaactttccggttaacgtttccttaaccggttaccctttaccccgttaccccgcccgttacttacccgg

SEQ ID NO: 245224 - DNA, 702 bp, Homo sapiens
  misc_feature: GYAE6OF02JWV76.5.59.F04.1.454.CMB.1.raw
  modified_base (195)..(195): a, c, t, g, unknown or other
  misc_feature (195)..(195): n is a, c, g, or t
  modified_base (231)..(231): a, c, t, g, unknown or other
  misc_feature (231)..(231): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgtctcgaggggaaancgccaccctctcctgcaggccagtcagatgtaccanaggttcagcctggacagcagaacctggcctaggtcccagtcctctcatctatggtactactacccacgacggccacgtcggacctacgtcccgaagtaccgtaggttcacggtcggctacgggtccggggtacctagggggaacctacggtacctttacgaccttcctaccgaacctaacttaccgaacgtccgaagtaaccgtcggggtaacgtacccgtaaggtaaacgtttacggttttacggaaccgttaagggtttacgtttaaccgtttaacggttacgttaacgtaacggtaccgttaaggttaacgttcggtaaccgtccgttaaccggtaacgggtaccgttcggaaaccggtaacgggtaaccgtaagggtaacggtaaacgtaacgaaacgtacgtacggtggtacgcgtaaccacgtacttcgttacgtcgtttacaccttccgtacctcgtacttacg

SEQ ID NO: 245225 - DNA, 555 bp, Homo sapiens
  misc_feature: GYAE6OF02IV2T6.5.59.F04.1.454.CMB.1.raw
  modified_base (196)..(196): a, c, t, g, unknown or other
  misc_feature (196)..(196): n is a, c, g, or t
  modified_base (511)..(511): a, c, t, g, unknown or other
  misc_feature (511)..(511): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaanagcccaccctctcctgcagggccagtcagaatgttaccaacaggttcagcctggaccagcagaactgccaggtccagcctctcatctatggtatactccaccgaggccacgtggcactcccagaacgtaggttacagtggacacggtcgggtcgtagggacaggtaccttcacctctacaaccatcgaagcagactggacgccgtagaagtatttgctagtgtaattactgtcgagactagtagtgtgcgtacgtacggtacgttcgacgaacggaacgaaggtaagtaactaacgaacgagtaggtacgtacgngacacgtatcgtagttcttactacttccgtcccgtactataccg

SEQ ID NO: 245226 - DNA, 676 bp, Homo sapiens
  misc_feature: GYAE6OF02H7FPA.5.59.F04.1.454.CMB.1.raw
  modified_base (190)..(190): a, c, t, g, unknown or other
  misc_feature (190)..(190): n is a, c, g, or t
  modified_base (227)..(227): a, c, t, g, unknown or other
  misc_feature (227)..(227): n is a, c, g, or t
tcagatcagacacgcacgaccggtgctcgatttagtacacacacttagggattggggtgctcagttaggacccagagggaaccatggaaacccagcgcagcttctcttcctcctgctactctggctccagatgccaccggaaagactgtgtgacgcagtctccaggcacctgtcttgctcgaggggaaangccaccctctcctgcagggccagtcagatgtacaagnggttcagcctggacagcagaacctggccaggttcccagtcctcctcatctatggtatacgtcccacgagggccatcggctactcccgagacgaggttcaaggtcggcaaggcggggtctagggaacagactttcaacttcacgacctaatccaaggccaagtaccgtgggacgaccgtacggaaacgttagttttcggacgtaaggttacgttaacgttacgtacgtcaacgttacgaaggttacgttagggtagtacggttaccgtaacggggtaccggttccggtaacccggtaaacgggtaacccggaaagggttaacgggtaaaaacgtaaaccgttaaaacgggtaacctagggtaaccgggtaccggtacggtaacccacgtaaacgttccgtagttaccgttaccaacggttttaccctaccccggtacctaccgttacccg

SEQ ID NO: 245227 - DNA, 624 bp, Homo sapiens
  misc_feature: GYAE6OF02IOPLA.5.59.F04.1.454.CMB.1.raw
  modified_base (198)..(198): a, c, t, g, unknown or other
  misc_feature (198)..(198): n is a, c, g, or t
  modified_base (389)..(389): a, c, t, g, unknown or other
  misc_feature (389)..(389): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaangccaccctctcctgcagggccagtcagatcgttaccaactggttcgtacgcctggtaccagcaagaaaccgtggcctacggttcccacgcctctcatctagtcggtatacaccaccgacgggcctacgtggcactcccgagactaggtcaggtggcgagcgggtactgggacagtactcacttctccaacntacgacgacgacgtacgtggacgccgtagtaagttagttttcgacgttagttagttaacgtttacgtgtacgtacgtcgtaacgttagttcgggtacgccgttacgacggttaccggttcgggaaccggaaaccggggtaacgaaagggtacgtaaagtaaccgaacgtaacgtgggtcggtaccgtgacctacgtactcgttacgttcgttctacgttacctctacgtcctacg

SEQ ID NO: 245228 - DNA, 683 bp, Homo sapiens
  misc_feature: GYAE6OF02G8VD8.5.59.F04.1.454.CMB.1.raw
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctccgaggggaaangccaccctctcctgcagggccagtcagaatcgttaaccaagaggttcgagcctggtaccagcaagaacctggcctaggttcccagcctcncatctatggtatctccacgaggccagtggcactcccaagactaggttcaggtcggacgaggtcgggtctaggggactaggtacctttacgacttccgtaccgaacctaacgtccaagccgtaaggtaccgttcggggaccgtacccgtaagggtaaacgtttagttttcgacggttaggttacgttactttacgttgtaccgtaagtacgtaaggtagttacggtataccgtacggtaccgggttaccggttaccggaacccggtaaacggggtaaccgtaaagggtaacggaaacgtaaccggtaaacgtacgttacgggtaccggtacggtcgaaccgtaccgtagttaccgttcgtaccgtttacctacgttccccgtaccgtactacgttccg

SEQ ID NO: 245229 - DNA, 592 bp, Homo sapiens
  misc_feature: GYAE6OF02HKQZ1.5.59.F04.1.454.CMB.1.raw
  modified_base (433)..(433): a, c, t, g, unknown or other
  misc_feature (433)..(433): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgttctttgtctccgaggggaaagcgccaccctctcctgcgagggccagtcagatgttaccaacgtaggttcgtagcctcggtaccagcaacgaaaccgtggaccacggttcccacgcctcctcattctatggtactactcccgaccgacgggtccacgtcggacactacccagtaccgtaggttcaggtggacgtaggcggtcgtgggacagtacttcactcacaccatcgacgcacgcgtcggactcgtagtaagtntttgctagttattattactgtacagtactagtgtggtatactcggacgtacggtcggacgaagggacgtaagggtacgaaactacgaacgtagtacggtaggtactaggacctacgtacgtcgtagttaccttacgtaccttccgtacccgctcgtacg

SEQ ID NO: 245230 - DNA, 792 bp, Homo sapiens
  misc_feature: GYAE6OF02G5SBE.5.59.F04.1.454.CMB.1.raw
  modified_base (193)..(193): a, c, t, g, unknown or other
  misc_feature (193)..(193): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctcgaggggaangccaccctctcctgcagggccagtcagatgtacanaggttcagcctgacngcagaactgcaggtccagcctcncatctagtgtatactccacgaggccacgtggaccactcccgaagactacggttcaggtcggcgaggtcgggtcgtaggggaacaggtaccttcgacgttctaccaccgatcgaagcgaagacgtcggacgtaccgtaggtaaacgttacgttttagacgttaaggttagttaacgtttacgttacggtaaccgttacgtacgttaaggttaaggttacgggttaacgtaccggttaacccgggttaaccgggttaacccgggtttacccgggtaacccgggtaaaaccggggtaaacccgggttaaaacggggttaaacggggttaaaaacgttaaaacccgggtaaaaccggttaaacggttacgggttaaccggggttaacccggttaaaccgggtaaccccggttaaacccgttaaaccggtttacccggttttaacccggttttacccggttttaaccgttaacccggtttttaccccccgtttaacccccgggttaccgtttacccggttttaaccccggg

SEQ ID NO: 245231 - DNA, 783 bp, Homo sapiens
  misc_feature: GYAE6OF02G0M38.5.59.F04.1.454.CMB.1.raw
  modified_base (193)..(193): a, c, t, g, unknown or other
  misc_feature (193)..(193): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatgccaccggaaagctgtgttgacgcagtctccaggcaccctgtctttgtctcgaggggaancgccaccctctcctgcggacggcagtcaagtattacgtaaccaacgtacgggttacgtacgtccgtacggtaccaggacgaaaccggtaaccgtccgggaccgttaccgggttccccaaccggttccccttacccgtactactttacgtaggttacggttaacttacccgtacccgaccgggacgggtaccctaccggtacggacctaaccgtaccgaggtaccgtagggttccgagggtcggacgtacgggtccggggtacgtacgggacctaagtccttactaccttccgaacctaaccgtataccgacggtaccgtaacggtaccggtaggtaccgtaccggttagtaacgtttggtttacgacgttagttacgttacgtttaccgtagtacgtacgtacgtagtttaggtacgtacgtaccgtaccggtaccgggttaccgggtaccgggtaaccggaaccgggtaaccgggtaagggtaacggtaaacgtaaccggaaacgtacgggtacgtacggaccgtccgaacgtaacgtcgttaccgttcttacgttaccgtaccttcccgttacccgtacgttatccgg

SEQ ID NO: 245232 - DNA, 639 bp, Homo sapiens
  misc_feature: GYAE6OF02HJEHD.5.59.F04.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (469)..(469): a, c, t, g, unknown or other
  misc_feature (469)..(469): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctcagggaaangccaccctntcctgcaggccagtcagaatgtaccaanaggttcagcctggtaccagcagaaacctggccaggttcccacgcctcctcatctatggtatactccaccgagggccacgtggcactcccagactaggttcagtggacaggtcgggtctggggacaggtacttcactctaccgaccactcgacgcgaacgccgtagggacgtccgttagaagtttacgtttgacgtagtttagttaatttacgtgtacgagtacaaggttatagggtacncgttaccgaacgggttaccggttaccggaccgaaacggggaccgaagggttaacggaaacttacggaaaaccgtacggttggtacggtaccgttagacccgtaaccgttaacgtacgtttacgttaccctttcgaacccgttttaccggtccccgtacctaacgttccgg

SEQ ID NO: 245233 - DNA, 723 bp, Homo sapiens
  misc_feature: GYAE6OF02GJ9Y4.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaancgcccaccctctcctgcgacgggccagtcaagaactcgttaaccaagtagggttcgtagccttaggtaaccaggcaagtaaacctggtactacggttcccagtccctctactatctagtggtaatactcccaccgaggccctacgtcggaccacgtcccaaggtaccgtacggttcgacggtcggacgtacggtccgggtcgtacgggacaggtacctactcgtacctacaacctagtacgacgcgtacgtaacgtcgggactaccgtaagtaacgttagtttacggacgttaaggttacgttaacgtttacgtccgttaaggtacgtacgtagttacggttacgggtacctaccgtaccggtacgggttaacccggttaccgggaaccgggtaaacggaacgggttaaaggtaaaccggtaaaactaacggaaaaccggtacgttacggtacgggtacgtaacggacccgtaacgtacgttcgttacgttacttacctccttaccggttccctacgtcttaccgg

SEQ ID NO: 245234 - DNA, 542 bp, Homo sapiens
  misc_feature: GYAE6OF02G2YEU.5.59.F04.1.454.CMB.1.raw
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
  modified_base (308)..(308): a, c, t, g, unknown or other
  misc_feature (308)..(308): n is a, c, g, or t
  modified_base (334)..(334): a, c, t, g, unknown or other
  misc_feature (334)..(334): n is a, c, g, or t
  modified_base (374)..(374): a, c, t, g, unknown or other
  misc_feature (374)..(374): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (420)..(420): a, c, t, g, unknown or other
  misc_feature (420)..(420): n is a, c, g, or t
  modified_base (536)..(536): a, c, t, g, unknown or other
  misc_feature (536)..(536): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtcnccaggggaangccaccctctcctgcagggccagtcagatcgttaccaactaggttcgagcctggtaccagcaagaaacctggcctaggttcccagcctcctnactctatggtatactccgacngggccacgtggcactccagcaggttnaggtggcagggcggtctgggacagtcttcactctccactntcagcgagacgtggancctagaagttntttgctagttcgtattacncgttcagtcagttagtggacgtcgtacgcggtacgtcggacgaacggacgtaaggtaagaacaacgaaccgtagtgtcggcgtcgactacgcgtctgttactcgtacttccgtccnctatcg

SEQ ID NO: 245235 - DNA, 680 bp, Homo sapiens
  misc_feature: GYAE6OF02HA6LL.5.59.F04.1.454.CMB.1.raw
  modified_base (197)..(197): a, c, t, g, unknown or other
  misc_feature (197)..(197): n is a, c, g, or t
  modified_base (237)..(237): a, c, t, g, unknown or other
  misc_feature (237)..(237): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagatcgttaccaacnggttcgtagcctggtaccagcaagaaacctggaccaggttcccagcctcctcatctatggtatactccaccagggccacgtggcactcccagacgaggttcaggtcggcaggcggtcgtggggacagtacttcactctccgacatccagcgacgacgtggacgcctaggtaaacgttagttttagacgtaagttagttaacgtttacgtcgttacgacgtacgtaagggttaagttaggggttaacgtccgttacggtaaccggggttaaccgggtttacccgggaaccgggtaaaccggggtaaccggtaaaggggtaacggtaaaacgtaaccggaaaaccgtaacggttacgggtacggtaccgtacggacccgtaacgtaccttcggttacgttcccgttacctaccgtttacccgttaccccgtacctacgttaccgg

SEQ ID NO: 245236 - DNA, 556 bp, Homo sapiens
  misc_feature: GYAE6OF02F4YSX.5.59.F04.1.454.CMB.1.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaagngccaccctctcctgcaggccagtcagatgttaaccaagaggttcgtagcctggaccagcagaacctggccaggttcccagcctcctcatctatcggtatactcccacgnggccacgtcggcactcccagacgtaggttcagtggcaggcggtcngggacagtcttcnctctcacatcancagacgtgacgctagtagtatttgactagtgttattacgtcgtacgagtctagtagtaggtcacgtcgacggtacgtccggacgtaacggacgtaacggtagaaactaacgaacgtacgtagacgtacgtcgacctacgtacgtacgtcgttactacgtacctaccgttcccgtactctcg

SEQ ID NO: 245237 - DNA, 628 bp, Homo sapiens
  misc_feature: GYAE6OF02JQL99.5.59.F04.1.454.CMB.1.raw
  modified_base (195)..(195): a, c, t, g, unknown or other
  misc_feature (195)..(195): n is a, c, g, or t
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
tcagatcagacacgcacgaccggtgctcgatttagtacacacacttagggattggggtgctcagttaggacccagagggaaccatggaaacccagcgcagcttctcttcctcctgctactctggctcccagatgccaccggaaagctgtgttgacgcagtctccaggcaccctgtctttgtctccgaggggaaancgccaccctctcctgcagggccagtcagactgttaccaagtaggttcagcctggaccagcaagaacctggaccagggttccccagtccctaccgtcaactctagtggtaatactcccacacgggccacgtggcactcccgaagtaccnggttcagtcggcgaggcggtactgggacngtaaccttcgactctccaccgacttcggagtcctaacggctcgggacgtcctagggaaattacgtttcgcgtaagtgttaacttctggtaacagtcgtaagtcggttagacgtcgtacgtaccggacgttccggcgaaacgggtacgtaacggtacgtaaacgtaccgtaaacgaacgtttggaaggtccttaacggactaccgtaacggtcttcggttaaccgttccagttcccgttcccggtacctgtacccgg

SEQ ID NO: 245238 - DNA, 781 bp, Homo sapiens
  misc_feature: GYAE6OF02IKLC8.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctccaggcacctgtcttgtctcgaggggaaagngccaccctctcctgcagggccagtcagaatcgttaaccaactaggttcgtagccgtggtaccagaccaacgaaccgttggaccctaggttccccagccctccttacattctattgggtacttactcccgaccgaacggggtccctaacgtcgggacctaacgtcccccgaaggtaaccgtacggggtttccaacgggttcgggaccgaacgggtccggggggtttaccacggggggaacctaacgggttaccctttaccgtaccggttcctaaccgtaaaccctacgttcccgaaaggtcccgaacgggtaaccgtcggggtaacgtacccgttaaggtaaacgttacgttttacgacgttagtacggtttaactttaacgttcgtacgtacggacttagtagtacggtacgtaccgttcggaacggtaccggttacgggacccgtaaagggaccggtaaacgggttacggtaaacgtaacgtaaaaccgggtaccgttaggtacgggtacgtaacggtaccgtaaccgtacgttccgttacgttccgttacgtaccttaccgttaccccgtacgtacttaccgg

SEQ ID NO: 245239 - DNA, 730 bp, Homo sapiens
  misc_feature: GYAE6OF02G9QQQ.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgccaccggaaagactgtgttgacgcagtctccaggcaccctgtctttgtctccgaggggaaangccaccctctcctgcgagggccagtcaagaatcgttaaccaagtaggttcgtagccgtggtaccagcaacgaaaccgtggaccacggttcccagccctctcactctatggtatactccaccgaggccacgtggcacgtacccgagacgtaggttcaggtcggacgtaggccgggttacgtacggggactacggtaccttcaccttctaccgaccattaccgacgacctaagtaccgttgggaaccggtaccttaagggtaaacggttagttttccggacgttaaaggttcgtttaaacgtttaccgttacggttacggtaacgtacgttaaggttagttacggggtaactccgttaaccgggtaaccggggttaccgttccgggtaaccggaaccggggtaaccggtaaggggttaacggtaaaacgtaaccgaaacggtaaccgttggtaaccgggtaccgtaggtaacccgactaacgttccgttaggtcctttacgtaccgttcccgttaccccgtcgtaacgttccgg

SEQ ID NO: 245240 - DNA, 749 bp, Homo sapiens
  misc_feature: GYAE6OF02IHOKA.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctcaggggaangccaccctctcctgcagggccagtcagaatgttaccaactaggttcgtagcctaggtaccagcaagaaacctggaccaggttcccagccttcctacacttactagttggtaacttacgtccccgaaccgacggggccctaacgtcgggacctaacgtcccgaagtaccgtagggtttcaaggtcggacacgggtccgggttctacggggaactacggtaccttcgaaccgttcaccgtaacctatcccgagaccaacggtacgtacgggtacgtcccgtaggtaaacgttacgttttcgacgtaggttacgttaacttaccgttaggtaccgtaggtacgtaaggttagttagggtaccgtcgttaaccggtaccgggttaaccgggttccggaaaccgggtaaacggggtaacctaaaggggttaacgtaaaaccggtaaacgtaaaccgggtaacgtcgggttacgggacgttacggaacctaacccgttaagttcccgttaaggtttcccttaacgtaccgttcccgttacccccgtacgttagttacccgg

SEQ ID NO: 245241 - DNA, 597 bp, Homo sapiens
  misc_feature: GYAE6OF02HQAFC.5.59.F04.1.454.CMB.1.raw
  modified_base (197)..(197): a, c, t, g, unknown or other
  misc_feature (197)..(197): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaanagccaccctctcctgcagggccagtcagaatgttaccaacaggttcgagcctggtaccagcaagaacctggccaggttcccagcctcctcatctatggtatactcccaccgagggccacgtggaccactcccagtacaggttcaggtggacaggtcgggtctgggacagacttcactctacacatcagcagactgganccgtagaagtntttgactagttagttattacgtgtcgagtcagttatggtactctacgacgggtacggttccggaccgtaacgggaaccgtaagggtacggaaactaaccgaaacggtacgttaggtacggtaccgtagaccgtaacctgttacctgtttaccttacgtaccgttccccgtttacccgtacctacttaccgg

SEQ ID NO: 245242 - DNA, 669 bp, Homo sapiens
  misc_feature: GYAE6OF02H9IA6.5.59.F04.1.454.CMB.1.raw
  modified_base (199)..(199): a, c, t, g, unknown or other
  misc_feature (199)..(199): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaagngcccaccctctcctgcagggccagtcagaatgttaccaacaggttcgagcctggtaccagcagaacctggccaggttccagcctcctcatctatggtatatccaccacgggccacgtggacactcccgagacctaggttcaaggtggcgaggcgggtctgggacagacttcacgtctaccaccaatcgagcacgacgtgggacgtccgtaggtaaagttagtttacgacgtaggttagttactttacgtaggttacaggtactaaggttagttagggtacgtaccgtacgtaaccgggttaccggttaccgggaccggtaaacggggaaccgttaaacgggtaacgggaaacgttaaaccggaaaacggtaccgttagggtacgggtaccgtggtaccaaccgtaacgttaccgttacgttacctttccgtaaccgttttccccgttacccgttacccgtacgttaccgg

SEQ ID NO: 245243 - DNA, 699 bp, Homo sapiens
  misc_feature: GYAE6OF02HWC4X.5.59.F04.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacacacttagggagttggggtgctcagttaggacccagagggaaccatggaaaccccagcgcagcttctcttcctcctgctactctggctcccagatgccaccggaaagactgtgttgacgcagtctccaggccaccctgttctttgtctccgaaggggaancgccaccctctcctgcgagggccagtcagaatgtaccaacgtggttcgtacgcctaggtaccagacgaacgaaaccgtcggccacggttccccagtccctcctcatctagtggtaactactcccgaaccgacgggcctacgtcggcctacgtcccaagaccgtaggttcaggtggacgaggtccgggttcgtaggggacacggtaccttcgacttcgtaccaaccgtataccagcaacggtcgtaggacgtaccgtaggtaagttacgttttgacgtaggttacgttattacgtagttacgtagtactaaggttagttggtacgtaccgtaccgtaaccgggtaccggttaccgggaccgtaaacggggtaccgtaaacgggtaggaaaacgtaacgtaaaacggtaccgttaggtacggtacgtaacggaccgtaaccgtagttaccgttcgttacgtttacctaccgttacccgtttacccgtaccctagttaccgg

SEQ ID NO: 245244 - DNA, 783 bp, Homo sapiens
  misc_feature: GYAE6OF02JOYX3.5.59.F04.1.454.CMB.1.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgtctttgtcctcgaagggaancgcccaccctctcgngcgacggccagtcagtattcgtaccaacgtggttcgacgtccgtaggtaacccagtaccaaacggtaaacccgtcggacccgtacggttaccccgacggtccccttcctacgtacttacgttacgtaggtaactacctacccgaccgacgggaccctacgtcggacctaccgtacccgaacgtacgtacggttccgacggtcggacgcgggtaccgggtacggtacgggacgtaacgtaccttacgtactaccgtccgtaacctacgtaccaacgtaccgtaacggtaccgtacgggtaaccgtacgtaaggtaaccgtttacgttttcggaccgttaaggtttacgttaaacgttcgtacgtaacgtacggtaccgtaagtttacggacggtaccgtaccggttaccggtaacccggggttaccgttccggaaccggtaaccgggtaccggtaaagggtaacgtaaacgtaaaccgtaaccgtaggttcgtacggtcgtaacgaccgtaccgtaacgtcctttcgtaacgttaccgtacccgttacccggtacccttacgtacgttacgg

SEQ ID NO: 245245 - DNA, 718 bp, Homo sapiens
  misc_feature: GYAE6OF02G02I8.5.59.F04.1.454.CMB.1.raw
  modified_base (195)..(195): a, c, t, g, unknown or other
  misc_feature (195)..(195): n is a, c, g, or t
  modified_base (234)..(234): a, c, t, g, unknown or other
  misc_feature (234)..(234): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctcaggcacctgtctttgctccgaggggaaagngccaccctctcctgcagggccagtcagaatgtaccaacnggttcgagcctggtaccagcaagaaacctggccacggttcccagccctcctcactctatggtatactcccaccgagggcccacgtcgggctacgtccccgaagaccgtaggttccgaggtcggccgagggtcggggtcgtacggggaacctaggtacccttcgaccttctaccaccatcgagccgagacgtcggacgtccgtaggtaacgttagttttacggcgttaaggttagttaacgtttacgttcggtacgtaggtacgttaaggttagttcgggtacggtaccgttaccgggttaaccgggtaccgggtttcccgggaaccggtaaacggggtaaccgtaaaggggtaaacggtaaaaccgtaaaccgtaaacggtaacggtacgggtacggtaccgttaccggaaccgtaaccgtacgttaccgttagttcccgtttaaccgttaccgttttccccgaccgttacgttccgttaccgg

SEQ ID NO: 245246 - DNA, 563 bp, Homo sapiens
  misc_feature: GYAE6OF02GCCK6.5.59.F04.1.454.CMB.1.raw
  modified_base (196)..(196): a, c, t, g, unknown or other
  misc_feature (196)..(196): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangcccaccctctcctgcagggccagtcagatgttaccaacaggttcgtagcctggtaccagcagaaacctggccaggttcccagcctcctcatctatggtatatcccaccgagggccacgtggcactccccaagacaggttcagtggcaggcggtctgggacagactcactctcaccatcagcagacgtggacnctagaagtntttgcagttagtattacngtcagtcagttagtggtacgctacgacggtacgttcgggaccgaagggtaccgaagggtacggaaactacgaaacgtacgtgtacggtcgtcgacctaccgattcgttagttaccttcgtacttacccttcccgtactacgttaccg

SEQ ID NO: 245247 - DNA, 522 bp, Homo sapiens
  misc_feature: GYAE6OF02I5PX9.5.59.F04.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (402)..(402): a, c, t, g, unknown or other
  misc_feature (402)..(402): n is a, c, g, or t
  modified_base (428)..(428): a, c, t, g, unknown or other
  misc_feature (428)..(428): n is a, c, g, or t
  modified_base (516)..(516): a, c, t, g, unknown or other
  misc_feature (516)..(516): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgtaccaanaggttcancctggtaccagcagaaacctggccaggttcccagcctcctcatctatggtatactccaccgagggccactggcatccccagacaggttcagtggcagcggtctgggacagaccttcactctcacatcagcagacgtgagcctagaagtatttgctagtntagttactgtcagcagttagtggtanctcgacggtacgttaccggacgaagggacgaagggtaggaaactaacgaacgactaggtagcgtgacacatctgtctctatcctaccnctatcg

SEQ ID NO: 245248 - DNA, 581 bp, Homo sapiens
  misc_feature: GYAE6OF02F0Z4J.5.59.F04.1.454.CMB.1.raw
  modified_base (197)..(197): a, c, t, g, unknown or other
  misc_feature (197)..(197): n is a, c, g, or t
  modified_base (366)..(366): a, c, t, g, unknown or other
  misc_feature (366)..(366): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaccaacaggttcgtagcctggtaccagcagaaacctggccaggttcccagcctcctcatctatggtatatccaccagggccactggcatcccagacaggttcaggtggcagcgggtctgggacagacttcacttcncaccatcagccagactggacgcctagaagtagttttgcgtagttgttaattacgtgtcagctagtagtaggtagtcttcgacggtacggttacgggaccgtaaggggaaccgaaagggtaggtaaagtaaccgaaaacgtaacgtaggtaggtacgtggacctaacctacgttccgttgtacttacgtacttaccttccccgtcctacgttaccg

SEQ ID NO: 245249 - DNA, 573 bp, Homo sapiens
  misc_feature: GYAE6OF02G1QXI.5.59.F04.1.454.CMB.1.raw
  modified_base (197)..(197): a, c, t, g, unknown or other
  misc_feature (197)..(197): n is a, c, g, or t
  modified_base (237)..(237): a, c, t, g, unknown or other
  misc_feature (237)..(237): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgttaccaacnggttcgagcctggtaccagcaagaaacctggccacggttcccagcctcctcatctagtggtatactccacgaggccactggcactccagactaggttcagtggcaggcggtcgtgggacagtactcgactctcaccatcgagcagacgtggacgcctagaagttctttaggctaagttagtagtttactggtcacggtactagtgtgtacgcgttacgacggtacgtcggaacgaacgggtaacgagggtaacggaaataaccgaaacgtacgtacggtacggtacgtcgaaccagtctacgtcgttacttctacgttcccgtaccgtcgtactcg

SEQ ID NO: 245250 - DNA, 565 bp, Homo sapiens
  misc_feature: GYAE6OF02FOON5.5.59.F04.1.454.CMB.1.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctccaggcaccctgtctttgctccaggggaaagngccaccctctcctgcagggccagtcagaatgttaccaanggttctagcctggtaccagcagaacctggccaggttcccagcctcctcatctatggtatatccaccagggccacgtggcatcccagacaggttcagtcgcaggcgggtctggggacagcttcactctcacatcagcagactggagctgaagtntttgctagttnttattactgtctagctagtagtgtagtctcgacggtacgttcggaccgaacgggacgtaaggtaggtaaacgtacgtaaaccggtaacgtcggtacggtaccgtggaccaccgtaacgttccgtacgtttccttcgtaccgttcccttccccgacctattaccgg

SEQ ID NO: 245251 - DNA, 745 bp, Homo sapiens
  misc_feature: GYAE6OF02FJE2G.5.59.F04.1.454.CMB.1.raw
  modified_base (195)..(195): a, c, t, g, unknown or other
  misc_feature (195)..(195): n is a, c, g, or t
  modified_base (731)..(731): a, c, t, g, unknown or other
  misc_feature (731)..(731): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctccgaggggaaanacgccacccctctcgtgcgacggcagtcgaagtactcgttaaccaacgtacggttcgtaccgtccgttacggtaacccagaccgaaacgtaacccgtcggaccgtaaccggttccccagcccctttcctactacttaccttaggtggttaactccgtacccacggacggcctacggtgacctacgtccaagtacgtaggttcaggccggtagcgggtccggtacgtggggaacctagttaccttacacgttctaaccgactacgtacacgacggacgtacgtggacctacgtaggtaacgtttctttacggacttaaggttacttaacgtttaccgtcgtacgaacgtacgttagttaggtcgttaacgtccgttacggtaccgggtaaccggttacgggaaaccgtaacggggtaaccggtaaacgggtaaagtaaaccggtaaacgtaaccggtaggttacggtacggtaccgtaccgacctaacgttacgttccgttacgttaccgttaccttaccggttcccttaaccccgngttaacgttaccgg

SEQ ID NO: 245252 - DNA, 881 bp, Homo sapiens
  misc_feature: GYAE6OF02JF7IC.5.59.F04.1.454.CMB.1.raw
  modified_base (195)..(195): a, c, t, g, unknown or other
  misc_feature (195)..(195): n is a, c, g, or t
  modified_base (391)..(391): a, c, t, g, unknown or other
  misc_feature (391)..(391): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgccaccggaaagctgtgttgacgcagtctccaggccacctgtctttgctaccgagggaancgccacccttctccgtgcgacgggccagtcgaagtaacgttcgttaaacccaacgtacgggttacgtacgcccgttagggtaacccaggaccgaaacggtaaacccgttcgggaacccctaaccgggtttacccccacggttcccccttaccctacggtaacctttacgttaacggttaggttaaccctttaaccncccccgaacggaccgggaccctacgttcggacctaccgtaccccgaagaccgtaggttcaggtcggactacggggtccggtcggtacggggaacctacggtaccgttctaccgttccgtaccgaacccttagacccgaacgtacgtaacggtacggtacggtaacgtacccgtaaggtaaacgttttacgttaacggtacgttaagttacgttacttaccggttagtaacgtaacggtacgttaaggttacgttcgggtaaccgttccggtaaacggtaccgggttaaccggttacccgggaaaccgggtaaaccggggtaaccgggttaaacgggttaacggtaaaaccggtaaaccgttaaaacggtaccgggttacgggtacggttaccggtaaccgggtaacctaaaccggttaaccgtttccgttacggtttacccttaccggttacccgttaacccggttccccgtaacgttaacccgttccgg

SEQ ID NO: 245253 - DNA, 586 bp, Homo sapiens
  misc_feature: GYAE6OF02HPV5U.5.59.F04.1.454.CMB.1.raw
  modified_base (198)..(198): a, c, t, g, unknown or other
  misc_feature (198)..(198): n is a, c, g, or t
  modified_base (313)..(313): a, c, t, g, unknown or other
  misc_feature (313)..(313): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgccaccggaaagactgtgttgacgcagtctccaggcaccctgtctttgtctccgaggggaaancgccaccctctcctgcagggccagtcagaatcgttaccaagaggttcgtagcctggtaccagcaagaaacctggcctaggttcccagcctcctcatctatggtatactccaccgnggcctacgtggcactcccagacctaggttcagtgcaggcggtctgggacagtctcactcncacntcagcagcgtggacnctagaagttntttgactagttgtattacgtgtaccagtactagttatcgggtatcgtacgacggtacgttccggacgtaaacgggtacgtaagggtacggaaacttaccgaaacgtacgtaggacggtcgtacgacctaccgtagttccgttaggttccttacggtaccttcccgtacccgtaccctattccgg

SEQ ID NO: 245254 - DNA, 646 bp, Homo sapiens
  misc_feature: GYAE6OF02FX5PI.5.59.F04.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaagnggttcgtagcctggtaaccngcaagaacctggccaggttcccagtcctcctcatctatggtatactccaccgtagggcctacgtggcactcccgagtccaggttcaggtcggcaggcgggtctaggggaccaggtaccttcgacttccgtacaacctatccaagctaggaccgtacggacgaccgtaggaagttatttcggacgtagttacgttaattacgtcggtactaggtacgtagttaacggtggtacgtccttacggaccgggttaccggttcggaaccggtaaacgggaccggtaaagggtaaccgtaaacgtaaccgtaaaccgtacgttacggagggtcctaacggacctacccgtatcgttacgttaccttcgtaccgttcccgtacccgtacgtctacgg

SEQ ID NO: 245255 - DNA, 580 bp, Homo sapiens
  misc_feature: GYAE6OF02F4FL4.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccaccggaaagactgtgttgacgcagtctccaggcaccctgtctttgctccgaggggaaangccaccctctcctgcagggccagtcagaatgttaaccaacgtggttcgtagcctggtaccagcaagaaacctggccaggttcccagcctcctcatctatggtatatcccaccagggccactggcactcccagacaggttcagtggcaggcgggtctggggacagacttcactctcaccatcacgcagactggacgcctaggaagtagttttgactagttagttacttacgtgtactagtacgtagttatagggtatccttacgacggtaccggttccggaccgtaaacgggaccgtaaagggtaggaaaacgtacgaaacggactggtacggtcgtcgacctacacgttctacgttctcgtaccttccgtccctctattaccg

SEQ ID NO: 245256 - DNA, 870 bp, Homo sapiens
  misc_feature: GYAE6OF02HPEGS.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcacctgtcttgtctccgaggggaangccaccctctcctgcgacgggccagtcaagaacttcgttaacccaacgtagggttccgtacggtcccgtcggtaaccagccgtaaacgaaacccgttgggaccctaacgggttacccccaggtccccttcccgtacacttcctagttggttaactactcccgtaaccgcggggtaccctacgtcgggccaacgtccccgaagtaaccgtacgggtttcagggtcggacctagggtcccggggttacgtaggggaacctacggtaaccttttccgaaccctttccgtacctaaacccctagtaacccgaaggacccgtaagggtaccgttacggggaaccgtacccggttaaggtaaacggtttacggttttacggtaccgttaagggtttacgtttaacgtttaaccgttcggttaccgtaacggtacgttaacggtttacgtacgggtaacggtccgttaccggtaccggggtaaccgggtttacccggggaacccgggtaaacgggtaaaccggttaaacgggggtaaacggtaaaaccggtaaaccgtaaaacccggtacgtacgggtacggttaccggtaccggtaaccgttaaccggtactttaccggttcgtttaccgttaccgttacccggtttacccctttaccccggtacccttaccgttacccgg

SEQ ID NO: 245257 - DNA, 711 bp, Homo sapiens
  misc_feature: GYAE6OF02I8J6V.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgtctccaggggaangccaccctctcctgcacgggccagtcagaactgttaacccaactaggttcgagccctgggtacccagccaagaaacctggacccaggttccccagcctcctcatctagtggtactactcccaccgaggccactggcacgtcccagactaggttcaggtcggacaggccggtctggggactaggacctttacactcctacacccgtatccgacgacacggaccgttggacgtaccgtaggtaaacgttagttttacggcgtaggttacgttaacgttacgttggtaccgtaacgtaccgtagttaacgttagggtactaccggttacgtaaccggggttacccggttccgggtaacccggtaaaccggggtaaccgtaaacggggtaacggtaaactaacccggtaaacggttaaccgtaggttaccggtaccgtaacggtaccaaccgtacgttaccggttcgtttaccgttacgtacccgtttacccggttaccccggttaccgtacttaaccggg

SEQ ID NO: 245258 - DNA, 756 bp, Homo sapiens
  misc_feature: GYAE6OF02HDARV.5.59.F04.1.454.CMB.1.raw
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctcgaggggaaangccaccctntcctgcagggccagtcaagatntaccaanggttcngcctggaccagcagaacctggccaggttccagcctctcatctatggtaatctaccgaccgacgggcctacgtcggcctaaccgtccccgaagtaaccgtaggtttaccgaaggttcggacagggtccggggttagtaggggacctaggacctttacaacgtctaccaaccgtactacacggaccaaggtaccgtggacgtaccgtaggtaaacgttacgtttttacggacgttagtttaacgtttaacgtttaccgttacggttacgtacgggtaaccttaagggttaacgttacggggttacgttaccgttacggtaaccggggttacccggtttaccgggaacccggtaaaccggggtaaccgttaaacggggttaacggtaaaaccgttaaccgaaaaccgttaacgtagggttaccggtacgtacggtaacccgaacgttaaccgttacgttaccggtttacccgttaccgttaccgtttaccccggtttacccgtacccgttacgttacccgg

SEQ ID NO: 245259 - DNA, 907 bp, Homo sapiens
  misc_feature: GYAE6OF02IDF7W.5.59.F04.1.454.CMB.1.raw
  modified_base (199)..(199): a, c, t, g, unknown or other
  misc_feature (199)..(199): n is a, c, g, or t
tcagatcagacacgcacgaccggtgctcgatttagtacacacacttagggattgggtgctcagttaggacccagagggaaccatggaaaccccagcgcagcttctcttcctcctgctactctggctcccagatgccaaccggaagctgtgttgacgcagtcctccaggctaccctgttctttgtcctccgaaggggaanacgccctaccctctcctgcgaggccagtcaaggtaatcgttaccaacgtaggttctagcctggtaccagcaagaaccgtcggccgtacggttcccacgtccctcctcacttctagtaggttaactactccccgaaccgagggcccacgtcggacctactaccccgaaggaccgtaggttaccgagggtcggacgtacgggtccggggtacgtacggggaactaacggtccttaccgtactaccgtacccaaccgtaacttccgaacggtaccgtaaacggttaaccgggttacgggtaaccggtaaccgttaacggtaaaacggttttaacggttttacggaccggttaggtttaacggtttaaacgtttaccgttacgggttaacccggtaaacggtttaccgttaaagggtttaccggttaacgggggttaccgtaacccgtttaacccggggttaaacccgggtttaacccggggttacccggtaaaacccggggtaaaccgggggtaaaaccgggttaaacggggttaaacgggtaaaaccgttaaacccggaaaaaccgggttaaccggttacgggttaccgggttaaccctacggggtaaaccctaacccggttaacgtttacccgtttacgggtttaccctttacccgttacccgttttacccccggttaacccttaccccggtttacgtttaaccccggg

SEQ ID NO: 245260 - DNA, 679 bp, Homo sapiens
  misc_feature: GYAE6OF02F6F0W.5.59.F04.1.454.CMB.1.raw
  modified_base (199)..(199): a, c, t, g, unknown or other
  misc_feature (199)..(199): n is a, c, g, or t
  modified_base (240)..(240): a, c, t, g, unknown or other
  misc_feature (240)..(240): n is a, c, g, or t
  modified_base (365)..(365): a, c, t, g, unknown or other
  misc_feature (365)..(365): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtcctccaggccaccctgtctttgtctccgaggggaaangccaccctctcctgcagggccagtcagatgttaaccaacgnggttcgtagcctggtaccagcaagaaacctggacctacggttcccacgccctcctcactctatggtatactaccaccgacggccacgtgcactcccagacaggttcagtgacgacggtcggtcgngggacagtacctcactctacaccatcgagcacgacgtggacgtccgtagtaacgttacgttttggacgtaggttacgttaacgtttacgtcgttacgtagtacgttaaggttagttcgggtacgttaccgttaccgggtaaccgggttaccggttaccgggtaacccgggtaaacggggtaacccgtaacgggtaacggtaaacgtaaccggaaaccggtaacgttacgggtacggtacgtacggaaccgtaccgtacgttcgttacgttccgttacctaccgttcccgttaccccgtaccgtaccgttaccgg

SEQ ID NO: 245261 - DNA, 706 bp, Homo sapiens
  misc_feature: GYAE6OF02G4NVA.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccaggggaangccaccctctcctgcagggccagtcagaatgtaaccacaggttctagcctggtaccagcagaacctggccacggttccagcctctcatctatgtatactccaccgaggccacgtggccacgtcccagactaggttcaggtcggacagggcggtcgtagggactaggtaccttcactctaccaccatacacggtacacggtacgtgggtaccgacgtaagggtaacttagttttacgacgttaaggtttacgttaaagtttaccgtggttaaccgtaaggtacgtaaaggtttagtacggggttacgtaccgtaccgggtaaccgggttaccgggttacccggaaccgggtaaacggggtaacccgttaagggttaaacgggaaacgtttaaacccgaaacggttaaccggttagggtcgggtaaccgttccggtaacccgtaccgttaacgtttccgttacgttacccgttccgtacctttccccgttaccccgttacgtacgttcccgg

SEQ ID NO: 245262 - DNA, 641 bp, Homo sapiens
  misc_feature: GYAE6OF02GNQQG.5.59.F04.1.454.CMB.1.raw
  modified_base (199)..(199): a, c, t, g, unknown or other
  misc_feature (199)..(199): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgtctttgtctccgaaggggaaancgccaccctctcctgcagggccagtcagtaatgttaaccaacgtaggttcgtagcctaggtaccagcaagaacctggacctaggttcccagcctcctcatctatggtatactccacgacggccacgtggcactcccagacgtacggttcaggtggcagggtcggtcgagggacagtctcactctacacatcagacacgtacgtcggacgtcgtagtaagttagtttcgacgtagttgttaacttacgtgtacgtagtacgtagttagtaggtactccgtacgacgggtaccgttaccggaccgtaaacgggaccgtaaagggtaacggtaaacgtaacgtaaaccgtaacgtacggtcggaccgtacggaacctaaccgtacgttaccgttacgttaccgttacgttaccgttcccgtttaccccgtacctaccgttaccgg

SEQ ID NO: 245263 - DNA, 786 bp, Homo sapiens
  misc_feature: GYAE6OF02J1QC9.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggcctcccagatgccaaccggaaagactggtgttgacgcagtctccaggccaccctgttctttgtctccgaggggaaagcgcccaccctctcctgcgacgggccagtcaagaatcgttaaccaacgtagggttccgtacgtccgttagggtacccaggacaacggaaacccgtgggacctacgggttcccacgccctcctcacttctagtggtaatactacccgacgacgggccacgtcggaccacgtccccgaagtaccgtagggttacaggtcggcgaacgggtccggggtacgtaggggactacgtaccgtttaccacgtccgtaccaaccgtacgtccgaacggtacctaacgggtaccgttacggggaccgtacccgtaagggtaaacgtttacgttttacggacgttaagggttagttaacgtttacgtcgttacgtaacgtgtacgttacgtggttaccgcgttacggtaacgggttaccggttaccgggaaccggtaacgggtaaccggttaaacgggtaacggtaaacgtaaccgtaaacgtaccggttcggaacggtaccgtaaccgtaccggtaaccgttaacgttccggttacgtttacccgttaaccgttaccgtttaccccggttacccgtacccgttcgttaacccgg

SEQ ID NO: 245264 - DNA, 553 bp, Homo sapiens
  misc_feature: GYAE6OF02HIAH9.5.59.F04.1.454.CMB.1.raw
  modified_base (196)..(196): a, c, t, g, unknown or other
  misc_feature (196)..(196): n is a, c, g, or t
  modified_base (346)..(346): a, c, t, g, unknown or other
  misc_feature (346)..(346): n is a, c, g, or t
tcagatcagacacgcacgaccggtgctcgatttagtacacacacttagggattggggtgctcagttaggacccagagggaaccatggaaaccccagcgcagcttcccttcctccttctactctggctcccagatgccaccggaaagactgtgttgacgcagtctccaggcaccctgtctttgtctccaggggaaanagccaccctctcctgcagggccagtcagaatgttaccaacaggttcgtagcctggtaccagcagaacctggccaggttccagcctctcatctatggtatatccacagggccacgtggccatcccagacaggttcagtggcaggcgggtcngggacagacttcactctcacatcagcagactggacgcctagaagtatttgactagtgttattactgtcagtactagtagtggtagtcgtcgacggtacgtcggaccgaagggaccgaaggtaggtaactacgaaacgaacgtagtgacgtgacgtacacttcgtcgttctacgtacttcccgttacccgtcctacgttcctagtacg

SEQ ID NO: 245265 - DNA, 560 bp, Homo sapiens
  misc_feature: GYAE6OF02IPQ8G.5.59.F04.1.454.CMB.1.raw
  modified_base (195)..(195): a, c, t, g, unknown or other
  misc_feature (195)..(195): n is a, c, g, or t
  modified_base (332)..(332): a, c, t, g, unknown or other
  misc_feature (332)..(332): n is a, c, g, or t
  modified_base (357)..(357): a, c, t, g, unknown or other
  misc_feature (357)..(357): n is a, c, g, or t
  modified_base (439)..(439): a, c, t, g, unknown or other
  misc_feature (439)..(439): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccagggaaangccacctctcctgcagggccagtcagaatgttaaccaactaggttcgtagcctggtaccagacagaaacctggccaggttccccagccctcctcatctatggtatactaccaccagggccacgtggcatcccagacnggttcagtggcagcggtctgggacngacttcactctcacatcagcagactggacgcctagaagtattttgactagtgttattacgtgtacagactagttatggttanctacgacgtacggttcggacgtaacgggacgaagggtacgaaagtacgaaacgaacgtggtaggcgtgaccgaacctgttacgtgttacttcgaccttccgtaccccgtacctattacccg

SEQ ID NO: 245266 - DNA, 650 bp, Homo sapiens
  misc_feature: GYAE6OF02GA3C2.5.59.F04.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaagngccaccctctcctgcagggccagtcagatgtaccaanaggttctagcctggaccagcagaacctggccacggttcccagcctcctcatctatggtatactaccaccgagggccacgtggactactaccgagacgtacggttacaggtcggacgacggtcggggtacgtggggactacgtaccttaccaccgtctaccaacctagtcaagaccacggtacgtcgggactaccgtaggtaagttcgtttagacgtgttagttacttactcgtacgagtactagttagtggtacgtcgttacggaacgggttacggttaccggaaccggaacgggtaccgaagggtaacgtaaacgtaacgaaaccgtaagtggtacgggtacgtacggaccctacgtacgttaccgttcgttaccttcctaccgttaccccgtttacccgacgtaccgttccgg

SEQ ID NO: 245267 - DNA, 621 bp, Homo sapiens
  misc_feature: GYAE6OF02HCCJR.5.59.F04.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (402)..(402): a, c, t, g, unknown or other
  misc_feature (402)..(402): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangcccaccctctcctgcagggccagtcagatgttaccaacgnggttcgagcctggtaccagcagaaacctggcctaggttcccagcctcctcatctatggtatctccaccgagggccacgtggccatcccagactggttcaggtggcaggcggtnggggacagcttcactcncacatcagcagtacgtggacgtccgtagaagttntttacgactagttacgtagtttacgtcgtacaggtcgtagttagttgggtacgtcgtaccgtaacgggtaccggttaccggaccggtaaacgggtaccgtaaagggtaacggtaaacgtaacgtaaaaccggtacgtagggttacggtacgtacggaccgacccgtagttccgttacgttaccttaccgtacttccccgttcccgtacctacgttccgg

SEQ ID NO: 245268 - DNA, 646 bp, Homo sapiens
  misc_feature: GYAE6OF02HSTQZ.5.59.F04.1.454.CMB.1.raw
  modified_base (195)..(195): a, c, t, g, unknown or other
  misc_feature (195)..(195): n is a, c, g, or t
  modified_base (427)..(427): a, c, t, g, unknown or other
  misc_feature (427)..(427): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgtgacgcagtctcaggcacctgtctttgtctccgaaggggaaancgccaccctctcctgcgagggccagtcaagatcgttaaccaactaggttcgagcctggtaccagcaagaacctggcctaggttcccagtcctcctcatctagtgtatactcccacgacggccacgtggcactcccaagacgtaggttcaggtcggcaggtcgggtcgtggggactacgtacttcgacttcgtacaactatcgagacagacgtaggacgaccgtaggaagttnttttagacgttaggttagttaactttacgtgtacaggtactagttacgtggtacgtccgtacgtaaccgggttacggttaccgggaacggaacggggtaaccgtaaagggtaacgggtaaaactaaccggtaaacgtacgtggttacggtacgtacgacctaaccgtattaccgttgttaccgttactaccgttcccgttaccccgacctacgttccgg

SEQ ID NO: 245269 - DNA, 617 bp, Homo sapiens
  misc_feature: GYAE6OF02GHS6E.5.59.F04.1.454.CMB.1.raw
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangcccaccctctcctgcagggccagtcagatgtaccanaggttcagcctggaccagcaagaacctggccaggttccagcctcctcatctatggtatactcccaccgagggcccagtggcactcccagacaggttcagtggcagcggtntgggacngacttnactctcacntcagcagactggancctagaagtntttgcagttgtattacgtgtacagtacgtagttatagggtactcgttaccgaacgggtaccgttacggaccgtaaacggggaacccgtaaagggtaacggtaaaagttaaccgtaaaacggaccgttaggtacgggtaccggtaccggtaaccgtaacccgtaacgttaccgttagttaccgtttaccgaacgtttaccctttacccccggtacccgtaattacccgg

SEQ ID NO: 245270 - DNA, 603 bp, Homo sapiens
  misc_feature: GYAE6OF02IU317.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaagngccaccctctcctgcagggccagtcagatgttaccaacaggttcgtagcctggtaccagacacgaaacctggacctaggttcccagcctcctcactctatggtatactccaccgagggccacgtcggacacgtcccagactaggttcaggtgcaggcggtctagggacagaccttcactctacacatcagcgacgatggacgaccgtaggaagtattttcgacgtagtgtaattacgtgtacgagtctagttagtaggttacgctacgacgggtacgttaccggtaccgacgggtaacgtaagggtaggaaacgtaaccgtaaacgaacgtgtaggtaccgtcggaccgaacctagttcctacggttacctttccgaccgttacccttcccgtacctacgttaccgg

SEQ ID NO: 245271 - DNA, 657 bp, Homo sapiens
  misc_feature: GYAE6OF02GBZXF.5.59.F04.1.454.CMB.1.raw
tcagatcagacacgcacgaccggtgctcgatttagtacacacacttagggattggggtgctcagttaggacccagagggaaccatggaaaccccagcgcagcttcgtcttcctcctgctactctggctcccagtatgaccaccggaaagactgtgttgacgcagtctccaggcaccctgtctttgtctccgaggggaaagcgcccaccctctcctgcagggccagtcagatcgttaccaactaggttcgtagcctaggtaccagcaagaaacctggaccaggttccccagccctcctcatctatggtatactccaccgagggccacgtggcactcccagaccaggttcagtggcaggcggtctgggacaggtaccttcacttctacacctatccagcagacgtggactccgtagaagttattttcgactaggtttagttaacttacgtgtacgaacgtctaaggttagttagggtacgtaccgttacgtaccgggtaccggttccgggaacccgtaaagggtaacccgtaaagggtaacggtaaaactacgtaaaaccgtacgttagggtacggtaccgtaacggacctaaccgtacgttaccgttacgttacctttacgtaccgtttcccgttaccccggtcctaccgttacccgg

SEQ ID NO: 245272 - DNA, 599 bp, Homo sapiens
  misc_feature: GYAE6OF02GFRIX.5.59.F04.1.454.CMB.1.raw
  modified_base (198)..(198): a, c, t, g, unknown or other
  misc_feature (198)..(198): n is a, c, g, or t
  modified_base (289)..(289): a, c, t, g, unknown or other
  misc_feature (289)..(289): n is a, c, g, or t
  modified_base (382)..(382): a, c, t, g, unknown or other
  misc_feature (382)..(382): n is a, c, g, or t
  modified_base (410)..(410): a, c, t, g, unknown or other
  misc_feature (410)..(410): n is a, c, g, or t
  modified_base (592)..(592): a, c, t, g, unknown or other
  misc_feature (592)..(592): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaaggggaaancgcccaccctctcctgcagggccagtcagaatgtaccataggttcgtagcctggtaccagcagaaacctggaccaggttcccagccctccncatctatggtatactcccaccagggccagtggcactcccagactaggttcaggtggcaggccggtcgtgggacaggtacttcactctccaacntcacgcacgactggactcctagaagttntttagcgtagttagttattacgtgtacgagtctagtagtgtacgacttcgacggtaccgttacggaaccgaacgggtaaccgaagggtaacgaaacgtacgaaacgtacgttagtacggtacgtacgaccctaccgtacgttcgtacgtttaccttaccgtacgttcccgttccccgtactnttaccgg

SEQ ID NO: 245273 - DNA, 552 bp, Homo sapiens
  misc_feature: GYAE6OF02FFSS1.5.59.F04.1.454.CMB.1.raw
  modified_base (195)..(195): a, c, t, g, unknown or other
  misc_feature (195)..(195): n is a, c, g, or t
  modified_base (453)..(453): a, c, t, g, unknown or other
  misc_feature (453)..(453): n is a, c, g, or t
  modified_base (534)..(534): a, c, t, g, unknown or other
  misc_feature (534)..(534): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaaangccaccctctcctgcagggccagtccagaatgttaccaacaggttcgtagcctggtaccagcaagaaacctggccaggttcccagcctcctcatctatggtatactcccaccgacgggcctacgtcggcactcccgaagactaggttcaggtggcaggtcggtctgggacagtactcactctccacatcagcagactggactcgtagaagttattttgacgtagttagttacttacgtgtacacgactagtatggtanctacgacggtcgttacggacgaaacggacgaaggtaacgaaagtacgaaacgacgtgagcgtgacaccgatcgtgtccttntactcctcccgactctcg

SEQ ID NO: 245274 - DNA, 534 bp, Homo sapiens
  misc_feature: GYAE6OF02G0ZA9.5.59.F04.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
tcagatcagacacgcacgaccggtgctcgatttagtacacacacttagggattgggggtgctcagttaggacccagagggaaccatgggaaaccccagcgcagcttctcttcctcctgctactctggctcccagatgccaccggaaagctgtgttgacgcagtctccaggcacctgtctttgctcaaggggaaangccaccctntcctgcaggccagtcagatgtaccangttcngcctgtaccagcagaacgtgccaggttccagcctctcatctatcggtatctccaccgaggcccacgtggcacgtcccagactggttcagttggctaggcgggtctggggactagaacttcacgtctacactatcagcacgactggactcctagagtntttgctagtnttatactgtacagctagttagngtnactgacgtacgtcgacgaaggaccaagtcggaataaccgaagtacgtggtacgcgtgtaccacggtactcgtacgttcttacctagttcctaccgtactagttaccg

SEQ ID NO: 245275 - DNA, 689 bp, Homo sapiens
  misc_feature: GYAE6OF02IY2YU.5.59.F04.1.454.CMB.1.raw
  modified_base (239)..(239): a, c, t, g, unknown or other
  misc_feature (239)..(239): n is a, c, g, or t
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaagactgtgttgacgcagtctccaggcaccctgtcttgtctcgaggggaaacgccaccctctcctgccagggccagtctagaatcgttaaccaanaggttccagcctggtaccagccagaacctggaccaggttcccngcctccgacntcgtatacggtatactccgaccaggcctacgnggtcactccgagtcgagttcagtcggacacggccgtagtggacctagccttacactctaccactacgctacggcctacgtacgtacggacggtacccgtagtaaacggttcggttttacggacgtacggttttacgtaacggtttaccttacggtacgttaacgtacggttaacggttacgtacgggtttacacggttacccggaacggtttaccggtacgggtaaccgttaaccggggaaacttaggggttaaacgtaaacggttaccgtaaaacggtagttacgggtccgtacggtaacgacccttacggtaacctcgttacttaccggttactccgttaccgtttcccgtcgtaacttccgg

SEQ ID NO: 245276 - DNA, 649 bp, Homo sapiens
  misc_feature: GYAE6OF02HGYEB.5.59.F04.1.454.CMB.1.raw
  modified_base (196)..(196): a, c, t, g, unknown or other
  misc_feature (196)..(196): n is a, c, g, or t
  modified_base (232)..(232): a, c, t, g, unknown or other
  misc_feature (232)..(232): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaaangccaccctctcctgcagggccagtcagatgtaccanaggttcagcctggaccagcagaacctggccaggtccagcctctcatctatggtatactcccacgagggccacgtcggcactcccaaggacctagggttcaggtcggctagggccggggtcgtggggactaggtacctttacgacttcctaccacccgtataccgacgacacggtacgtagggacgtaccgttaggtaaagttacgttttacggaccgttaggttacgttagtttaccgtgtacgtacgtacgtagttagtaggtacgtcgtacggtacggtacggttaccggaacggtaacgggaccgtaagggtaacgtaaacgaaccgtaaagtaccgtaggtacggtacgtacgaccgtaccgtacgttccgtacgttacttacgtaccgtttcccgtcccgtactactaccgg

SEQ ID NO: 245277 - DNA, 632 bp, Homo sapiens
  misc_feature: GYAE6OF02G45UK.5.59.F04.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (353)..(353): a, c, t, g, unknown or other
  misc_feature (353)..(353): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgccaaccggaaagactgtgttgacgcagtctccaggcacctgtctttgtctccgagggaaangccaccctntcctgcagggccagtcagtaatcgttaaccaacgtaggttcgaagcccgttagggtacccaggaccaagaaacctggacctaggttcccagcctcctcatctatggtatactccacgaggcctacgtgcactccagtacaggttacnggtgacaggcggtctagggactaggtaccttcgactcgtacacctatccaggcaagtacgtggacgtacctaggaacgtttagtttcgattaacggttagttaacttacgtgtacgagtacgtaatagttaggtacgtcgtacgtacgggtacgttaccggtacgaaacgggtaacgtaacggtaacggaataaccgtaacggacttaggtcggtacgtcggactaaccgtactgttaccgttaccgttacctaacttccgtacccgtacctagtacgg

SEQ ID NO: 245278 - DNA, 192 bp, Homo sapiens
  misc_feature: GYAE6OF02HLE41.5.59.F04.1.454.CMB.1.raw
  modified_base (189)..(192): a, c, t, g, unknown or other
  misc_feature (189)..(192): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtcttgctcgaannnn

SEQ ID NO: 245279 - DNA, 700 bp, Homo sapiens
  misc_feature: GYAE6OF02HHKAG.5.59.F04.1.454.CMB.1.raw
  modified_base (208)..(208): a, c, t, g, unknown or other
  misc_feature (208)..(208): n is a, c, g, or t
  modified_base (338)..(338): a, c, t, g, unknown or other
  misc_feature (338)..(338): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtcctccaggccacccttgttccttttgtcctaccgaagggggaaancgccctaccctctccgtgacgagggccagtcaagaattcgttaaccaagtgggttcgacgcctaggtacccagaccaagaaacctggacctacggttcccaagtccctctactatctaatggtaattacncccgaacgacgggccacgtgaccacgtccaaggtacctaggttcaaggtcgccagggtccggtcgtgggaactaggtaccttcaccgtcaccacctagctaagctacggtcgtgactacgtagtaagttatttggactaagttagttactacgtgtaccgtaggtacctagttacggtcgtactcgtaacgccgggtacgttcggaaccgaaacgggtaacgtaagggtacgtaaactaacgtaaacggtacgtagggtaccggtacggtacgtaaccgaaccgttacgttacggtaccgtttttaccgtaaccctttacccggttacccccgtttaaccccgttagtaccctttaacccgg

SEQ ID NO: 245280 - DNA, 778 bp, Homo sapiens
  misc_feature: GYAE6OF02H9K01.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgtctttgtctccgaaggggaancgccaccctctcctgcagggccagtcagatgtaccaataggttcgagctggaccagcagaacctggccaggttcccagtccctcctcatctatggtatactcccaaccgtacgggccaacgtcggaccaacctccccgaagtaaccgtacggggtttaccaacgggttgggacccgtaagggtcccgggggttacgtaccggggggaactaaccgggtaacctttaccggtaacccttccttacctaaccccgattccgaacggccgtaaaggtacccgttagggaacgtcccgtaaggtaaacggttaggttttcgaaccgttagttacgttaacgtttaccgttggtaccgtaagtaccgtaaggttacgtgggtaaccgcgttaaccggtaaccgggttacccgggttaccggaacccgggtaaacgggtaaccgtaaacggggttaaacgggaaacgtaacccggtaaaaccgtaacgtacgggtacgggtaccgtcggtaaccctaaccgtactttaccggttacttccgtttaccgtaccgtttccccgttacccgtacccgttagttacccgg

SEQ ID NO: 245281 - DNA, 698 bp, Homo sapiens
  misc_feature: GYAE6OF02I4SNH.5.59.F04.1.454.CMB.1.raw
  modified_base (193)..(193): a, c, t, g, unknown or other
  misc_feature (193)..(193): n is a, c, g, or t
  modified_base (238)..(238): a, c, t, g, unknown or other
  misc_feature (238)..(238): n is a, c, g, or t
  modified_base (277)..(277): a, c, t, g, unknown or other
  misc_feature (277)..(277): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaacggaaagctgtgttgacgcagtctccaggcaccctgtctttgctcgagggaaangccacctctcctgcaggccagtcaagatgtaccaataggttcganccgtggaaccagcaagaacctggccaggtccagccttcncatctagtgtatactaccacgacggtccaactcggaccacgtcccgaagtaacacgggttaccaaggtcgggacacgggtccgggtcgtacggggaactacggacctttccaaacttcccgtaaacaccctaataccgaaccggacaaggtaacgtcggaacgtaccgtaagaaacgtttacgtttggactaggtttacgtaacgtttaaccgtggtagtacgtaccgtaagtaaccttggggtaactcctacgggaacgtaccggggtttcgaaccggaacggtaaccgggtaaaggaaggttaaaacacgaaaacgtaacgtcggtacgggtactccgggaaacctccgtaaagtccgtttaacggtccgtttaaccgtacctttcccggtaaccccggtacccttaggttaaccccgg

SEQ ID NO: 245282 - DNA, 622 bp, Homo sapiens
  misc_feature: GYAE6OF02HM7SZ.5.59.F04.1.454.CMB.1.raw
  modified_base (196)..(196): a, c, t, g, unknown or other
  misc_feature (196)..(196): n is a, c, g, or t
  modified_base (393)..(393): a, c, t, g, unknown or other
  misc_feature (393)..(393): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgttaccaacaggttcgtagcctggtaccagcagaaacctggccaggttcccagcctcctcatctatggtatatcccaccagggccacgtggcatccccagacaggtttcagtggcagcgggtctggggacaggacttcactctcacctatcaagctagcctgggacncctgaagtattttgctagtcgttattactgtcagtacagttatggttaagcgttacgaccgggtacgtttccggacccgtaaggggaacccgaagggttacgggaaaacgttacgaaaaccggtaacgttacgggtacgggtacgttacggacccgtaaccgtaacttccgttacggtttacctttaccgtacctttcccgttaccccggttaccctacctttacccgg

SEQ ID NO: 245283 - DNA, 741 bp, Homo sapiens
  misc_feature: GYAE6OF02H75W0.5.59.F04.1.454.CMB.1.raw
  modified_base (186)..(186): a, c, t, g, unknown or other
  misc_feature (186)..(186): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
tcagatcagacacgcacgaccggtgctcgatttagtacacacacttagggattgggtgctcagttaggaccagagggaaccatggaaaccccagcgcagcttctcttcctcctgctactctggctcccagatgccacggaagctgtgttgacgcagtctccaggcacctgtcttgtctcgaggganagccacctntcngcaggccagtcagaatcgtaccaanaggttcagctggacngcagaacctggcaggtccagcctctnatctatggtaatacncccacgaggcctagtggcctactcccgaagtacgtaggttcaggtaggccgaaggtccgggtactaggggtactacggaccgtttccgaaccgttcaaccctacccgtaattacccgaaggtacctaggtaacccgttagggtacgacccgttagtaaaacggtttacttttacggaccgtaaggttaccggttaagtttacgtaggtacccgaagggttcctaaaggttacgtttacgggtacgaccgttaccgggtaaccggggttaaccgggtttccggaaacccggtaaaccggggtaaaccgttaaaacggggttaacggaaaaacgttacccggaaaaaacgttaccgggtaagggttaccggtaaccgtacggtaacccgtaccgaaccggtttaccgtacggtttcccttaccgtaaccgttcccggtttaccccgtacccgtacgttacccgg

SEQ ID NO: 245284 - DNA, 880 bp, Homo sapiens
  misc_feature: GYAE6OF02IJIIW.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctcaggcaccctgtctttgctccgaggggaangccacctctcctgcagggccagtcagatcgttaccaacgtaggttcgtacgcctggtaccaggacaacggaaaccgtggaccctacggttccccacggccctcctcaacgttctaagtggtaacttactccccgaaccgacggggtcccaacgtcggcctaactccccgaagaaccgtagggtttccaagggttcggacgaggggaccggggttacgtcgggggtaaacgacgtaccgtttaccaacgttcccgtaacaaccctaagtaccgtaacggcctaaaggtaccgtacggggtacgtcccgttaaaggtaaacggttagtttttacggaccgtttaaggttacgtttaaacgtttaacggttgttaaccgtaacggtacgttaacggttaaggttcgggttaaccggtaccgttacccgggaaccggggtttaacccgggttacccggggaaacccggggtaaaccggggtaaacccgggttaaaaggggttaaaccgggtaaaaacggttaaacccggtaaaaaccgggttaaccgggtttacgggttaccgggtacccggttaacgggtaacccgttaacccgttaacggtttacccgttaacggttttccccgtttaaccgttacccgtttaccccccgggtttaccccccggttaccgttaacccggtttacccgg

SEQ ID NO: 245285 - DNA, 587 bp, Homo sapiens
  misc_feature: GYAE6OF02HEU31.5.59.F04.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (232)..(232): a, c, t, g, unknown or other
  misc_feature (232)..(232): n is a, c, g, or t
  modified_base (454)..(454): a, c, t, g, unknown or other
  misc_feature (454)..(454): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaangccaccctctccngcagggccagtcagatgttaccanaggttcgagcctggtaccagcagaacctggccaggttcccagcctcctcatctatggtatactccaccgacggccacgtggcactcccagacaggttccagtggcaggcggtcgtagggacagccgttacacttccgtcacctatcacgacacgtacgtaggacgccgtagtaagtagttttagacgtagttgttattactgtcacgtcaggtataggtacncgttacgacggtaccggttcggaccgaacgggaccgtaaggtacggaaacgtaacgaaacgtacgtaggtacggtcgtacgaccacgtagttccgtagttccttactacttaccgttcccgactaccgttacg

SEQ ID NO: 245286 - DNA, 749 bp, Homo sapiens
  misc_feature: GYAE6OF02JT3J3.5.59.F04.1.454.CMB.1.raw
  modified_base (199)..(199): a, c, t, g, unknown or other
  misc_feature (199)..(199): n is a, c, g, or t
  modified_base (404)..(404): a, c, t, g, unknown or other
  misc_feature (404)..(404): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtcctccaggccaccctgttctttgctccgaggggaaancgcccaccctctcctgcacggccagtcagtaatcgttaaccaactaggttcgtaagccgtaggtaccagacgaacgaacccgtggacccaggttccccagtcccttaccgtactaattcgttaactggtaacttacctcccaaccggacggtccctaacgtcggacctaacgtccccgaagtaccgtaggtttccaggtcggacngggtccggtacgtagggaccaaggtacctttcgacttccgtaccaacctagtcgaaccggactaacgggtaccctagggtaccgtaccgtaaggtaacggtttaacgttttcggaccttaaggttacgttaacgttaccgttaggttacgtaagttcgtaagttaacgttaggtaccgtaccgttacggtacggtaaccgttccgggaaaccgtaaccgggaaccgtaacgggtaaggtaaacgtaacgtaaacgtacgtcggtacggtaccggagtaaccctaccggtaattaccgttacgttaccttcgtaaccgtttccgtaccccgtaccttgtaacccgg

SEQ ID NO: 245287 - DNA, 621 bp, Homo sapiens
  misc_feature: GYAE6OF02HP0VX.5.59.F04.1.454.CMB.1.raw
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (354)..(354): a, c, t, g, unknown or other
  misc_feature (354)..(354): n is a, c, g, or t
tcagatcagacacgcacgaccggtgctcgatttagtacacacacttagggattggggtgctcagttaggacccagagggaaccatgggaaaccccagcgcagcttctcttcctcctgctactctggctcccagatgccaccggaaagactgtgttgacgcagtctccaggcaccctgtctttgctccgagggggaaancgccaccctctcctgcagggccagtcagaatgttaccaanaggttcagcctggtaccngcaagaacctggccaggttcccagccctcctcatcctatggtatctccaccgagggccacgtggccagtccccagtacaggttcagtgcagcgggtcngggacagacttcactcgtacaccatcgagcagacgtggacgcctagaagtatttcgactagttagttagttactgtcgtagactaggttagtggttacgccgttacgtaccgggtaccggtttaccggaccggtaacgggaaccgtaaacgggtaaggtaaacgtaaccgtaaaacggtaacgttcgggtacggtacgtacggacctaccgtaacgttccgtcggttacttacctacgtttacccttccccgtacctacgttaccgg

SEQ ID NO: 245288 - DNA, 692 bp, Homo sapiens
  misc_feature: GYAE6OF02F89W5.5.59.F04.1.454.CMB.1.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaangccaccctctcctgcagggccagtcagaatgttaaccanaggttcgtagcctggtaccagcaagaacctggccaggttcccagccctactcatctagtggtactactcccaccgaggccacgtggcactccagacctaggttcagtggctagggcggtacgtgggaacacgtacctttcactcgtacacctatccgaagtccaagtaccgtagggaaccgtcccgtaggtaaacgttactttttcggactaaggtttaggttaactttaccgtggttaccgaagtacgttaaggtagttagggtacgtaccttacgggaaccgggtaccgggtttaccgggaaccgtaacgggggaacccgtaaaggggttacggaaaacttaccggaaaaaccgttacgttggtacgggtacctaacggacctaaccgtagttcccgttaggtttacccttacgttaacccgtttcccgtttaccccggaccttacgttaccgg

SEQ ID NO: 245289 - DNA, 755 bp, Homo sapiens
  misc_feature: GYAE6OF02IQREY.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgtctccgaagggaagacgccaccctctcctgcgacggccagtcagtactcgtaccaacgtggttcgtacgccttagggtaccagtcaacgtaaaccgtcggtaccgtacggttcccacggtcccttccgtactattccgtaagttaggtacttaactccctaaccgaccgggtcctacgtcggactaccgttaccccgaagtaccgtaacggtttaccgacggtcggacgacggtcgggtacgtggggaacctaacggtaccttcgaaccctccgtacgtaaccacgttacgaacggtaccgtaacgtccggttacggacgtacccggttaagtaaacggttacgttttcggacgttaacggttacgttaacgtttaccgtagtacgtaaggtaccgtaagttacgttacggtacgtaccgtacggtaaccgggttccgtacggtaccgtaacgggaaccgtaaagggtaacggtaaacgtaaccgaaacgtaacgttcgtacggtacggtacgtacgtacctacgttacgtacgttacgttcctaccgtttcccgtaccctaccgtaccgtacg

SEQ ID NO: 245290 - DNA, 633 bp, Homo sapiens
  misc_feature: GYAE6OF02GGVL4.5.59.F04.1.454.CMB.1.raw
  modified_base (197)..(197): a, c, t, g, unknown or other
  misc_feature (197)..(197): n is a, c, g, or t
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (489)..(489): a, c, t, g, unknown or other
  misc_feature (489)..(489): n is a, c, g, or t
tcagatcagacacgcacgaccggtgctcgatttagtacacacacttagggattggggtgctcagttaggacccagagggaaccatgggaaaccccagcgcagcttctcttcctcctgctactctggctcccagatgccaccggaaagactgtgttgacgcagtctccaggcaccctgtctttgctccgaggggaaangccaccctctcctgcgagggccagtcaagtatcgttaaccaacgtaggttcgtaagcccttggtaacccagcaagaaacctggccaggttcccagcctccnatctatgtatactccacgacggccatggcactcccagactacggttcagtgcaggccgggtnaggacngtacttacactcncctaccgaatccgaagctacggaacgttagggacgtacccgtaggtaagttacgtttttacggactaacggtttgtaactttaaccgtcggtaccaggtacctaaggttntacggtacgccgtacgacggtacgttccggaaccgtaacgggtaaccgtaagggtacgaaaacgttaccgaaacggtacgttacggacggtacctggaacctacgtacttcgttcgtacttctactacccttccgactcctacg

SEQ ID NO: 245291 - DNA, 574 bp, Homo sapiens
  misc_feature: GYAE6OF02H4K97.5.59.F04.1.454.CMB.1.raw
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (285)..(285): a, c, t, g, unknown or other
  misc_feature (285)..(285): n is a, c, g, or t
  modified_base (340)..(340): a, c, t, g, unknown or other
  misc_feature (340)..(340): n is a, c, g, or t
  modified_base (369)..(369): a, c, t, g, unknown or other
  misc_feature (369)..(369): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaancgccaccctctcctgcagggccagtcagatgtaccanggttcagctggaccagcagaacctgccaggtcccagcctctcatctatgtatncccacaggccactggcactcccagactaggttcagtcggcaggcggtctgggacngtactcactcacacatcagcagctggacncgtagaagtatttgctagttgtacttactgtacagcgtaagttagtggtagtcctacgacggttaccggttaccggaccgtaaacgggaaccgaagggtaacggaaacgtaacgaaaccgtaacgtgggtacggtacgcggtaccctaccgtagttccgtcgttccgttactaccgttcccgtttaccccggactacgttaccgg

SEQ ID NO: 245292 - DNA, 864 bp, Homo sapiens
  misc_feature: GYAE6OF02IUTWU.5.59.F04.1.454.CMB.1.raw
  modified_base (165)..(165): a, c, t, g, unknown or other
  misc_feature (165)..(165): n is a, c, g, or t
  modified_base (199)..(199): a, c, t, g, unknown or other
  misc_feature (199)..(199): n is a, c, g, or t
  modified_base (573)..(573): a, c, t, g, unknown or other
  misc_feature (573)..(573): n is a, c, g, or t
  modified_base (676)..(676): a, c, t, g, unknown or other
  misc_feature (676)..(676): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgaccaccggaaagactgtgttgacgcagtcnccgaggcaccctgtcttgtctccgaaggggaaanacgccaacccttctaccgtgacacgggccagtcagtaaacttgtaacccaacgtaggttactagccgttaggaaccagacgaagaaacctcggaccgtaacggttccccacgtaccccgtacctacgtacttaccgtaacgttaggtaacttaacttacccccgaacccgtaacggggaccccttaaacgtcgggaccctaccgtaccccgaaacggtaacgtaaccgggtttacgtaacgggtacgggtaccgacgggttaccgggggttaccgtacgggggaaacgtaaccgttaccgtttacctaacccttaccttaccaaccgtaacgtacccgaaagaccggtaaccggttaccgtaaggggtaacccnccggtaaacgtaaacggtttaacgtttttacggaacgtttagggtaacttaacgtttaaccgtacggtttacaacggtaacgtaactttagttacgggtaccnccgtaacggttaaccgggtaccggtttacggaacccggtaaacggggtacccgttaaagggtaacgtaaacggtaaccaaaaccgggttaacgtcggttacgggacgtaacggtacctaaccgttacgttacggtacctttaccttacgttaccttaccccggtaacccgttccgaaccgtttcccgg

SEQ ID NO: 245293 - DNA, 686 bp, Homo sapiens
  misc_feature: GYAE6OF02GUHLA.5.59.F04.1.454.CMB.1.raw
  modified_base (235)..(235): a, c, t, g, unknown or other
  misc_feature (235)..(235): n is a, c, g, or t
  modified_base (424)..(424): a, c, t, g, unknown or other
  misc_feature (424)..(424): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaagagccaccctctcctgcagggccagtcagatgtaccaanaggttcagcctggtaccagcaagaacctggccaggttcccagcctcctcactctatggtatactcccaccgtagggccacgtggcctactccccgaagacctacggttcaggtcggacagggccgggttctaggggaccaggtacctttcaacgtctaccaccgtatccaagtccaagtacgtgggacnccgtagtaacgttattttcggacgtagttacgttaacgtttaccgtcgtacgtagtaccgtaagttacgtgggttaacgccgttaccggtaaccgggttacgttacccgggaaccggtaaacggggaaccgttaaacggggtaacggaaaacgtaaccgtaaaacggtaacgttgggtaccggacgttccggaaccttaacccgtgttaaccgtcgtttaccgttactacccgttaccccgtcccgtacttaccgttaccgg

SEQ ID NO: 245294 - DNA, 808 bp, Homo sapiens
  misc_feature: GYAE6OF02IASMA.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattgggtgctcagttaggaccagagggaaccatggaaaccccagcgcagcttctcttcctcctgctactctggctcccagatgccaccggaaagactgtgttgacgcagtctccaggcaccctgtctttgtctcgaggggaaangccaccctctcctgcgagggccagtcagaatacgtaaccaacgtagttacgtagccgtacggtacagacgaacgaacctggaccacggttcccacggtcctacctctaactctagtgtaactctacccacgaggaccacgtgcactaccgagtactggtcaggtcgcgagggtcggtcgtacggggacacgtacgttaccacgttccgacctacaacgtccaacggtcgaacggtaacccggtagggaccgtaccggttaaggaaacgttttacgttttacggtacgtttacggttagtttaaaacgtttaccgttacggtaaccgtaacggtacggttaaggttaaggttaccgggtacgttacccgtaccggttaacccgggggttaacgggtttacccgggaaacccggggtaaaccgggggtaaaccggttaaagggggtaaccgggtaaaaaacgttaacccggtaaaaaagggtaacccggttacggggttaacgggttacggtaaccggtaaccctaacccggtacgtttacggtttacccgttaaccgttttcccgtaaccgttttacccccgtttaaccccggtacccgttaacgtttaccccgg

SEQ ID NO: 245295 - DNA, 565 bp, Homo sapiens
  misc_feature: GYAE6OF02GEZEC.5.59.F04.1.454.CMB.1.raw
  modified_base (199)..(199): a, c, t, g, unknown or other
  misc_feature (199)..(199): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgtctttgtctccgaaggggaaangcccaccctctcctgcagggccagtcagaatgttaccaacgaggttcgtagcctggtaccagcaagaaacctggccaggttcccagcctcctcatctatggtatatccaccgagggccacgtggccatcccagacaggttcaggtggcaggcggtcgtgggacagtacttcactctcaccatcgagcagacgtggacgtccgtaggaagtattttgactagtagttattacgtgtacagctagtagtggtacgtcgtcgacggtacgtcggacgaacgggacgtaagggtagaaacgtacgaaacgaacgtgtacgacgtcgaccacctacgtcgtgttctactacttccgtcccgtcctataccg

SEQ ID NO: 245296 - DNA, 925 bp, Homo sapiens
  misc_feature: GYAE6OF02IESLE.5.59.F04.1.454.CMB.1.raw
  modified_base (198)..(198): a, c, t, g, unknown or other
  misc_feature (198)..(198): n is a, c, g, or t
  modified_base (240)..(240): a, c, t, g, unknown or other
  misc_feature (240)..(240): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgttctttgtctccgaggggaaangccaccctctcctgcgagggccagtcagaatgttaccaacgnggttcgagcctggtaccagcaacgaaacctggcctaggttcccagcctcctcacttctagtggtactactcccgaaccgacgggacctaacgtcgggacctaccgtccccgaagtaccgtagggtttaccgaggttcgggccgtaacgggtccgggggttacgtacgggggtaacctaacgggttaacctttaccgtaacccgtttccgtaacccaaacccgtaacgtacccgaaacggtcccgtaaagggtaacccggttaggggaaccggtacccggtttaaacggtaaacggtttacggttttttaacgggaccgttaacgggtttacggtttaaaccgttttaaccggttacggttaaccggtaacggttaacgttaagggtttaacgggttacggggtttaaccgtacccggtttaaccgggtaacccggggttaaccggggttttacccgggaaacccggggtaaaaccgggggtaaacccggtaaaacgggggttaaaacgggtaaaaccgtttaaaacccgggaaaaaccggttaaccgggtttacgggtaaccgggttaccgtaaccgggtaacccaaacccgtttaacggttcccgttttaaccgggtttcccgtttaacccgtttaacccgtttaccccggtttaccccggtacccgtttaccgtttacccggg

SEQ ID NO: 245297 - DNA, 663 bp, Homo sapiens
  misc_feature: GYAE6OF02JXL2E.5.59.F04.1.454.CMB.1.raw
  modified_base (200)..(200): a, c, t, g, unknown or other
  misc_feature (200)..(200): n is a, c, g, or t
  modified_base (340)..(340): a, c, t, g, unknown or other
  misc_feature (340)..(340): n is a, c, g, or t
  modified_base (424)..(424): a, c, t, g, unknown or other
  misc_feature (424)..(424): n is a, c, g, or t
  modified_base (655)..(655): a, c, t, g, unknown or other
  misc_feature (655)..(655): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgtctttgtcctaccgaggggaaangcccacccttctcctgcagggcccagtcaagaacttcgttaaccaagtggttccgtaagtcccgtggtaaccagacctaaggaaaccgttggacctacggttccccagtcctacctcatctagtgtactactccgaccgnggccacgtggctactccgaagaccgtagtcaggtggacgtagcgggttcagggacagtcttacgcttacactaccgatccgaanaccgaagtccgtagggtaccgaccgttagggaaagttcgtttacggccgttaagtttacggttaactttaccgtggtaaccaggttccgtaagttaccgtttaggaccgtactcggtaaccggttcgtacccggacggtaaaggaccggttaaggaagtaaccgtaacggtaaacgtggttagcggttacgcgactactacgtctacgtacttaccgtcgtccctaccgtnacgttacg

SEQ ID NO: 245298 - DNA, 631 bp, Homo sapiens
  misc_feature: GYAE6OF02GZQKM.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaangccaccctctcctgcagggccagtcagaatcgttaccaataggttcgtagcctggtaccagcaagaacctggccaggttccagcctcctcatctatggtatactccaccacgggccacgtcggcactccccagactaggttacaggtggcaggcgggtctagggacagtcttcactcacacatcagcagacgtggacgccgtagtaagtagtttcgctagtgttattcgtacgtacagtacgtaggttaagttggtacgtcgtacggtaccggttaccggttaccgggaccgtaacggggtaaccgtaagggttaacggtaaacgtaaaccgaaacgtaaccggttacggtacgggtacctaacggaccgtaccgtaacgttccgttacgttaccgttacctaccgtttacccgttacccgtaccgtacgttcccgg

SEQ ID NO: 245299 - DNA, 847 bp, Homo sapiens
  misc_feature: GYAE6OF02F9BF4.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaagactgtgttgacgcagtctccaggcaccctgtctttgctccgaaggggaaagcgcccaccctctcctgcacgggcctagtcaagtaacttcgtaaccaacgtaggttacgtagtccgtaggtaccagacgaagaaacctcggcctaacggttccccaggcccttcctactacgttactagttggtaactacgtacccaccggtacgggaccctaccgtacggacctaaccgtaccccgaacgtaaccgtacggtttacgaggtcggcgtaccggtcgggttacgtacgggacacgtacctcgacttctaccgaacctactacgacgtacgtaacgaccgtggacgtaccgtagtaaacggttctttacggaacgttacgttagggttaactttaccgggtacgttaccgtaaggtaccggttaagttaaccgggtttaggtacgtacccggtttacccgggtaaacccggggttaccggttaacccggggtaaacccgggttaaaccggggtaaaaccgggttaaaaccggggttaaaccgggaaaaacccggttaaaccgggttaaaaccggttaacgggttcgggtaaccgggttaccggtaacccgggaccctttaaacggtacctttacggtttaccggttaacctttaccttacccggtttaccccggttccccgttaacccttcgttacccggg

SEQ ID NO: 245300 - DNA, 666 bp, Homo sapiens
  misc_feature: GYAE6OF02HK3NE.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctcaggcaccctgtcttgtctccaggggaaangccaccctctcctgcaggccagtcagaatcgttaaccaactaggttcgagcctggtaccagcaagaacctggccaggttcccagcctcctcattctatggtaatatacccaccgagggaccacgtggacactacccagactaggttacgaggtcggcacggtcggggtacgtggggactacggtacctttcgaacgttctaccgaaccagtaccaaggcctaagggtaccgtaggacgtaccgtaggtaagtagttttcgactaggttagttatttacgtgtacgtaagacgtaagtagtaggtacgtactacgtacggtaaccgttacgtaaccgtaacgggaaccggtaagggtaagtaaacgaaacgtaaacgtaacgtacggtacgggtacgtacggtacctacgtaacgttccgttacgttaccgtttacaccgtttacccgttaccccgtaccgttacgtacccgg

SEQ ID NO: 245301 - DNA, 801 bp, Homo sapiens
  misc_feature: GYAE6OF02FJFRP.5.59.F04.1.454.CMB.1.raw
  modified_base (196)..(196): a, c, t, g, unknown or other
  misc_feature (196)..(196): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccaggccacctgtctttgtctccgaggggaaancgccaccctctcgtgcgagggccagtcagatcgttaaccaacgaggttcgtagccgttggtaccgacgcgaacgtaaaccctgggaccctacgggttaccccgacgtccccttaccctactaacgttccgttaaacgttcgggtaacttaaccttaccccgaaccgaacggggtcccaacgttcgggaccctaacctcccgaacggaccgttaacgggttcctaacgggttcgggaccggtacgggtccgggggttaccgtacgggggacctaacgggttaacctttccgaaccgttcgtaacccgaaccgtaactccggaaacggtaccgaacgtacgtcggggaacgtccgtaaaggtaacttacggtttacggcgttaaggtttacgttaattaccgtcgtaacgtaggtacttaagggttacgttagggaccgttaccgttacggaaaccgggttaccggttaccgggaaccgtaaacggggtaaccggtaagggtaaacgtaaacgttaccggaaacgtcggtacggtaccggtacgtaacgccgtaacctacgttgtaccgtaccgttactacccgttacccgtcccgactagttaccg

SEQ ID NO: 245302 - DNA, 800 bp, Homo sapiens
  misc_feature: GYAE6OF02HGB64.5.59.F04.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
tcagatcagacacgcacgaccggtgctcgatttagtacacacacttagggattggggtgctcagttaggacccagagggaaccatggaaaccccagcgcagcttctcttcctcctgctactcgtggctcccagatgcccgaaccggaaagactgtgttgacgcagtctcgagcacctgtcttgctcgagggaaancgccaccctntccngacgacggcagtacagtaagttacttaaccgaagttaggttacggaacgtcccgttagggaaccaagggtaccaaaacggtaaaccgttccggggtaacccgtacggggtttaccccaacggtcccccttacctacgtaacgttacttaaacggttacggtaaacttttacccaacccggaaccgggtaaccggggtaacccgtaccggtaccgggactttaaacccgtacccccggaaagtaaccccggttaacggttaccggaacgggttacggacgtaacgggttccggggtaccgttagggggaaacctacggttaccttacgaaccgtacctaccgaacgtaactccgaacgtcaacggtaccgtggaaccgtactagtaagttcgttagactagttaactattacgtctagtacgtagacgttgtacgtacaccggtacgacggttaacgtccgggaaacacgggtaaacgtaagtaaacggtaaacgtaaaccgaaggtaacgcggttaacgaccgtagaaccctaacgtaacctgttaccggttacctacgttacccaccggtttaccctacggcgttaaccg

SEQ ID NO: 245303 - DNA, 791 bp, Homo sapiens
  misc_feature: GYAE6OF02INTK2.5.59.F04.1.454.CMB.1.raw
  modified_base (193)..(193): a, c, t, g, unknown or other
  misc_feature (193)..(193): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctcaggcacctgtctttgtctccgagggaangccaccctctcctgcgacgggccagtcagtaacttcgttaaccaacgtacggtttccgtacgccgttacggtaccagaccgaacggtaaaccgtcggtaccctacgggttccccagtccccttccgtacctacttctaagttcggtaacttacctcccgaaccggtacggggaccctacggtcggacctacgtccccgaaggtacgtacgggttacgagggttcggacgtacgggtccggggtcgtacggggaaccgtagttaccgttacctaccgtctacccaaccgtactacgaacgtaccgaacggtaccgttaggggaccttacccggttaagtaaccggttattttacggacgtttaggtacgtttaacgtttacgtggttacctacggtactaaggttacggtacggttagtcccgttaaccgggaccgggtttacgggtaccgggaaccgaaacggggtaaccgtaaagggtaacgtaaaaccgttaacggaaaaccgtaggttggacggtaccggtccgtaacctacgttaacttccggtattttacccgtactttacccgtaccccgtttcccggacttacggttcccg

SEQ ID NO: 245304 - DNA, 600 bp, Homo sapiens
  misc_feature: GYAE6OF02H6WAH.5.59.F04.1.454.CMB.1.raw
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (394)..(394): a, c, t, g, unknown or other
  misc_feature (394)..(394): n is a, c, g, or t
tcagatcagacacgcacgaccggtgctcgatttagtacacacacttagggattgggtgctcagttaggacccagagggaaccatggaaacccagcgcagcttctcttcctcctgctactctgctcccagatgccaccgaaagactgtgttgagcagtctccaggcaccctgtctttgtctccaggggaaanagccaccctntcctgcagggccagtcagatcgtaccagngttcgtanctggacngnacgaactgcagtccngcctctcntcatgtatatccgacaggccactcggcactccagacaggttcagtgnacgcggttcncgggacngacttcacgtctcgacctagtacacgcagtaccgtaggacgcgtacggaatagttttcgngtaacgtgttactttacgtcgttacgagtaccgtagttaccgtaggtacgtacctacgacggtacgttcccggtacgaacgggtaccgtaaacgggtaggaaagtaaccgtaaagaacgttcgtaacgggtataccggtccgaacccgtacgttaccgttacgtttaccttaccgtaacgttcccgtacccgtcccgtattaccgg

SEQ ID NO: 245305 - DNA, 664 bp, Homo sapiens
  misc_feature: GYAE6OF02H2OQF.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgcagtctccgaggccaccctgtctttgcctccgaggggaaancgcccaccctctcctgcacgggccagtcagtaatcgttaccaactaggttcgtagcctggtaccagacaacgaacctggacctaggttccccaggtccctcctacacttcgtagttacgtacttactacccgtaccgaacgggtacccctacgttacgggacctaaccttacccccgaagtaaccgttacgggttcagggtcggacctagggccgggttacgtacgggactagtacctctacgtctaccgactatcgacgacagacgtgacgtccgtagtaagttgtttagacgttagttagttaacttcgtgtcacgtacgtaacgttagtacgggtataccgtacgtacggtaccggttacgaccggaacggacggtaaggtaagaacgtaacgaacgtagtagtacggtactacggtacacgtattcgtacgtcgttactaccttcgtacccgtctataccgg

SEQ ID NO: 245306 - DNA, 892 bp, Homo sapiens
  misc_feature: GYAE6OF02IV7LS.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctcgaggggaaangccaccctctcctgcgacggccagtcgaagtaacttacgttaaccaacgtacgggtttacgtacgtccgttacggtaaccgagaccgaacggtaaaccgtcgggaccgtacggttcccaacgtcccttacctactacttaccgttagttacggtaacttaccgtacccgaaccggtacggggtaccctacggtacggtacctaaccgtaccccgtaacgtaccggttaacgggttaccgtaacgggttcggaccggtaacgggtccgggggttaccggtacggggtaaaccgttaacggttaaccgtttacccgtaacccttaccgtaaccgtaacccctagttaccgaaccggtaacgtaacggtaccggtagggtaccggtacccgttaaggtaacgtttacgtttcggacttaggttacgttaacttcggtacgtaacgtaggttacgttaggttacgttacgggtaactccgttaaccgggacgggttaacggttacccggaaacgggtaaaccgggtaaccggtaaacggggttaaaccgggtaaaactaaacccgggtaaaacgggttacgttacgggtaacggtacccggtaacggtaacccgtaacgttaacggtttacccgtacgttttaacccggttaacctttacccggttttaccccgaccccggtttaccttacggtttacccgg

SEQ ID NO: 245307 - DNA, 607 bp, Homo sapiens
  misc_feature: GYAE6OF02GYPE6.5.59.F04.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (263)..(263): a, c, t, g, unknown or other
  misc_feature (263)..(263): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctccaggggaaangcccaccctctcctgcaggccagtcagatgtacangtcanctgacngcagaactgcaggtccagcctcnatctatgtatctccacagggccacgtggcactcccgagacgaggttcaaggttggaccaggcgggtcgtgggaacnggtaccttcactctacacagtacngacacgacgtggacgtccgtagaagttctttgcgtagttgttactctaggtctaggtactaaggttagttaggtactcgtacgaccgggttaccggttacggacccggaaagggtaaccgtaaggggtaaacggtaaaacgtaaccgggtaaaacgacgttacgggtacggtacgttacggacctaaccgttagttccgttagttcctttacgtaccgtttccccgtcccgtcccgtattcccg

SEQ ID NO: 245308 - DNA, 849 bp, Homo sapiens
  misc_feature: GYAE6OF02J028X.5.59.F04.1.454.CMB.1.raw
  modified_base (147)..(147): a, c, t, g, unknown or other
  misc_feature (147)..(147): n is a, c, g, or t
  modified_base (727)..(727): a, c, t, g, unknown or other
  misc_feature (727)..(727): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctccagatcgccgaacggaanactgtgtacgacgctacgtctccgacggccctaccgttgttcttcgtaccgtacggaagggaacgccgtcctaccctctccgtgacggaccggacctagtacgaagtacttaccgttacgacggttacggttacgacgtacgtacggtacgacgacgtaacggtacctcggtaccgtaccggttccacgtcccttacgtcttaacgttacgtaggttaccgtacttaacccggcccgacggtaccggtacctaccggtacgtaccctaccgtaacggtacgtacggttacgggtacgtacgggtcggaccggtcgggttacgtaccggacgtaccgtacttaccctcctacccggtacaccctaccggtaacgtacggaacccgtacggtacgtaccgaggtacccgttaggtttaaaccgtttaggttcgtaagttaccgttaacgtttacggttaacgttaccgacggttactagggtaccgttagtccggtaagtccgtacccgggtaacggttacccgggtaacggtaaacccgggtaaaggtaaccggtaacggtaaacgtaaacccgggttaanaacccggtaacggtttcccgaggttacccgtaaccgtacgtacccttagtacccgtttaccgtaaccgtttccgttaccccgaccgtttaaccccggtaccgtacccggttttacgaccggg

SEQ ID NO: 245309 - DNA, 561 bp, Homo sapiens
  misc_feature: GYAE6OF02GNKQW.5.59.F04.1.454.CMB.1.raw
  modified_base (197)..(197): a, c, t, g, unknown or other
  misc_feature (197)..(197): n is a, c, g, or t
  modified_base (237)..(237): a, c, t, g, unknown or other
  misc_feature (237)..(237): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngccaccctctcctgcagggccagtcagaatgttaaccaanaggttctagcctggtaccagcagaaacctggaccaggttcccagcctcctcatctatggtatatcccaccagggccactggcactcccagacaggttcagtggcaggcgggtctgggacagtacttcactctcacctatcagcagactggacacgtgtaagtagttttgacgtaggttagttacttacgtagtctagtctaagttagtggtagtcgtacgacggtacggttcggacgaacgggacgtaaggtagaaacgtacgaacgtatagcggtacgtcggactacgacttctaggtcttctcttacctcccgtctactccg

SEQ ID NO: 245310 - DNA, 565 bp, Homo sapiens
  misc_feature: GYAE6OF02I8OUK.5.59.F04.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (293)..(293): a, c, t, g, unknown or other
  misc_feature (293)..(293): n is a, c, g, or t
  modified_base (437)..(437): a, c, t, g, unknown or other
  misc_feature (437)..(437): n is a, c, g, or t
  modified_base (461)..(461): a, c, t, g, unknown or other
  misc_feature (461)..(461): n is a, c, g, or t
tcagatcagacacgcacgaccggtgctcgatttagtacacacacttagggattggggtgctcagtttaggacccagagggaaccatggaaaccccagccgcagcttctcttcctcctgctactctggctcccagatgaccaccggaaagacctggtgttgacgcagtctccaggcaccctgtctttgctccaggggaaancgccaccctntcctgcaggccagtcagaatcgtaccaacnggttcagcctgaccngcagaactggccagtcccagcctcncatcatgtactancccacgacggccacgtggcacgtccagacgagttcaggtcgcgaggccgggttctaggggacacgtaccttcaccgttctaccgaacctagtccagtacacgtacgtggacgccgtagaagtctttagctagtcgtattacgtntcgtagtacgtagtagtcggtacncgtcgtaacggtcgttcggacgaaggacgaaggtaagaatacgaacgagtcgcggtactgacctctaacgttcgtacgttcgtactacgtcctccgactctacg

SEQ ID NO: 245311 - DNA, 895 bp, Homo sapiens
  misc_feature: GYAE6OF02FHCIS.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaccggaaagactgtgttgacgcagtctccaggcaccctgtcttgctccgaggggtaaacncgcccaccctctccgtgccgagggccagtccagtactcggttaacccaacgtcggttcgacgcctcgggtaacccagaccaacggaaacccgtggaccctacgggtttaccccaggtccccttacccgtacaacgttacctaagttcggttaactaccgttaccccgaaccggacggacccctacgttcggacctaaccgttaccccgaacgtaaccgtagggtttaccaacggttcgggactacggggtccggtccggtagggacctacggtaccctttaccgaccgttccgtaccgaaaccctacgtaccgaaccggtaccgtaacgggtaaccggttcgggggtaaccctaccggttaacgggtaaaccggtttaacgtttttacccgggaacccgttaaggtttaccgggtttaaacctttacccgggtaacgggtttaccaacgggtacccgttaaaggtttaccgttcggggttaaccggtacccgttaacccggggtaaccgggttaccggggtttaacccgggaaacccgggtaaaccggggtaaaccggttaaacggggttaaaccaaaaccggtttacccgaaaacgggttacggttacggtacggtaaccgtaaccgggtaccaaccttaacggtccttacggttaccctacgttacccgttcccgtacccgtacctacgttccgg

SEQ ID NO: 245312 - DNA, 758 bp, Homo sapiens
  misc_feature: GYAE6OF02JQRJU.5.59.F04.1.454.CMB.1.raw
  modified_base (59)..(59): a, c, t, g, unknown or other
  misc_feature (59)..(59): n is a, c, g, or t
  modified_base (146)..(146): a, c, t, g, unknown or other
  misc_feature (146)..(146): n is a, c, g, or t
  modified_base (192)..(192): a, c, t, g, unknown or other
  misc_feature (192)..(192): n is a, c, g, or t
  modified_base (234)..(234): a, c, t, g, unknown or other
  misc_feature (234)..(234): n is a, c, g, or t
  modified_base (249)..(250): a, c, t, g, unknown or other
  misc_feature (249)..(250): n is a, c, g, or t
  modified_base (285)..(285): a, c, t, g, unknown or other
  misc_feature (285)..(285): n is a, c, g, or t
tcagatcagacacgcacgaccggtgctcgatttagtacacacacttagggattggggtnctcagttaggacccagagggaaccatcggaaaccccagcgcagcttctcttcctcctgctactctggctccagatcgccacggaaanctgtgtgacgcagtctcgagccacctgtcttgactcgaagggaaancgtcccaccctgtcctgcgaggccagtcaagatcgtaccagngttcagcctagaccnncaagaacctggactaggtccagcctccgtacactntacgtaggtactacgtccgaccgacggtcctacgtcggacctaccgtccaaggtacgtacggtctaacgggtcgaccggtacggtccgggttacgtaggggaacctacgtacgttccaacggttctacggaacccagttaccgaacgtacgtaacgggtacgttaacgggccgttacccgaagttaaacccggttgtttaccgacgttaaacgttcgttaaagttcccgtagtacgtaacgtcctaaagggttccgttaggtacgtaccggtaccgtaaccggttaaccgggtaccggtaacccggggtaaacgaaccggggtaaaagtttacccggggaaaactaacccgggtaaaacgttaccggtacgttacgggttaaccccggttagaccgtaaccgtttaaccgtcgttaaaccgtttctaaacccggtccgtttaaccccggtccggtaaaccttcggttaaccgg

SEQ ID NO: 245313 - DNA, 739 bp, Homo sapiens
  misc_feature: GYAE6OF02IXZKZ.5.59.F04.1.454.CMB.1.raw
  modified_base (198)..(198): a, c, t, g, unknown or other
  misc_feature (198)..(198): n is a, c, g, or t
  modified_base (464)..(464): a, c, t, g, unknown or other
  misc_feature (464)..(464): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgtctttgtctccgaggggaaancgccaccctctcctgcacggccagtcagaactcgttaccaactggttactagcctaggtaccagacaacggaaacctggacctacggttaccccaggtccctcctactaactccgttaagtacggttaattacgtaccccgaaccggtaacggggtcccctaccggtacgggacctaaccgttacccccgaaagtaaccgaggtttacaggttcggacgaggtccgggtacgtcgggaacacggtaccttcgaactctcgaacctntacgacgtccaagtacgtcggaacgtacgtaaggaaacgttacgttttagacgttaagttagtttaaacttacgtcggtaactacggtaacttaggttaagtcgggtactacgttaccggaacgggttaccgtaccggtaaccggaaacgggtaaccgaaagggttacggaaaacttaacgaaacggttaacgtcgtaacggtaccgtcgtaccaacctacgttaccgttcgttaccttacgtaccggttccccttaccggtactacgttaccgg

SEQ ID NO: 245314 - DNA, 764 bp, Homo sapiens
  misc_feature: GYAE6OF02ID3GK.5.59.F04.1.454.CMB.1.raw
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (580)..(580): a, c, t, g, unknown or other
  misc_feature (580)..(580): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtcttgctcgagggaangccnccctctcctgcagggccagtcagaattcgttaaccaaacgtaggttcgtacgcctcgggtaaccagtcgaacgaaaccgtggacctacggttcccaggtcctccgtcacttctagttcggtaactactacccgaaccgtacgggcctaccgttacggactaccgtaccccgaagtaaccgtaacgggtttaccgaacggttcgggacgtacgggtccggggtcgtaacggggaactacggtacctttacgaccgtttccaccgtaacctagtaccgaagccgtaacggtacgttacgggaacgtcccgtaagaaacggtttagtttcgacgtagttacgttaacttacgttagtaccgtagtacgtagttaaagtcggttaacnccgttacggaaccgggtttaccggtacccggaaccggtaaacggggaccgtaaaacggggttaacgaaaacgtacccgaaaacgggttacgtagggaccggtacgtacggtaacccgtaataaccgtttcggtacggtttacaccgtttaaccgtaccccttaccggtacctacggtttaccgg

SEQ ID NO: 245315 - DNA, 716 bp, Homo sapiens
  misc_feature: GYAE6OF02J05DE.5.59.F04.1.454.CMB.1.raw
  modified_base (319)..(319): a, c, t, g, unknown or other
  misc_feature (319)..(319): n is a, c, g, or t
  modified_base (650)..(650): a, c, t, g, unknown or other
  misc_feature (650)..(650): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaccggaaagactgtgttgacgtcagtctccaggcctaccctgttctttggtcctaccgaagggggtaaacgacgccctaacccttctccgtgcgacgggcctagtcaagtaattcgttaaccgaacgtaggttacgacgtccgtcggtaccagacaacgaacctggcctagtccagcctcncactctagtgtactacaccacgacgccatacggcactaccgagaacgtcgttacgacgtgccgagggtccggtcgtaacgggactaggtaccgttactaccgttccacgtaacctaagacctacggacgtacgtaacgtcggacgaccgtaggtaaaggttacgtttcgacgttacgttacggttacttacggttctacggtaacgtacggtacggttagtacgggtactaccggttaccggtacgggttaccggttacgggaaccgggttaaacggaaccggtaaaggtaacggtaaaacgtaaccgtaaaacggtaccgtaggtacggngttaacggtaacctacgtaacttaccgtcgtttacgtccttacgtcccgttacccgtactactcgg

SEQ ID NO: 245316 - DNA, 792 bp, Homo sapiens
  misc_feature: GYAE6OF02HQ1NV.5.59.F04.1.454.CMB.1.raw
  modified_base (155)..(155): a, c, t, g, unknown or other
  misc_feature (155)..(155): n is a, c, g, or t
  modified_base (193)..(193): a, c, t, g, unknown or other
  misc_feature (193)..(193): n is a, c, g, or t
  modified_base (261)..(261): a, c, t, g, unknown or other
  misc_feature (261)..(261): n is a, c, g, or t
  modified_base (296)..(296): a, c, t, g, unknown or other
  misc_feature (296)..(296): n is a, c, g, or t
tcagatcagacacgcacgaccggtgctcgatttagtacacacacttagggattggggtgctcagttaggacccagagggaaccatggaaaccccagcgcagcttctcttcctctgctactctggctccagatgccaccggaagctgtgttgacgnagtctccgaggccacctgtctttgtctccgaggggaancgcccaccctctccgtgcgacggccagtcaagtactcgttaaccaagtggttcgagccgtaggtaccngacaagaacctggcctacggttccagtccctctanacttctagtggtaactacgtaccccgaacgaggggtccctaaggtcggaccaaccgtccccgaaggtaaccgtagggtttcacggggttacggaccgtaacgggtccggggttactagggggtaaccctaaggttacccctttaccgtaaaccgtttccgacccgtaaccttagtacccgtaaggtccctaaacgggtaccgttcggggaacgttacccgtaagggttaaaacgttcgttttcggaaccgttaggttacgttaacttacggtacggtactacggtaccgtaaggtttacgtaggttaactcgttacgggtaaccgggtaccggtttaccggaacgtaaacgggtaccgtaaagggttaacggtaaactaaaccggtaaacgtacgttggtaaccggtacgtcggaacccgttacgtaaccgtttggtaccgtttacccggtacgttaacccgtttcccggttaaccccgtacgttaaccgttccgg

SEQ ID NO: 245317 - DNA, 779 bp, Homo sapiens
  misc_feature: GYAE6OF02ISQZD.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaaggggaagacgccaccctctcctgcagggccagtcagtaatcgttaaccaacgaggttcgtacgcctaggtaccagccaagaaacctggaccacggttccccagcctcctacactactagtggttactactacccaccgagggccacgtgggacactcccgaagaccgtacggtacagtcggccgtaggccggggtcgtcgggaacgtagtaccgttctaactccgttaccaaccgtatccgaacgacctaacggtacgtagggtaccgtaccgtaaggtaaacggttcgttttaggacgttaaggttacgttaaattttacccgttaggttacgtaacggtacgttaaggttacgttacggggttaaccgtacccgttacgggtaaaccgggttacccgggtttacgaacccggggttaaacggggaaaccccggtaaagggggttaaaccggtaaaaccgttaaaccggaaaaccggtaacccggttagggtaccgggttaccgttaacgacccggttaaacctaacgtttccgtacggttacctttccgttaccgttaccgttacccccgttacgtacctttacccgg

SEQ ID NO: 245318 - DNA, 571 bp, Homo sapiens
  misc_feature: GYAE6OF02G4T2R.5.59.F04.1.454.CMB.1.raw
  modified_base (192)..(192): a, c, t, g, unknown or other
  misc_feature (192)..(192): n is a, c, g, or t
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
  modified_base (552)..(552): a, c, t, g, unknown or other
  misc_feature (552)..(552): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagactgtgttgacgcagtctccaggcacctgtcttgtctcgaggggaangccaccctctcctgcagggccagtcaagaatcgttaaccaactaggttcagcctggtaccagcaagaaacctggccaggttccagcctctcatcgtatggtaatactccgacgagggccactggacactccagacnggttcagtgcnggcggtngggacngacttnactcncacatcagcagacgtggagtccgtagaacgttntttacgactaggttagtacttacgtgtacgaggttctaagtgtaggtacgaccgttggaaccggtacggttaccggacggtaaccggaacgtaagggtacgaaactaacgaacgtacggtgtaaggcgtacggacacgtaactcgtctacgttacncttccgtaccgcctagtcg

SEQ ID NO: 245319 - DNA, 794 bp, Homo sapiens
  misc_feature: GYAE6OF02FF6A6.5.59.F04.1.454.CMB.1.raw
  modified_base (195)..(195): a, c, t, g, unknown or other
  misc_feature (195)..(195): n is a, c, g, or t
tcagatcagacacgcacgaccggtgctcgatttagtacacacacttagggattgggtgctcagttaggacccagagggaaccatcggaaaccccagcgcagcttctcttcctcctgctactctggctccagatgccaccggaaagactgtgtgacgcagtctccaggcacctgttcttcgtctcgaggggaaacncgcccacctctccgtgcgacgggccagtcagtactcgttaaccgaactcggttctacgccgttggtaaccagactaacgaaaccgtcggacctacggttcccagccttacctactactctagtcggtactacgtaccaccgacggcctacgtcggactaccgtcccgaacggtaccgtacggttttacgaacggttcggaaccgtacggggtccggggttacgttacgggggtaacctaacggggttaaacctttccgtaaacccgtttcccgtaacccgtaaccctaacgttaacccgaacggtacccgaaacggtaccgttacggggtaacccggtaacccgtaagggttaaaccggtttaacgtttttacggaacgttaacggtttacgtttaaaccgttaccgtacggttacgaacggtactaacgggttacgttacgggtacgtaccgttacggtaaccggttacggttaccggaaaccggtaacgggtaaccgtaagggtaactaaacgtaaccgaacgtaacgtgtacgcgtaacgacgtacctacgttcgttacgttacttacgtccttacccgttccgactacgttaccg

SEQ ID NO: 245320 - DNA, 596 bp, Homo sapiens
  misc_feature: GYAE6OF02HXTRX.5.59.F04.1.454.CMB.1.raw
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcacctgtctttgctcgagggaangccaccctntcctgcagggccagtcagatgtaccanggttcagcctggaccagcagaactgccacgttcccagcctctcatctatgtatactcccaccgtacgggccacgtggcactcccgagtacctacggttcaggtcggacgacggtcgggtacgtggggacacgtaccttctaccgtactccgaccatacaacgccagaccgttggacctcgtagaagttatttcgactggttatatttaccgtagtcaagtcgtaagtagttaggtacgtcgtacgtaacggtccgttacggaccgtaagggaccctaagggttacggaaacaccgtaaaggtaccgtagtgaccggtgacctacgcttacgtacgttcttacctagttcccgttaccctctacgtaccg

SEQ ID NO: 245321 - DNA, 799 bp, Homo sapiens
  misc_feature: GYAE6OF02HPBDC.5.59.F04.1.454.CMB.1.raw
  modified_base (599)..(599): a, c, t, g, unknown or other
  misc_feature (599)..(599): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatcgccaccggaaagactgtgttgacgcagtctccaggcacctgtctttgtctccgaaggggaaatacgccacctctccgtgcgacgggccaggtcaagaacttcgttaaccaatacgggttacgtacgccgtcggtaccaggaccaagtaaaccctgggtacctaacgggttccccaggtccccttcctaacgtacttaccgtaagttggttaactaaccgttaccccgaaaccggtacggggaccctaaacggttcggacctaaccgttaccccgaaagggtaccgttacgggtttaccagggttacggcgtaacggggtccggttaccggtgggaacctaacggtacctttgaaacccgtttcgtaccaaccctaagtaccgtaacgtaccgagtacccgttaaggtaccgtacgttacggtaaagttacttttacgacggttaagtacggttactttaacggtntacgtaacggtcgtaaggttacgtgggtacgtaccggttacggacgggttaaccggttcccggtaacgggaacgggtaaccgtaacggggtaagtaaaacggtaacgtaaaaccggtagtacggtacggtacgtacgaacctaaccgtaccttacggttacttaccggttactcttacccgtacccgtactcggttaccg

SEQ ID NO: 245322 - DNA, 791 bp, Homo sapiens
  misc_feature: GYAE6OF02F7R97.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccaccctgtctttgtctccgaggggaaangccaccctctccgtgcgagggccagtcagatcgttaccaactaggttcgtagcctggtaccagcaacgaaccgtggaccacggttcccagcctcctacatctagtcggtactactacccaccgtacggcctacgtcggacctaacgtccccgaaggaacgtacgggtttaccaggtcggaccgtaacgggtccgggttcgtaggggaaccacggtaccttaccgtaccttacgtacccgaaccgtacgtacccgaaggtaccgtaacggtacggtacgggaccgtacccgtaaggtaaacggttagttttaccggaacgttaaggttacgtttaacgttacgttacggttactaacggttacgtaacgtttaggttacgggttacgtccgttaaccgggtaacccgggtttaaccgggttaccgggaacccgggttaaacgggtaacccggttaaaagggtaaaccgtaaaaccgtaaccgtaaaccggtaacgttacgggtacgtacggtaccgtaaccgtaacgtaccgttacgttcgttacccgttaaccgtacccgtttcccgttaccccgtaccgtacgtttacccgg

SEQ ID NO: 245323 - DNA, 558 bp, Homo sapiens
  misc_feature: GYAE6OF02GZ773.5.59.F04.1.454.CMB.1.raw
  modified_base (198)..(198): a, c, t, g, unknown or other
  misc_feature (198)..(198): n is a, c, g, or t
  modified_base (348)..(348): a, c, t, g, unknown or other
  misc_feature (348)..(348): n is a, c, g, or t
tcagatcagacacgcacgaccggtgctcgatttagtacacacacttaggggattggggtgctcagtttaggacccagagggaaccatggaaaccccagccgcagcttctcttcctcctgctactctggctcccagatgccaccggaaagactgtgttgacgcagtctccaggcaccctgtctttgctccaggggaaangccaccctgtcctgcagggccagtcagaatgttaccaatagggttcgtagcctggtaccagccagaaacctggccaggttcccagcctcctcatctatggtatatccaccagggccactggcatcccagacaggtcagtggcaggcggtntgggacagacttcactctacacctatccgagcacgactggacgcctagaagtattttagcgtagtgttattacgtgtactagtcgtagtacgtggtagctcgacggtacgttcggaccgtaagggacgtaagggtaggtaaactacgaaacgaacgtggtaggcgtagacgaccagtcttacgtcttactattcctcccgtctacttccg

SEQ ID NO: 245324 - DNA, 727 bp, Homo sapiens
  misc_feature: GYAE6OF02IH38N.5.59.F04.1.454.CMB.1.raw
  modified_base (93)..(93): a, c, t, g, unknown or other
  misc_feature (93)..(93): n is a, c, g, or t
  modified_base (128)..(128): a, c, t, g, unknown or other
  misc_feature (128)..(128): n is a, c, g, or t
  modified_base (155)..(155): a, c, t, g, unknown or other
  misc_feature (155)..(155): n is a, c, g, or t
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
  modified_base (412)..(412): a, c, t, g, unknown or other
  misc_feature (412)..(412): n is a, c, g, or t
tcagatcagacacgcacgaccggtgctcgatttagtacacacacttagggattggggtgctcagttaggaccagagggaaccatggaaacccngcgcagcttctcttcctctgctactctgctccagntgccacggaagctgtgtgacgcagtcncagcacctgtctttgcgtcgaagggancgtccacctctcgngcgaacgggcctagtcgnggaacttcgttaccaaacgtccggttcgtcgaccgtaggtaccgacgacgtaaacgaaccgttcggacccttaacgttaaccccgacggttccccgtaccttacctaacggttcctagttaacggtattacccgtacccgaaaccgttcggaccgaacgttcggactaacctccggtacgtaaccgtgtaacgggttnaaaggttccgacgggtacggttacggtacgggactaaacggttccggtcttaaacccgtcgtacctaccgtaacgccgtaacggtacgtaacgacgtacggtacgtacgtacggtagttgttacgaagtacgttacgttacgttagtaagtaccggtactacgtacgtaacgtcgtacgtacgtacggttccgtaacggtcgtaacgaacggtaacgtaaggtaccgtaaaggtacgaacgtccggtagtacgtacgtaccgtaaccgtataccgttacgtcgttcgtacgttcgtacctccgtacgtacggtac

SEQ ID NO: 245325 - DNA, 859 bp, Homo sapiens
  misc_feature: GYAE6OF02JXBZD.5.59.F04.1.454.CMB.1.raw
  modified_base (199)..(199): a, c, t, g, unknown or other
  misc_feature (199)..(199): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatcgccaccggaaagactgtgttgacgcagtcctccgaggccaccctgtctttgtctcgagggaancgcccacctctcctcgcgagggccagtcaagtaattcgttaaccaacgtacgggttcgtaacgtccgtaggtaaccagaccgaacgtaaacccgtgggaccctacgggttccccaacgtccccttacctactattacctaggtcggttaactacctccccggaacgccgggtaccctaccgtagggaccctaccgtacccgaacggtaccgttacgggttaccgaacgggttcggacccggtaagggggtacccggggttcggtaaacggggtaaacccttacggttaacgtttccccgtaacttccccgttaaccgaaccccgtaatccgtaacgaccggtaggtaaccgtcgggtacgtacccgtaaggttaacgttaccggtttacgtaagtacggtttaacggttacttaaccggttacggtaacgtacggttacgttaacggtttaccgggttaaggtaccgttaccggtaccggtaaccgggttacccgttaaccgggaaccggttaaccgggaaaccgggttaaagggaaaccggtaaaacggttccggaaaacggttccgttagggtaccggttaccgtcggtaacccgttactacggttaccttaccggtctttaaccgtaccgttcccctaaccgtccgttacgtaccgg

SEQ ID NO: 245326 - DNA, 767 bp, Homo sapiens
  misc_feature: GYAE6OF02HFOZM.5.59.F04.1.454.CMB.1.raw
  modified_base (167)..(167): a, c, t, g, unknown or other
  misc_feature (167)..(167): n is a, c, g, or t
  modified_base (200)..(200): a, c, t, g, unknown or other
  misc_feature (200)..(200): n is a, c, g, or t
  modified_base (254)..(254): a, c, t, g, unknown or other
  misc_feature (254)..(254): n is a, c, g, or t
tcagatcagacacgcacgaccggtgctcgatttagtacacacacttagggattgggtgctcagtaggaccagagggaaccatggaaaccccagcgcagcttctccttcctcctgctactctggcctcccagatcgccaaccggaagtactgtgttcgacgcagttcnccaggccaccctgtcttgctccgaggggtaaancgccaccctctcctggccagggccagtcagaactgttaccaacgtggtcgtacnccgtggtaccagcaagaaccgtggaccgtacggttcccagtcccttacctcgaacttccgtaagttcggtaacttaccgccccgaaccgtaacggggtcccctaaacggtcggtacctaacccgtccccgaaacggtaccgtaacggtttcgaacggtggtaccggacgggtccggtacgttcgggaacacggttctaccggacttcgactccaagtcacgggtacacgtggtacggtactcggacgtaaacggttgtttacgtactaggtacgttacgtattcgaacgttaacgtgtaacggtagttcggtacgtccgtaacggttccggggtaacttcccgggtaccggtaaccggtaacggttaaccgggaaggtaaacctaaccgggtaaaaccgttaggtaacggggttacgtaccggttccggaaccgttaacccgtacgtttaccggtagttttaccccgagtttacccggttacccttacccggttaacccgtcgtttaacccgg

SEQ ID NO: 245327 - DNA, 772 bp, Homo sapiens
  misc_feature: GYAE6OF02HGOE2.5.59.F04.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaccggaaagactgtgttgacgcagtctccagcaccctgtcttgtctcgagggaaancgccacccttntcctagcacgggccagtcagaactcgttaaccaacgtagggttcagcctagggtacccaggaccaagaaaccgtcggtccacgggtttaccccacggtcccttaccttacattcctagtacggttaactacgtcccgaaccgtacggggaccctaacgtcgggtacctaacgttccccgaaggtaaccgtacggttttccaagggtttcgggaccgtacgggttccggggttcgtaacggggacacgttaccgttcctaaccgtctacccaacctaattccgaccgactaacgggtacccgtagggtaccgtaccggttacgtaaacggtttacgtttttacggaccgtaaggtttacgtttacgtttaccgtacggttactacggtaccgtaaggttaacgttgggtacgtacccttacgggtaaccgggttacccggttacgggtaacccgggttaacggaaccggttaaggtaaccggtaaaacgtaccgaaacgtacgtacggttacgcgtacgacctacgcttacgcttcgttacgaccttcccgtaccgtctaccgttacg

SEQ ID NO: 245328 - DNA, 752 bp, Homo sapiens
  misc_feature: GYAE6OF02G6R3O.5.59.F04.1.454.CMB.1.raw
  modified_base (197)..(197): a, c, t, g, unknown or other
  misc_feature (197)..(197): n is a, c, g, or t
  modified_base (239)..(239): a, c, t, g, unknown or other
  misc_feature (239)..(239): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccgggaaagactgtgttgacgcagtctccaggccaccctgtctttgctccgaggggaangcccaccctctcctgcacgggccagtcaagaatgttaccaanaggttccgagcctaggtaccagcaacgaacctggccgaggttccccagccctccgtacactctactggtatactccgaaccgcgggacctacgtggaccacgtaccccgagtaccgtacggttccaggtcggacgacgggtcggggttctacggggactaggtaccttacgaccgttcctaccgactaacttcaacggtacctaacggacgttagggaccgtaccgtaagggtaacgtttacgttttaggaccttaaagggttcgttaacttttacgacggttactaacggtacgtaggtttagttacgggtacgtaccggtacgtaaccgggggttaccggttaccgggaaaccgggaacgggtaaccggttaacggggttaaacggtaaacgtaaaccgaaaaccgggttacttacggggaccggtacggtccgaaccggtaacccgtagttacccgttacgttaccgttaccttacgtcccccgtttacccgttaccgtactttacccgg

SEQ ID NO: 245329 - DNA, 545 bp, Homo sapiens
  misc_feature: GYAE6OF02GNKNL.5.59.F04.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (430)..(430): a, c, t, g, unknown or other
  misc_feature (430)..(430): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctggtgttgacgcagtctcaggcaccctgtcttgctccaggggaaangccacctctcctgcaggccagtcagaatcgttaccaacnggtcgagcctaggtaccagcagaaacctggccaggttcccagcctcctcatctatggtatactccgaccgtagggccacgtggccacgtcccgagaccacggttcaggtggcaggtcgggtcgtgggacagtacttcacgtcacactancagcagacnggacnctagaagttntttgctagtatagttactgtacagngtagtagtgtagccgtcgacggtcgtacgaccgaacgggactaagggtacgaacgtaacgaacgagtcgtacgcgtcgaccacgtctctcgtactcgtctcccgtcctctatccg

SEQ ID NO: 245330 - DNA, 820 bp, Homo sapiens
  misc_feature: GYAE6OF02GKJWE.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccgaggggaaancgccaccctctcctgcagggccagtcaagaatcgttaaccaacgtaggttcgtacgccttggtaccagccaacgaaacctggaccaggttcccagccctcctcactctatggtatactccacgacgggccacgtcggccactaccccagaccgtaggttccgaggtggcgagggccggggttcgtacggggacgacggtacttaccgacttaccgtaccaaccgtaacttacccgacggtaccgaacgtaacccgggtacggggtaacggtcccgttaagggtaaacgtttacggttttttacgggacgtttaagggtttacggtttaacgtttaaccgttcgggttaccgtaaggtaccgtttaagggttacggttacgggtaacggttccggttaaccgggtaacccggggttaaccggtttacccggggtaaacccgggtaaacggggggtaaacccggttaaacgggggttaaaacgggaaaaccggttaaaccgaaaaccgggtaaccggttacgggttacgggtacgtaccggtaacctaacccggtaacgttccggttacgttacccgtttacgtaaccctttcccggtttaccccgtacccgtactttaacccgg

SEQ ID NO: 245331 - DNA, 641 bp, Homo sapiens
  misc_feature: GYAE6OF02FNEL7.5.59.F04.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
tcagatcagacacgcacgaccggtgctcgatttagtacacacacttagggattggggtgctcagttaggacccagagggaaccatggaaaccccagcgcagcttctcttcctactgctactctggctcccagatgccaccggaaagactgtgttgacgcagtctccaggcaccctgtctttgtctccgaggggaaanagcccaccctctcctgcaggccagtcagatgtaccanggtcagcctggtaccagcagaacctgccaggttcccagcctctcatctagtggtatactaccaccagggcccacgtggccacgtccccaagaccagggtttcagtcggcaggcggggttnggggacagtacttcacttccncacccatcagtcaaggtcgtacggacgcctaggtaacgtaagtttttggaccgttaaggttacgtttacgtttacgttcggttacttaaggtacttaaggtagttacgggttagtaccgtacggaccggttaccggttacggacccggtaacgggaccgtaaaggggtaaggaaacgtaacgaaacgtaacgttaggtacggcgtcggtaccaacctagttcctacgttaccttacaccgtttcctaccccggtactacttaccgg

SEQ ID NO: 245332 - DNA, 732 bp, Homo sapiens
  misc_feature: GYAE6OF02IXJRB.5.59.F04.1.454.CMB.1.raw
  modified_base (224)..(224): a, c, t, g, unknown or other
  misc_feature (224)..(224): n is a, c, g, or t
  modified_base (394)..(394): a, c, t, g, unknown or other
  misc_feature (394)..(394): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtcctccaggccaccctgttctttgtctccgagggaaagcgccaccctctcctgcgagggccngtacagaatcgttaaccaacgtaggttctagtaccgtacggtaccagacacgaaccgtaggtccacggttcccagccctaccgtcatctatcggtatactaccaccgacggcctacgcggactacgtacccgatacgtagttacgtagtcggcacggtcggtcgtcgganacgacttcacgtcacgactagtacgacgaccgagtaccgtaggtaccgacgttacgtaagttagtttacgtcgtaacgtttagttacgtttacgttcgttaccgtaagttaccgtaacgttaggtaacgttggtaccggtacgttaaacccgggttaccggttacccgggaacccggtaaaccgggggtaaccgtaaacggggttaaaccgggtaaactaaaaccgggttaaccgtaaaccggtcggtaacggtacggtaacgtaaccgtaaccgtacttcggttaagtttcccctaagttacccttacccgttaccccgttaccttacgttacccgg

SEQ ID NO: 245333 - DNA, 654 bp, Homo sapiens
  misc_feature: GYAE6OF02G9FJQ.5.59.F04.1.454.CMB.1.raw
  modified_base (197)..(197): a, c, t, g, unknown or other
  misc_feature (197)..(197): n is a, c, g, or t
  modified_base (489)..(489): a, c, t, g, unknown or other
  misc_feature (489)..(489): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaagngcccaccctctcctgcacgggccagtcagaatcgttaaccaacaggttcgtagccttggtaccagcaagaaaccgtggaccaggttccccagccctcctcatctatggtatactccaccgacggccacgtcggcactcccgagacgaggttcaggtcggcaggcggtcgtagggacacgtacttcactctacaccatcagcgacgtacgtcggacgtcgtaggaacgttgttttcgacgttaggttagttactttacgtagttacgtagtacgtacgttaaggttgggtacnccgttacggaaccgggttacggttaccgggaaccggtaacgggaaccggtaacgggttaacggaaacgtaaccgtaaacggtacgtaggtacggacgtacggacctaaccgtagttccgtacgtttcttaccgtacgttacccgtttaccccgactcgttaccgg

SEQ ID NO: 245334 - DNA, 709 bp, Homo sapiens
  misc_feature: GYAE6OF02HO2GP.5.59.F04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (329)..(329): a, c, t, g, unknown or other
  misc_feature (329)..(329): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaancgccaccctctcctgcagggccagtcagatgttaccaanaggttcgancctggtaccagcagaacctggccaggttccagcctcctcatctatggtatactccaccgagggccacgtcggcactcccagtacnggttcaggtcgcaggccggtcgtcggggactacggtacctttaccgaccttcgtaccaaccgtattaccgacgacctaaggtaaccgttgggacgtacccgtaggtaaacgtttacgttttcggacgttaaggttacgtttacgtttaccgttgtacctaagtcgtaagtttacggtagggttacgtaccgttacgtaaccgggttaccggttaccgggaaacccggaaacggggtaaccgtaaacggggttaacgtaaaacgtaaccggaaaacgttaacgtacgggttacggtaccgtcggacccgttaacctacgtttaccgttaggtttaccttaccgtaccgtttaccccgttccccgtaccttccgttaaccgg

SEQ ID NO: 245335 - DNA, 780 bp, Homo sapiens
  misc_feature: GYAE6OF02GXM6I.5.59.F04.1.454.CMB.1.raw
  modified_base (146)..(146): a, c, t, g, unknown or other
  misc_feature (146)..(146): n is a, c, g, or t
  modified_base (431)..(431): a, c, t, g, unknown or other
  misc_feature (431)..(431): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaanactgtgttgacgcagtctccaggcaccctgtctttgtctccgaaggggaagacgcccaccctctcctgcgacgggccagtcaagtaacttcgttaaccaacgtagggtttccgtaacgtcccgttagggtaacccaggtaccaaacggtaaacccgtcgggaccctacgggttacccccaacggtccccttcctacctacgttaccttaacgttggttaacctacctaccccgaaccggaccgggcccacgtacggaccacctcccgaagtaccgtacggttcgnggtacggacggtacgggtccggggtacggtaggggaacctacggttaccttacctaccgtacctacgaaccctataccgtcgaaccggacgtacggtacggacgtacccgtaggtaacgtttcgtttacgtacgtagttacgttattacgttacgtacgtacgtacgtaagttacgtaggtacctcggtacgtaccgggttaccggttaccggtaaccggtaaccgggtaaacggtaacgggttaaacgtaaaccgtaaaccgtaacgtaacggttacggtacggtccgtacgacccgtactacgttctacgttacttacgttaccttaccgtaccctcgttacttcgg

SEQ ID NO: 245336 - DNA, 698 bp, Homo sapiens
  misc_feature: GYAE6OF02HGT6K.5.59.F04.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (475)..(475): a, c, t, g, unknown or other
  misc_feature (475)..(475): n is a, c, g, or t
  modified_base (660)..(660): a, c, t, g, unknown or other
  misc_feature (660)..(660): n is a, c, g, or t
tcagatcagacacgcacgaccggtgctcgatttagtacacacacttagggattggggtgctcagttaggaccagagggaaccatcggaaacccagcgcagcttctctcctctgctactcgtggcctccagatcgccaacggtaaacgactggtgtacgacgtcacgtcctcacggcacctgtcttgctaccggagggaaatcnccacctctccgngcgacgggccagtcagtaatcgttaaccaaacgcgtttcgacgccgttacgtaccagcaaacgaacgtcggcgtacggttaccgacgtacctccgtactactacgttacgtacggttaactacgtacccgaccgtaccggacccgtacgttacggacctttaaccgacccgtacggtaaccgacgtttacgaacggttcggaccgtacgggtccggtacggtcggaactacggtacttacgcttacgacctacgtaaccngtaacgctaggacgtacgacgtacgtagtaagtacgttctacgtaagtcgttaactcgtcgtaacgtcagttatacggtcgttcgaccgtacggttacgacgttacggtaccgtaacggacgggtaacgtaagggaaacttaacggaagtactacgtacggttcgaacgaccttacaacggttanaccgttcgtacctacggttctacctaccgttacgtacg

SEQ ID NO: 245337 - DNA, 762 bp, Homo sapiens
  misc_feature: GYAE6OF02G855D.5.59.F04.1.454.CMB.1.raw
  modified_base (195)..(195): a, c, t, g, unknown or other
  misc_feature (195)..(195): n is a, c, g, or t
  modified_base (416)..(416): a, c, t, g, unknown or other
  misc_feature (416)..(416): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctccgaggggaaangccaccctctcctgcagggccagtcagatcgttaccaacaggttcgtagcctggtaaccagcaagaacctggccaggttcccagtcctctcatctagtggtaattactccctaaccgacgggtacctacgtcgggccaactcccccgaagtaaccgtagggtttccaggttcggcgacggtcgggtctaggggacaggtacttcgaacttctccgaacctntacacggtacaacggtaaccgttgggacgtaccgtaggaaacggtttagttttacgaccggtaggtttagttaaacgtttaccgttaggttaaccgtacggtacctaaagggttaacgttacggggttacgaccgttacccggaacgggttaacccgggtttaccggaaccgggtaaaccggggtaacccggtaaagggttaaacggtaaacgttaaacccggaaaacggttaaccgttagggtaccggtaccgtaccggtacctaaacccgtaacgtttaccggtcgtttacccgtttccgaaccggtttacccccgtttccccggaacctttacggtttacccg

SEQ ID NO: 245338 - DNA, 678 bp, Homo sapiens
  misc_feature: GYAE6OF02JV4RV.5.59.F04.1.454.CMB.1.raw
  modified_base (189)..(189): a, c, t, g, unknown or other
  misc_feature (189)..(189): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaagactgtgttgacgcagtctccaggcacctgtcttgctcgagggaangccacctntccgngcngggccagtcagatgtaccaataggttcngccgttgaccagtacagaacctggaccaggtcccagtcctccnagtnagtgtacnctccgacgcggcctagtcggactactcccgaagacgtacgtcgacggtcgacgacgggtccgtgtacggacgtaacgtactttacgacgttacctaccgtacgtacgttaccgaaacgtcggtaaacggacgttacggacgtaaccggtaacggtaaagtttaccggtttacgtaccggtaaaggtttcggttaaccttacggtcgttacgacgtcgtaacggttcgttaaggtccgtaacgttaccggaggttacccgtaacggtacccggtaagggaacccggttaagggtaacgaaagtacccgaaaggtacctggacgttcgacggtaacacggtacttagccgtttacgttaccacggttaccctacggtacccttagtaaccgg

SEQ ID NO: 245339 - DNA, 743 bp, Homo sapiens
  misc_feature: GYAE6OF02HJ2WG.5.59.F04.1.454.CMB.1.raw
  modified_base (207)..(207): a, c, t, g, unknown or other
  misc_feature (207)..(207): n is a, c, g, or t
  modified_base (548)..(548): a, c, t, g, unknown or other
  misc_feature (548)..(548): n is a, c, g, or t
  modified_base (678)..(678): a, c, t, g, unknown or other
  misc_feature (678)..(678): n is a, c, g, or t
  modified_base (735)..(735): a, c, t, g, unknown or other
  misc_feature (735)..(735): n is a, c, g, or t
tcagatcagacacgcacgaccggtgctcgatttagtacacacacttagggattggggtgctcagttaggacccagagggaaccatggaaacaccagcgcagcttctcttcctcctgctactctcggcctcccagatcgcccaaccggaaagactggtgttgacgcagtcctcgaggccaccgtgttcttcgtctccgaaaggggaancgccctaccctctcctcggcgacgggtccagtccaagaagttccgttaaacaacgtacgggttcgtaacgtccgtacggtaccgacgacgtaaccgaaaccgtcggtacccgtaacggtaccccacgtcccgtacctcgaacttccgtaggtaggttaactaccacccgaaccgcgggtacccagtcggtacctaccacccgaagttcgtaacggtttccgagggtacgaacggtcggtccgggttaggtaccgaactgttaaccctacgtacctccgtactaacctactagggacctacgacgtacggtacgtacgtccgtaaggttacttaggttacgngtaacggttacttaacgttacgtacgttacgaacgttcggtaacctagggtttaccggccttaacggaccgttaaccggtacgtccggtaacggtaaacgacgggttaacgaaagtaaccgaacgtaacnggtccgtagcctcggacacccgtaagtccgtacgttccgtataccgtcccgtaccgngttacccg

SEQ ID NO: 245340 - DNA, 662 bp, Homo sapiens
  misc_feature: GYAE6OF02G5EMC.5.59.F04.1.454.CMB.1.raw
  modified_base (144)..(144): a, c, t, g, unknown or other
  misc_feature (144)..(144): n is a, c, g, or t
  modified_base (189)..(189): a, c, t, g, unknown or other
  misc_feature (189)..(189): n is a, c, g, or t
  modified_base (229)..(229): a, c, t, g, unknown or other
  misc_feature (229)..(229): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccacggaanctgtgttgacgcagtctccaggcacctgtctttgctccagggaangccaccctctcctgcagggccagtcagaatcgttacacgnggttcgagcctggaccagcaagaacgtcgcacgttccagtcctctcactctagtgtactactaccgaccgtacggcctacgtcggactactcccgagaccgtaggttcaggtcggacgacggcgggttcgcggggaacaggtaccttcgactacgtaccaccgataccgacgcgacgtacgtacgggtacgtcctaggtaacgttagttttcgacgttagttacgttacgttacgttcgtacgtacgtacgtacgttagttcggttacgtaccgtacggtaccggttacggttaccgggtaccgaacgggtaaccgtaagggtaacggtaaacgtaaccgtaaacgtagttacggttaggaccgttacgaaccgtaccgtacttacgtacgttccgttacgttaccttaccgttacccgtcctaccttaccgg

SEQ ID NO: 245341 - DNA, 761 bp, Homo sapiens
  misc_feature: GYAE6OF02HN4PP.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgtctcgagggaaancgccaccctctccgtgcgacgggccagtcagtaatcgttaaccaacgtacggttcgagtccgtaggtaccagacgaacgaaacccgttcgggaccctacggttccccgacgtcccctccgtctacttacctagtcggttaactaccgtcccgaaccgacgggccctacgtcggacctacctcccgaagtaccgtaggtccgtaaggcggacgtacgggtccgggtacgtacggggaacctacggtacctttccgacgtcctaccgaccaacgtccgacgaccgtaagtacgtacggacgtaccgttaggtaacgttacgtttacgacgttaaggtacgttaacgttacgttacgtccgaacggttacgtaaggttaaggttacgggtacgtaccggttaacggaacccgggttaaccgggtacccggtaaccgggaaccgggtaaccggtaacgggtaaacggtaaacggttaaccgaaacgtacggtacgtacggtcctacggacctaccgtacgttaccgttcgtacttaccgttaccgttcccgttaccgtaccttacgtacgg

SEQ ID NO: 245342 - DNA, 707 bp, Homo sapiens
  misc_feature: GYAE6OF02GUB86.5.59.F04.1.454.CMB.1.raw
  modified_base (198)..(198): a, c, t, g, unknown or other
  misc_feature (198)..(198): n is a, c, g, or t
  modified_base (661)..(661): a, c, t, g, unknown or other
  misc_feature (661)..(661): n is a, c, g, or t
tcagatcagacacgcacgaccggtgctcgatttagtacacacacttagggattgggggtgctcagttaggacccagagggaaccatggaaaccccagcgcagcttctcttcctcctgctactctggctcccagatgccacccggaaagactgtgttgacgcagtctccaggcaccctgtctttgcctcgaaggggaancgcccaccctctcctgcgagggccagtcaagaatcgttaaccaactagggttccgagccgtaggtaccagaccaagaaaccgtggtacccgacgggttccccagtccctcctacactcgtagtggtatactcccaccgacgggccaacggtcggctaactccccgaagtaccgtacggttcaaggttggaccgaggccggggttacgtggggtaccaaggtaccgttcaacttccgtaccaaacctagtacccgaagtaccgacgtaacggtacggtacgtaccttaggtaacggtattttacggacgttaaggtacgttaactttaccggtgttaccgagtaccgtagttaggttcgggtacgtacgtacgtaccggtaacggttcccgggacgtaaacggggtaaccgtaaggggttaacgaaacgtaacgtaacggaacgttcggtagtcgtacgtaccncgtatcgttacgtaccttcgacgtttcccgccgtctacgttaccgg

SEQ ID NO: 245343 - DNA, 838 bp, Homo sapiens
  misc_feature: GYAE6OF02F3V2T.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccgaggccacccttgtctttgtctaccgaagggggaaacacgccaccctctcctgcgacgggccagtccagtaactcgttaaccaacgtaggttcgtacgccgttgggtaacccaggtccaaacggtaaaccgtcggacccgtacgggttccccaaggtccccttcctacgtacttcgtaagttacggtaacttactacccgacccggtacggggcccctaacgttcgggacctaaccgtcccgaacggacgtacggtttcaacgggttcggaccgtagggtcccggggttacggtacggggtaacctaaggtacccgtttacgaaccgtttccgtaacctaacgtacgttaccgaacggtaaccctagggtaaaccgtgggaccgttaccggtaagtaaacggttttactttcggacgttaacggttacgttaaacgtttccgtaggtccgtaaggtacttaaggttacgttacggtaccgtaccgtacggtaaccggggttaccgttaccgggaaccggtaaccggggtaaccgtaaagggttaaccggaaacttaaacggaaccgttaacgttcgggtaacggacgttaacgtaaccgtacccgtaagtttaccgttacggttaccctttacgtacccgtttcccgttaccccggtacttaccggttacgg

SEQ ID NO: 245344 - DNA, 586 bp, Homo sapiens
  misc_feature: GYAE6OF02I9CAS.5.59.F04.1.454.CMB.1.raw
  modified_base (107)..(107): a, c, t, g, unknown or other
  misc_feature (107)..(107): n is a, c, g, or t
  modified_base (196)..(196): a, c, t, g, unknown or other
  misc_feature (196)..(196): n is a, c, g, or t
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
  modified_base (528)..(528): a, c, t, g, unknown or other
  misc_feature (528)..(528): n is a, c, g, or t
tcagatcagacacgcacgaccggtgctcgatttagtacacacacttaggggattggggtgctcagttaggacccagagggaaccatggaaaccccagcgcagcttcncttcctcctgctactctggctcccagatgccaccggaaagactgtgttgacgcagtctccaggcaccctgtctttgctccgaggggaangcccacctctcctgcacgggccagtccagtaatcgttaaccaacgtacggttcgtagccctggtaccngcacgaacctggcccaggttccccagccctacgtcactctaanggtactatcccacgaggccaacgtcggctactcccagaactcggttcaggtgccaggccggtctgggacacggtcctcacctcgtaccaacgtntccgagtccaacgtcgnggacncgtagatntttgctagttnacttcgtagtcgatctaagtgtcgtagtccacgtacggcgttacgacaaccggtagaggtaacgtaacgtaacgaagacttacggngtacgtcgacactagtccgtacgttcttaccgtactttccctaccgtccacgttaccg

SEQ ID NO: 245345 - DNA, 633 bp, Homo sapiens
  misc_feature: GYAE6OF02GXZ47.5.59.F04.1.454.CMB.1.raw
  modified_base (196)..(196): a, c, t, g, unknown or other
  misc_feature (196)..(196): n is a, c, g, or t
  modified_base (311)..(311): a, c, t, g, unknown or other
  misc_feature (311)..(311): n is a, c, g, or t
  modified_base (434)..(434): a, c, t, g, unknown or other
  misc_feature (434)..(434): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagctgtgttgacgcagtctccaggcaccctgtctttgtctccgaggggaaangccaccctctcctgacacgggccagtcagaatgttaaccaacgtaggttcagcctaggtaccagcagaaacctggccaggttcccagcctcctcatctatgtatactccgaccgnggccagtcggcacgtccaagactaggttcagtcggactaggccggtactgggacagtaccttcgactcgacaccgatacgagcagtccgtagggacgtaccgtagtaacgtttagtttacggngtaacggttagttacttaacgtcgttacgtagtcgttagttacggttaggtacgtccgtacgtaaccgggtaccgttacggaaccgtaagggtaaccgtaagggtacggtaaaactaaccggaaacgtacggtggtacggtacgtcgtaccgacgtattcctagttccttacgtaccttacccgtccgtactaggtccg

SEQ ID NO: 245346 - DNA, 767 bp, Homo sapiens
  misc_feature: GYAE6OF02G3CMF.5.59.F04.1.454.CMB.1.raw
  modified_base (148)..(148): a, c, t, g, unknown or other
  misc_feature (148)..(148): n is a, c, g, or t
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
  modified_base (276)..(276): a, c, t, g, unknown or other
  misc_feature (276)..(276): n is a, c, g, or t
  modified_base (332)..(332): a, c, t, g, unknown or other
  misc_feature (332)..(332): n is a, c, g, or t
tcagatcagacacgcacgaccggtgctcgatttagtacacacacttagggattgggggtgctcagttaggacccagagggaaccatgggaaaccccagcgcagcttctcttcctcctgctactctggctcccagatgccaccggaaanactgtgttgacgcagtctccaggcaccctgtctttgctccaggggaaangccacctctcctgcaggccagtcagtatgtaccaagnggttcgagcctgaccngcaagaactggccaggtccagcctcncactctataggtactacacaccgagggcctacgtggcactcccgagtactggtacncggtgcgtaggtccgggtagtacgggactaacgtccgttacacttccgtaactaccgtatccccgaaaggtacccgaaccggtacggacgggtaaccgtacgttaaaggttaacggtttactttacggtacggttaagttaacgtttaacgttacgttcgtaaacggtcgtaacgttacgggttagttaccgggtactaccggtttaccgggtaacggggttacccggttaccgggtaaaccggggtaaaccgggttaacggggtaaaacggttaaaccggggtaaactttaaaaacccggaaccgggttaaacgttacggggtaccgttacggtaacccgggtaaccaaccggttttacggacccgttttacgttaccccggttacgttacccccgggttaccgtttaaccccgaccgttacgtttaacccggg

SEQ ID NO: 245347 - DNA, 825 bp, Homo sapiens
  misc_feature: GYAE6OF02HJX54.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccgaggcacctgtctttgtctcgagggaangccaccctctcctgcacgggccagtcaagtaatcgttaaccaagtacggttcgagtaccgttaggtaaccagaccgaacgtaaaccgtcggaccgtacggttacccaacggtcccttaccgtacctacgtacgttaagacggtttttttaacaacttacccgaaccggtacggggtaccctaaccgttcgggacctaaccgttacccgaaggtaaccgtacggtttacgacggttcggaccgtacgggtccgggttacgtacggggaacgtaacggtaccgttaccgtaaccgtaccttacccgaaactaacgttaccgaaacgtacccgtaaacgggtaccgtacgggtaaccgtacccgttaaggaaacgtttaggtttacggacggttaaagttacgttaaacgtttaccggttacgtactaacggtactaaacggtttacgtacgggtacgtaccgtaccggtaacggttacccgggttaccggaaccggtaaacgggaaccgttaaacggggaaacgtaaacggtaaaccgaaacggtaaccgtacgggtacgtacggtcgtaacgacctaacgttaccgttacgttaccttacgtacccttaccgtacccgtacgtagttaccgg

SEQ ID NO: 245348 - DNA, 764 bp, Homo sapiens
  misc_feature: GYAE6OF02JSRSC.5.59.F04.1.454.CMB.1.raw
  modified_base (196)..(196): a, c, t, g, unknown or other
  misc_feature (196)..(196): n is a, c, g, or t
  modified_base (248)..(248): a, c, t, g, unknown or other
  misc_feature (248)..(248): n is a, c, g, or t
  modified_base (392)..(392): a, c, t, g, unknown or other
  misc_feature (392)..(392): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgtgacgcagtctccaggcaccctgtctttgtctccgaggggaaanagccaccctctcctgcacggccagtcagtaatgttaccaactaggttcgtancctcgggtaacccagccaagaaaacctcggtaccaacgggttcccaagtccctacctcatcctagtaggtactaagtcccaccgacgggacctacgtacggccactacccagaccgacggttcgagtcggacacgggccgggtntacggggacctaaggtaccttaccgacttctccgaacctacttacccggaagtaccctaaacggtaaccggttacgggaccggtaacccctttagggaaaccgtttacgttttacgggaccgttaaggttacggtttaaacgtttacgttacggttcgtaacgtagtacggttaagtcgtaacgtccgttaacggtaccggtaaccgggttccggtaaaccgtaaaccgggacgttaaacgggtaacgggaaaaccgtaacgtaaaacgggtaaaccgtgggtaacgaccggttagtaacccgtaacgtaccgttacgttacgttccgttacttaacccgttaccgtttaccccaccggtttacttaaccgg

SEQ ID NO: 245349 - DNA, 931 bp, Homo sapiens
  misc_feature: GYAE6OF02HTLKN.5.59.F04.1.454.CMB.1.raw
  modified_base (148)..(148): a, c, t, g, unknown or other
  misc_feature (148)..(148): n is a, c, g, or t
  modified_base (202)..(202): a, c, t, g, unknown or other
  misc_feature (202)..(202): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaaccggaaanactgttgtgacgcagtctccaggccaccctgttctttgctaccgaaggggaaancgacccaccctcgtccctgaccgacgggacctaggtacaaagtaacgttacgttaaccaaagtacgggtttaccgtaacgtccgtacggtaacccacggactaaacggtaaaaccgtcggaccgtaacggttccccaacgtaccccttcctaacgtaacgttaccttaagttacggttaaacttaacgtaccccgtaaacccggtacggggtaccccaacggtaccggtacctaaaccgtacccccgaaaggtaccgttaagggtttaccaacgggtcggaacgcgggtcgggtacgtcggggaaactacggtaccttcgtaactaccgtacaaccagttaccgaagccgtaacggtactacggaacgttccgttaagtaaacgttagttttaccggaacgttagtttaacgtaaacttacgttacggtacaaacggtaacgttaaacgttacggttaacgggtacgtaccgttaaaccggggtacccgtttaaacccggggttccgggaaacccggttaaaaggggtaaccccggttaaaaggggttaaaaaccgggtaaaacttaaaacccgggaaaaacccggttaacgtttaccggggtaccggtaaacgttaacccggttaacccgaaaccgtttaaaccgttccggtttaacccgtttaaccctttaccggtaaaccccttttaccccggggttacccccgtaagttaacccgtttaaccggg

SEQ ID NO: 245350 - DNA, 753 bp, Homo sapiens
  misc_feature: GYAE6OF02IODX8.5.59.F04.1.454.CMB.1.raw
  modified_base (181)..(181): a, c, t, g, unknown or other
  misc_feature (181)..(181): n is a, c, g, or t
  modified_base (210)..(210): a, c, t, g, unknown or other
  misc_feature (210)..(210): n is a, c, g, or t
  modified_base (242)..(242): a, c, t, g, unknown or other
  misc_feature (242)..(242): n is a, c, g, or t
tcagatcagacacgcacgaccggtgctcgatttagtacacacacttagggattggggtgctcagttaggacccagagggaaccatggaaaccccagcgcagcttactcttcctcctagccttactctggtcctcccagatcgaccaaccggaagtactggtcgttcgaacgtcgacgttcnccgaggtccacccgttggttctttgtccnccggaaaggggaatcgccctacccttctccgnggacgaggtccaaggtcaagtactcgtaaccaacgtggttacacggtccttaggaactacggactaagtaacctggaccgtaccgttccgacgtcctcctacacttctagtacggtaataccgtaccgaacgacggtcctaggcgtccaaccgttccgaaggtaccgtacggttcgacgttacggacaggtccggcgttacgggaaactcggaaaccttgtactacgtaccgacttacgccgtaacggtccaagtacgcggaacgtactaacggtattaccgtgacttacggttagttacgtagttacgtacgaacgtttagtacggtacgttaagaccgttcggaacgtaccgtaacggtccgtaacgaaccggtaggtaaacgggtacgtaaacgtaaccgtaaacgtacggtacggttacgtcgtaaacggtccgaaaccgttacgttacccggttaactcgtttaaccgggtcgtttacccctacggttacccgtaccgttaaccgg

SEQ ID NO: 245351 - DNA, 796 bp, Homo sapiens
  misc_feature: GYAE6OF02IFNLB.5.59.F04.1.454.CMB.1.raw
  modified_base (198)..(198): a, c, t, g, unknown or other
  misc_feature (198)..(198): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgaccaaccggaaagactgtgttgacgcagtctccaggccacctgtctttgtctccgagggaancgccaccctctcctgcgagggccagtcagtaattcgtaaccaaacgtaggtttcgacgccgtcggtaaccagaccgaagaaaccgtcggaccgtaacggtttaccccaacggtccctacctctaacttccgttaatcgggtaacttaacgtaccccgaaaccgaacggggtaccctaacgtcgggacctaaccgtccccgaaaggtaaccgtagggttacctaagggtggacgacgggtaccggggttccgtaggggacgtacggttaaccttccgaacttcctaaccgaccgtaatccgaacggaccgtaacggtacggtacggaacggtacgttaacggtaaacgtttacgttttacgacgttaaggtttagttaaccgtttacgttacggttaaccaggtaccttaaggttacgtacgggttacgaccgttacggaaccgggttaccgggttaccggaaaccggtaagggaaccgtaaaggggttaacgaaaactaccgaaaacgtacgttcggtaacggtcctaacggtacccaacgtacttccggttagtttaccgttacttaccgttcccgtaccccgtaacttcgtaccgg

SEQ ID NO: 245352 - DNA, 668 bp, Homo sapiens
  misc_feature: GYAE6OF02FHXWL.5.59.F04.1.454.CMB.1.raw
  modified_base (196)..(196): a, c, t, g, unknown or other
  misc_feature (196)..(196): n is a, c, g, or t
  modified_base (357)..(357): a, c, t, g, unknown or other
  misc_feature (357)..(357): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangcccaccctctctgcagggccagtcagatcgttaccaacgaggttcgtagcctggtaccagcagaaacctggcctaggttcccagccctcctcatctatggtatactccaccgaggccacgtggccatcccaagacaggttcagtgcagcggtctgggacngtacttcactctcaccatcgacgcagtacgtggacgtccgtagtaagttgttttcggacgtagttacgttaactttacgtagtttccgaagacgtaaggttagtacggggttactaccgtttacgggtaaccgggtaaccgggtttacccgggaacccggtaaaacggggtaaccgtaaacggggttaacgggtaaaacgttaccgaaaaaccgtacggttacggtacgggtaccgtacgacccggaaccttacgttaccgtaggttacctttacgaccgtttacccgttccccgtacctacgttacccgg

SEQ ID NO: 245353 - DNA, 702 bp, Homo sapiens
  misc_feature: GYAE6OF02JXSLX.5.59.F04.1.454.CMB.1.raw
  modified_base (105)..(105): a, c, t, g, unknown or other
  misc_feature (105)..(105): n is a, c, g, or t
  modified_base (110)..(110): a, c, t, g, unknown or other
  misc_feature (110)..(110): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (409)..(409): a, c, t, g, unknown or other
  misc_feature (409)..(409): n is a, c, g, or t
tcagatcagacacgcacgaccggtgctcgatttagtacacacacttagggattgggtgctcagttaggacccagagggaaccatggaaaccccagcgcagcttcncttcncctgctactctggacctcccagatcgccaccggaaagcctgtgttacggacgcagtctccgaggccacctgttcttgtccacgagggaacngccacctctcngcaggcctatcagntacgtaaccagacggttcancgtcggtaacagcctaagaaccgtggacctacggttcccagccgttccactagtcctagtacgtaactcgtacccacgacggtcctaagtcggcctaacgtacccgagaaccgttgggttacccagttaccggggactacggggtcccggttgacgggtaacnggttaaccttccgaacgttctacaaccgtacgtactacggactaacggtccgtaaggtcgaaccgttaggaaacgttcgttagtccgtaagtttacggtaactttaccggttatacgaaaccgttctaaaagggtcgttcgtttaacgggaccttacggttacgggtaccgtacggtaacgggaacgttacgggaacgttacgtaacttaaacgaacgttacggcgtaagtccgtagaacgttaccaggttactcggttactaccggttattacccgtccgtacttagtcccg

SEQ ID NO: 245354 - DNA, 725 bp, Homo sapiens
  misc_feature: GYAE6OF02H2CM3.5.59.F04.1.454.CMB.1.raw
  modified_base (216)..(216): a, c, t, g, unknown or other
  misc_feature (216)..(216): n is a, c, g, or t
  modified_base (261)..(261): a, c, t, g, unknown or other
  misc_feature (261)..(261): n is a, c, g, or t
  modified_base (658)..(658): a, c, t, g, unknown or other
  misc_feature (658)..(658): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaagactgtgttgacgccagtctccaggccaccctgtctttgtctccgaagggaagacgccaccctctcctgcgngggccagtcagatgttaccaactggttcgacgcctagtacagtanaacgaaccgtggacctacggttcccacgtaccctacctacgacttacctagtacggttactacgtacccaacggtacgggaccctacgtacggtacctacgtaccccaaggtaccgtacggttccgaagggtccggacggaacgggtcgggaccgttacgggaactacggtacttacccgacgttaccgaaccaccgttaagtaccacggacgttaaccgacggttaccgggacgtaccgtacggttaaaacggttgtttacggacgtaacggtacgtttacgttaacgttcgaacgttacgtacgtagttacggtcgtacgtaccgtcggtaacgtaccgggttacgaccggaacgggtaacggaaacgtacggtaacgtaacgaaccgttaacgngtacggagtacgtacgactacttcgtacgtcttacgttacctacccgtttcccgacgtattacccgg

SEQ ID NO: 245355 - DNA, 553 bp, Homo sapiens
  misc_feature: GYAE6OF02G6L50.5.59.F04.1.454.CMB.1.raw
  modified_base (196)..(196): a, c, t, g, unknown or other
  misc_feature (196)..(196): n is a, c, g, or t
  modified_base (328)..(328): a, c, t, g, unknown or other
  misc_feature (328)..(328): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgtctccaggggaaangccaccctctcctgcagggccagtcagaatgtaccaacaggttcgagcctggtaccagcagaacctggccaggttcccagcctcctcatctatggtaatactcccaccagggccacgtggccatcccagacnggttcaggtggcaggcgggtctgggacngacttcactcncacatcagcagcgtggacgctagaagtatttgctagtntattactgtcagctagtagtggtacncgtcgacggtacgttcgggaccgaagggaaccgaagggtaaggaaataacgaaacgacgtgtacggcgtggacctaccgatccgtgttcgttactacttccgttcccgtacctacgttaccg

SEQ ID NO: 245356 - DNA, 679 bp, Homo sapiens
  misc_feature: GYAE6OF02H4VVT.5.59.F04.1.454.CMB.1.raw
  modified_base (147)..(147): a, c, t, g, unknown or other
  misc_feature (147)..(147): n is a, c, g, or t
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (488)..(488): a, c, t, g, unknown or other
  misc_feature (488)..(488): n is a, c, g, or t
tcagatcagacacgcacgaccggtgctcgatttagtacacacacttagggattggggtgctcagttaggacccagagggaaccatgggaaaccccagcgcagcttctcttcctcctgctactctggctcccagatgccaccggaaanactgtcgttgacgcagtctccaggcaccctgtcttgtctcaggggaancgccaccctctcctgcagggccagtcagatgtaccacnggttcgancctggtaccaggcaaggtaacctggaccaggttcccaggtcccctctcctatcgtaagttcggtatacgtacccaccgacgggtccaaccgtcggcctactaccccgaggtacctagggttccaggttcggaccaacgggtcgggttacgtccggggaagacgtacctttcctaccgtcgtaccaacctcgtacgaacggcaacgggtactcgggtaacgtccgtagtaaaccgttgtttttaccgngttacggtagttacgttacgtacgttccgtaggtaccgagttacgtagggtctacgtacgaccggtacgttccggaccggaaaccggtacggaacgtaaggtaaacgtaacgtaaacggtaacctggttggaccgtacgaccgtaacctgttacgtccgttactcgtaccgtccgttccacgtcttaccgg

SEQ ID NO: 245357 - DNA, 751 bp, Homo sapiens
  misc_feature: GYAE6OF02GWV40.5.59.F04.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (255)..(255): a, c, t, g, unknown or other
  misc_feature (255)..(255): n is a, c, g, or t
tcagatcagacacgcacgaccggtgctcgatttagtacacacacttagggattgggtgctcagttaggacccagagggaaccatggaaaccccagcgcagcttctcttcctcctgctactctggctcccagatgccaccggaagactgtgttgacgcagtcctcgaggcaccctgtctttgctccgagggaancgccacctntccngcgaggccagtcagtatgttaccaagtaggttcgagccgtaggtaaccngccaagtaaaccgtggaccctaggttcccaggtcctcctacactctacgtggtaactaccgtaccaccgacgggcctacgtggcactccgagactacggtactagggtcgaacgtacgggtccggtacgtcgggtaacgacggttaccttaccgaccttcgtaccgaacctcttaccggaacgtaccgaagttaccgtacggtacgtaccgtaggtaacgttacgttttacggacgtaggttacgttaacgtttacgtcggtaactacgtacggttaggtaacgttacggttacgaccgttaccggtaacgggttacccgttaccggaccggtaaccggggtaaccgttaaacgggtaacgggtaaacgtttaaccggaaacgtaaccgggttacgtacggttaaccgtaacggtaaccctaacggttaccgttaccgttaccggttacgttacccggtaactttcccccggttacgtacccgttagttaacccgg

SEQ ID NO: 245358 - DNA, 786 bp, Homo sapiens
  misc_feature: GYAE6OF02IXGYG.5.59.F04.1.454.CMB.1.raw
  modified_base (202)..(202): a, c, t, g, unknown or other
  misc_feature (202)..(202): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagctggtgttgacgcagtctccaggccacctgttcctttgcctccgaagggggaaancgccctaccctccgtccccggacgacgggaccacgtcaaggtaaacttcgttaacccaagtacgggtttccgtaacggccgttagggtaacccaggacctaacggtaaaccgtcgggacccgtacggttcccccagtccccttaccctacacgttcgtacgttgggttaacttaccttacccgaccgacgggcctaacggtggacctacgtccccaagacgtacggttcaggttcggacgacgggtccggtcgttacgggactaacggttccttaccacgtttccaccgtaacctagtaccgacggtctaaacggtcgtttaacgggaccgttacccgttaaggtaaacgtttaccgttttggacccggttaagttacgggttttaacgttaccgttacggtaccgtaacggttgtttaaacgtgttcggtaacgtccgtaacgtccggtacgtcggaacgtaacgggacgtaaggtaagtaaaccgacgtaaacgtacgtagggtacgtacgccggtaaccgtactacgtccttacggttacttcgaaccgttttcccgacccggtacttacgtccgttacgg

SEQ ID NO: 245359 - DNA, 768 bp, Homo sapiens
  misc_feature: GYAE6OF02I3FO2.5.59.F04.1.454.CMB.1.raw
  modified_base (233)..(233): a, c, t, g, unknown or other
  misc_feature (233)..(233): n is a, c, g, or t
  modified_base (372)..(372): a, c, t, g, unknown or other
  misc_feature (372)..(372): n is a, c, g, or t
  modified_base (607)..(607): a, c, t, g, unknown or other
  misc_feature (607)..(607): n is a, c, g, or t
tcagatcagacacgcacgaccggtgctcgatttagtacacacactttaggggattggggtgctcagtttaggacccagagggaaccatggaaaccccagcgcagcttctcttcctcctgcctactctggcctcccagatgccgaccggaaagtcctgtgtttggacgcacgtcctcgacggcctaccgtgttctttgtcttaccgaaggggaaacagcccacccgttctaccnggcgtacggaccagtacgagtaacttcggttacaaccggttaggttaccgtcgtacccgttcggtaccgaggacctaacgtaaaccgttcgggacctacggttcccacgtcctcgcctagtaccttagtagtattaccnccgtaaccgagggtcccagtacggcctccgtaaccgacgtacgttggttaccaggtccggactacgggtcggtcgtaaggtacgtaaccgtcctttacgaaccttcggaccttaccgactcggaactccgagggtttacccacggacgtacccttaggtaaaccgtttgttccgtaaggttacgttacgttaacgtttcgtagttcgtaataccggttacgttaggtgttaccgnggttaaccgtacgggtaccgttaccggaccgggtaacggtaccgggtaacggtaacggtacttaaccggggaactttaacggtccgtgggacgttcgaccgtagtacccgtttaccggttacgttccgttactaccgttccccgtacggttcctacggtcg

SEQ ID NO: 245360 - DNA, 778 bp, Homo sapiens
  misc_feature: GYAE6OF02GT21W.5.59.F04.1.454.CMB.1.raw
  modified_base (157)..(157): a, c, t, g, unknown or other
  misc_feature (157)..(157): n is a, c, g, or t
  modified_base (188)..(188): a, c, t, g, unknown or other
  misc_feature (188)..(188): n is a, c, g, or t
  modified_base (544)..(544): a, c, t, g, unknown or other
  misc_feature (544)..(544): n is a, c, g, or t
tcagatcagacacgcacgaccggtgctcgatttagtacacacacttagggattggggtgctcagtttaggacccagagggaaccatggaaaccccagcgcagcttctcttcctcctgctactctggctccagatgccacggaaagactgtgtgacgnagtctcagcacctgtcttgctacgagggaangccacctctcctgcagggccagtcagtaacttcgttaccaacgtaggttcgtagcctaggtaccagtcaacgaaaccgtggcctacggttcccagtccttcctcgtattcgttatcggttaatacgtacctaaccggacgggtacctagtccggacctaccgtaccgaaggtaccgttaacgggttacgtacgggttcggacgtaacgggcccggggttacgtcggggaactacggttacctcgaccgtcttaccgaactacttaccggaacggtaccgtacggtaacgtcgggtaaccgtacgttaggaaagttttacgtttcggacgtttaggttacggttaactttaccgggngtacgtacggaacggttcggtttaagtcgtacgttaccgtacggaccgggtttaccgggtaccgtaaccggggtaaaccggtacgggtaaagggtaacggtaaaacccgacgttaaaccgggacgtttaggtaccggtgttaaccgaccgttaaccgttacggttaacccgtttcggttacggttccttaacccggtttaaccctacccggttaccttacccggtttaacccgg

SEQ ID NO: 245361 - DNA, 598 bp, Homo sapiens
  misc_feature: GYAE6OF02FPG8M.5.59.F04.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (396)..(396): a, c, t, g, unknown or other
  misc_feature (396)..(396): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacccttgtctttgctccgaggggaaacngcccaccctctcctgcagggccagtcagatgttaccagngtcgagcctggaccngcagaacctggccaggttcccagcctccgtcatctatggtatcgtaccaccgaggccacttggccagttcccgagactaggttcagtggcaggtcgggtctggggacagcttccatctacgaccatcagcagacgtggacgcgngtaagtgttttgcgtagtgttattactgttacgtagtcgtagttatggttacgtcgtacacggtacgtcggccgaagggacccgtaagggttacggaaacgttacgaacgtaaccgtagtaggtaccgtacggtaccaaccgtacgttaccgttcggtacctttccgtaaccttcccgtttaccccgtcctacgtttacccg

SEQ ID NO: 245362 - DNA, 654 bp, Homo sapiens
  misc_feature: GYAE6OF02JRU2E.5.59.F04.1.454.CMB.1.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (451)..(451): a, c, t, g, unknown or other
  misc_feature (451)..(451): n is a, c, g, or t
  modified_base (568)..(568): a, c, t, g, unknown or other
  misc_feature (568)..(568): n is a, c, g, or t
tcagatcagacacgcacgaccggtgctcgatttagtacacacacttagggattggggtgctcagttaggacccagagggaaccatggaaaccccagcgcagcttctcttcctcctgcctctctggcctcccagatcgcccaccggtaaagctgtgttcgaccgcagtcctccgaggccacccttgtcttgctccgagggaaancgtccncctctcgngcacggccngtacagtatcgtacaacnggttcngcctggaccngcaacggtaaccnggtccacggttacccagtcctctacactactcgtagtacttacacccgaccgacggtcctaacgtcggctaccgtaccgagttaaccgtaggttcaccggtggaccgtacgcgggttccgagggacctagtccttaccgactccggtacacctacgtacggaaccgcgtacggttacncgggtactccgtaagtaacggttcttacgcgtagtacgttataaccgtgaccgtagacttagtagtggactcctcgggtaccacgggtacgtaccgaacggaccgtagtacggtaanaccgtaacgacgttcgacggcttaaccggactacggtaactccgtagttaaccgtttcgacccgttaccgtccgtacctattccgg

SEQ ID NO: 245363 - DNA, 734 bp, Homo sapiens
  misc_feature: GYAE6OF02JAFDY.5.59.F04.1.454.CMB.1.raw
  modified_base (195)..(195): a, c, t, g, unknown or other
  misc_feature (195)..(195): n is a, c, g, or t
  modified_base (444)..(444): a, c, t, g, unknown or other
  misc_feature (444)..(444): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctcaggcaccctgtctttgctccgaaggggaangccacctctcctgcgaggccagtcagtaatcgttaccaatggtcacgcctaggtaccagcaacgtaaacctggacctacggttcccaggtccctctcatctagtcgtatactacccgaccgagggtccaacgtcgggacctacgtccccgaaggtaccgtacgggttactagggttacggaccgacgggtcggggtaccgtacgggggtaactacgttaaccttccgtaaccgtcctacgaaacccgtntaaccggaacgtacccgtaagggtacgtacgggtaccgtccgtaaggtaacgttagtttcgacgttaggttacgttacgttacgtggtacgtaacggtactaaggttacgtaggttacgaccgttacggaaccgggttaccgtttaccgggaaccgtaaacggggtaccgtaaagggttaaccggtaaacggtaccgtaaaacgtagtacgggttaccgacggttcgaaccgtacgtacgtacgttacgttccggttacttaccgtcccgttaaccggtccaagttccgg

SEQ ID NO: 245364 - DNA, 814 bp, Homo sapiens
  misc_feature: GYAE6OF02HLQ2V.5.59.F04.1.454.CMB.1.raw
  modified_base (216)..(216): a, c, t, g, unknown or other
  misc_feature (216)..(216): n is a, c, g, or t
  modified_base (537)..(537): a, c, t, g, unknown or other
  misc_feature (537)..(537): n is a, c, g, or t
tcagatcagacacgcacgaccggtgctcgatttagtacacacacttagggattggggtgctcagttaggacccagagggaaccatggaaaccccagcgcagcttctcttccgtcctgctactcgtggcctcccagatcgccgaaccggaaagacgtggtgttacgacgctagtcctccgaggcctaccctgttctttgtccgtccggaagggaaancgccacccttctctgcgacggccagtacagtaagttcgtaaccaacgtaggttcacgccgtggaccagaccaaagaaccgtcgaccgacggttaccagtccctcacattcgagttagtaactacctacccgaccgagggtccctaacgtcgaccgtaacctacccgaacggtacgttacggttaccgtaaggtccggacgtcggtacgggtccgtacggaaacgtctaacgtccctaacgtccgtaaccgtacctaagtccgtaaggacctaaacgggtacggttacgggaaccgtccgttaaacggtaaacgggtttttntacgggtaaccttagggttacggtttaacgttagtccggtaacgacggttaacgttagtacggttataccggtaccggtaccgtaaccgggtcgtaccgtaacccgggggaactaaccccgggttaaaggtaccggtaaaacggtaaccttaaaaccggtaccggtacgggttaccggtttaccgaacgtacccgtaaccggttacggttacggtttaaccgtttcccggaccgtttacccggtttaaccgccccggttaaccgtacttacccgggg

SEQ ID NO: 245365 - DNA, 243 bp, Homo sapiens
  misc_feature: GYAE6OF02IU7RK.5.59.F04.1.454.CMB.1.raw
  modified_base (203)..(209): a, c, t, g, unknown or other
  misc_feature (203)..(209): n is a, c, g, or t
  modified_base (211)..(243): a, c, t, g, unknown or other
  misc_feature (211)..(243): n is a, c, g, or t
tcagatcagacacgcacgaccggtgctcgatttagtacacacacttagggagttgggcacggtgggcatgtgtgagttttgtcacaagtatttgggctcaactttcttgtccaccttggtcgttgctgggcacagcggcctgggctgcctggtcaaggactacttcccgtgtctgatctgagcgggtctggcaggcgcatagnnnnnnngnnnnnnnnnnnnnnnnnnnnnnnnnnnnnnnnn

SEQ ID NO: 245366 - DNA, 753 bp, Homo sapiens
  misc_feature: GYAE6OF02HLV22.5.59.F04.1.454.CMB.1.raw
  modified_base (191)..(191): a, c, t, g, unknown or other
  misc_feature (191)..(191): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccacggaaagactgtgttgacgcagtctcaggcacctgtcttgctcgagggaagngccacctctcctgcgacggccagtcaagaattcgttaaccaacgtagggttacgtacgtccgttacggtaaccaggaccaacgtaaacctcgggaccgtacggttccccacgtccctcctctactcgtagtacggtactaccgtcccgaaccggtacgggtaccctacgtcgggacctacctccccgaagaccgtacggttcacggtacgcgaagggtcggtacggtagggactacgtacttacgactactacacctacgtacacgacgtagtaccggacggtaccgtaccgttaaggtaacgtttacgtttacgagtaggtttagttacgttacgttacgtaccgtagtacgttaagttaggttacgggtactccgtacggtaccggttaaccggttaccgggaaccggtaaaccgggtaacgtaacggggttaacggtaaaccgtaaaccggtaaacggtacggttacggtacgggtaccgtacggaaccttaactaacggttcgttacgttaccggttaccttacccgttacccttacccggtccttaaggttacccgg

SEQ ID NO: 245367 - DNA, 678 bp, Homo sapiens
  misc_feature: GYAE6OF02F0MH5.5.59.F04.1.454.CMB.1.raw
  modified_base (413)..(413): a, c, t, g, unknown or other
  misc_feature (413)..(413): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaagactgtgttgacgcagtctcaggccaccctgtctttgtctccgaggggaaagagccaccctctcctgcacgggccagtcaagatcgttaccaacaggttcgtagcctaggtaccagcagaacctggaccaggttcccagtcctcctcatctagtggtatacaccaccgtacgggccacgtcggcactcccagtacgaggttacaggtcggcgacgggtccgggtgtacggggtaccaggtacctttaccaccgttacctacgaacccgtntacgaagctacgtacgtggacgaccgtagtaacgttagttttacgacgtaggtttagttaacgtttacgtagttaccgagtaccgtagttacgtaggttacctcgttaccggacggttaaccggttaccgggaacccgtaaggggtaacccgtaggggttaaccgaaacgtaacgtaaaccggtacggtacggtacgtacgtcggaccgtaacgtcgttactccggtttactaccgtacttcccgtaccctacgtacgttaccgg

SEQ ID NO: 245368 - DNA, 795 bp, Homo sapiens
  misc_feature: GYAE6OF02IGSW4.5.59.F04.1.454.CMB.1.raw
  modified_base (198)..(198): a, c, t, g, unknown or other
  misc_feature (198)..(198): n is a, c, g, or t
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
tcagatcagacacgcacgaccggtgctcgatttagtacacacacttagggattggggtgctcagttaggacccagagggaaccatggaaaccccagcgcagcttctcttcctcctgctactctgctcccagatgccaccggaaagactgtgttgacgcagtctccaggccaccctgtctttgtctccgaaggggaaangccaccctctccgtgcgagggccagtcagattgttaccaatggttcgtagcctaggtaccagacaagaaccgtggaccacggttcccagtccttccnctatcctagtggtaatacncccgaaccgagggccctacgtcggcctaacgtccccgaagtaccgtacggttacacgggttcggcgtaacgggccggggttacgtacggggaaccgtacggtacctttccgaacgttccgtaccgaccgtaagtccgaacggccgtaaggtacccgtagggaccgtccgtaaggtaacgtttacgttttacggccgttaaagggttcggtttaaactttccggttggttaaccgtaacggtacgttaagggtttacgttacggggtaactaccgggttaaccggtaaccggggttaacccgggtttaccgggaaacccggtaaaggggttaacccgtaaaggggttaaacggtaaaacttaaccggtaaaacggtaccggttgggtacggtaccgtcggaacccgttaaccgttacgttaccggttacgtttaccgttaccgtaaccgtttcccccggttaccctccggttaacttccggg

SEQ ID NO: 245369 - DNA, 718 bp, Homo sapiens
  misc_feature: GYAE6OF02IC2K5.5.59.F04.1.454.CMB.1.raw
  modified_base (198)..(198): a, c, t, g, unknown or other
  misc_feature (198)..(198): n is a, c, g, or t
  modified_base (382)..(382): a, c, t, g, unknown or other
  misc_feature (382)..(382): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggccacctgtctttgtctccgaaggggaaancgccaccctctcctgcagggccagtcagtatcgttaccaagtaggttcgagccgtagtacagtacaacgaacctcggacctacggttcccacggtccctcctactatcctagttggtaactacgtaccccacgtacgggcccagtcggacctacgtacccagtacgtaggttccaggtcggacncgggtcggttcgacgggacacggtacttaccacggttcctaacgacctagttaccacggccgaagtccgtaggacggtacccgttaggaaaccgttttagtttcggaacgttaggttaacgttacgttttaccggtcgtttaacggacgttacgttaagggttcgttacgggtagtacccgtaggacccgggtttaccgtacgggtacccggaaacggggtaccgttaaagggtaaccgaaaggttaaccaaaccggttagtcgggttacgcgtaacgacccttacgattcccgtggttaccttacgtccgtttccccgtacctctaccgttacgg

SEQ ID NO: 245370 - DNA, 759 bp, Homo sapiens
  misc_feature: GYAE6OF02HM1FN.5.59.F04.1.454.CMB.1.raw
  modified_base (197)..(197): a, c, t, g, unknown or other
  misc_feature (197)..(197): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactggtgttgacgcagtctcaggcaccctgtctttgtctccgaggggaaanagccacctctcctgcagggccagtcagaatcgttaccaacgtaggttcgacgcctggtaccagtaccgaacgaaacctggaccctacgggtttccccaagtcccctaccttcgaattcgtaacgtggtaacttactaccccgaaccgtacgggaccctaaccggtggcctacgttaccccgaagtaccgtacggttcaacggtcggacacgggtccgggtactaggggaacttaggacccttacgaccttaccgtactaaacccgtagtacccgagtacccgaagggttaccggtacgggaacggtcccttagggtaaacttacggtttttaacgccgttaaggtttacgtttaacttaaccgttcggtaacgttacgacgttaagggttaccgttagggtaacgccttacggtaaaccgggttcggtacccgggtaacgtaaccgggtaacgaacgggtttaacggaaactaacggtaaaaccgtagtacggttcggaccgtcgaacgtacgtacgttcgtagttccttaacgtccttacccggaccttacgtattaccgg

SEQ ID NO: 245371 - DNA, 686 bp, Homo sapiens
  misc_feature: GYAE6OF02HMWQH.5.59.F04.1.454.CMB.1.raw
  modified_base (435)..(435): a, c, t, g, unknown or other
  misc_feature (435)..(435): n is a, c, g, or t
tcagatcagacacgcacgaccggtgctcgatttagtacacacacttagggattggggtgctcagttaggacccagagggaaccatggaaaccccagcgcagcttctcttcctcctgctactctggctccagatgccaccggaaagactgtgttgacgcagtctccgaggccacccttgtctttgtctaccgaagggggaaacagccaccctctcctgcagggccagtcagaatcgtaccaaacgaggttccgagcctggtaccagcaagaaacctcggacctaggttcccagcctcctcatctatgtatacaccaccgcggacctacgtggcactccgagtactaggttcaggtcggagacggtcggggtctggggactacgacttcactcactaccatcagtgacgtacgtgacgtctagaaagtttcgtttanacgttaagttgttaattacgttacgtacagtacgaagtttaagtcggtaaacgccgttacgaaccgggtttaccgtacccgggaacgaacgggtaaccgtaagggtaaacgggtaaacctaaacgggtaaaaccgtacggttacgggttaggtacccgttaacgacccgttaaccgtaacgttacccgttaacgtttaccgtttaccgttaaccgttacccccgtttcccggtacccttacggttaaccgg

SEQ ID NO: 245372 - DNA, 748 bp, Homo sapiens
  misc_feature: GYAE6OF02G1Q9W.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggcctcccagatcgccaaccggaaagactggtgttgacgctagtctccgaggccacccttgttctttgtccttaccgaaggggaaacgacgcccgtaccctcctcctcgcgacgggaccagtcgaagtaaacgttcgtaaaccaacgtaggttacgtacgtaccgtacgtacacgacaacgtaaccgtcggtaccgtacggttacccgacgtaccctcctactacgtacttacgtactaactactaacccgtaccgacgtacctacgtcggacctaccgaccgaagtacgtccgttacggagtccggtagacgggtcggtacggtacggaacgtacgtactacctactactacccgtatacgtcgacgtacgaccgtcgacggtacgtactaggtacgttagtaccgtgttaaggtctttaactacgtacgtacgacgttacgttagtaacggttgtaacctagttaccggtaccggtaacccggttaccggaaggaaaccgggtaacgtaaacgggttaacgaaaccgttaacggtaaacgcgggttagtacccggagtaacgaaccgttacgaaccgttcttacgtacttcctaaccgtttcctccgaacctttcgtaaccgg

SEQ ID NO: 245373 - DNA, 855 bp, Homo sapiens
  misc_feature: GYAE6OF02GKFCU.5.59.F04.1.454.CMB.1.raw
tcagatcagacacgcacgaccggtgctcgatttagtacacacacttagggattggggtgctcagttaggacccagagggaaccatgggaaaccccagcgcagcttctcttcctcctgctactctggcctcccagatcgccaaccggaaagactgtgttgacgcagtctccgaggccaccctgtctttgtctccgaagggaagcgccaccctctcctgcgacggccacgtcagacttcgttaaccaacgtaggttaccgtagcccgttaggtaacccaggaccaaacggtaacccgtcgggacccgtacggttaccccaacggtccccttacctactacttccgtaagttcggttaactacctacccaaccggtacggggacccctacggttcggacctaccgtaccccaaggtaccgtacggtttacgacggtacggacgaccgggtcgggttacgtacggggactaacggtacctttcaccgttcccttaccgaactacgttaccaacgaccggtaacgaccggttacgggaacgtcccgttaacggtaaacggttttacgttttacgggacttaaacgggttaactttaacggtttaccgttacgtaaccggttaacgtaccgtttaaggttacggttagggttaacctaccggttaccgggtaaccgggttaccggttacccggaaccggtaaacgggtaaccgttaaacggggtaaacgtaaaacgtaaccggtaaaccggtaacgttacgggtaaccggtccgtaacgggaacccttaaacggtacgttaccgttacgttaaccgttccttaaccggttaccccgttacccgtaccgttaccgtacccgg

SEQ ID NO: 245374 - DNA, 738 bp, Homo sapiens
  misc_feature: GYAE6OF02HZ18N.5.59.F04.1.454.CMB.1.raw
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
tcagatcagacacgcacgaccggtgctcgatttagtacacacacttagggattggggtgctcagttaggacccagagggaaccatggaaacccagcgcagcttctctcctcctgctactcgtggcctccagatgccaacggaaagactgtgtgacgcagtctccgaggcctaccctgttcttgtcctaccgaaggggaancgccacccttctccngacgagggcagtcaagtaactcgttacaagtaggttcgacgtccgtaggtacacggacaacgtaaccgtggaccgtaacggttcccagttccaccgtactaacgtcgtagtaggttaactaccgtacccgaacgtacggtccctaagtccggtacctaccgtcccggaagtacggtacgttacggtagtcggacgaccgggttcggtacgttacgggaactacggtacttcgtaccttaacncctactnacgaacgcgtatacgtcggaacgtcgtaagtaacgttcgttacggcttaggtacgttaattcgtacgactacggtactagttacggtccgtagtaccgtccggtaaacggttaccggtaccgtaccgtaaacgggtaccggtaaacggttaacggtaaaccaaacgggttaaccgaaaccggttcgttacggtaccgtaacggtacctaacggtacgttaccgttccggttacgttaccgtccgttttaacccgtaccctaggtaccttaccgg

SEQ ID NO: 245375 - DNA, 927 bp, Homo sapiens
  misc_feature: GYAE6OF02HFV31.5.59.F04.1.454.CMB.1.raw
  modified_base (194)..(194): a, c, t, g, unknown or other
  misc_feature (194)..(194): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccaggggaangccaccctctcctgcgtagggccagtcagaacttgtaaccaagtaggttccgtaagccgtagggtaccaagtaccaacggaaaacccttcggggaccctaacgggtttcccccaaggtcccctttacccgtaccaagttacccgttaaagttacgggttaacttaaccggtacccccaaccggtaaacgggggtcccccaacggtttgggaacccctaactaccccccggaaggttaaccccgtaggggttttacgaccggggttacggaccggtaaacgggttcccgggggtaccgttaacgggggaaaccctaggtaacccgttttaccgaaccgtttcccctaaccggtaaaccgtactaccgggaacgttcccgaaagggttaccctaggggtaaccaccgtaacgggttaaaggttaacggttttttaccggaaccggttaaggttaacgttaaggttttaacccgtttacgggttaaacccgtaacggttacggttaacggtttaagttacgggttaccgtacccgtaccggtaacggggttacccggtacgggtaacccggaaaccggggtaaccggtaaagggttaacggtaaaacgtaccgtaaaagggttaacctagggtaaccggtaccggtacgtaacccgtaacgtaaaccgtttaccgtacggttacccttaacgttacccgttacccgttaccccggttaccgtaacgtttacccggg

SEQ ID NO: 245376 - DNA, 746 bp, Homo sapiens
  misc_feature: GYAE6OF02HJRFP.5.59.F04.1.454.CMB.1.raw
  modified_base (130)..(130): a, c, t, g, unknown or other
  misc_feature (130)..(130): n is a, c, g, or t
  modified_base (207)..(207): a, c, t, g, unknown or other
  misc_feature (207)..(207): n is a, c, g, or t
  modified_base (471)..(471): a, c, t, g, unknown or other
  misc_feature (471)..(471): n is a, c, g, or t
  modified_base (509)..(509): a, c, t, g, unknown or other
  misc_feature (509)..(509): n is a, c, g, or t
  modified_base (736)..(736): a, c, t, g, unknown or other
  misc_feature (736)..(736): n is a, c, g, or t
tcagatcagacacgcacgaccggtgctcgatttagtacacacacttagggattggggtgctcagttaggacccagagggaaccatggaaaccccagcgcagcttctcttcctcctgctactctgctcccngatgccaccggaaagactgttgttgacgcagtcctaccgaggccacccttgttctttgtcctaccgaaggggtaaanacgccctacccttcctcctcgaccgtacgggccctaagttccaagtaacttacgttaacccaaacgtaggttaccgtacgcccgttaggtaaccaggacctaaggaaacccgtcggaccgtacggttaccccacgtccctcctacatctagtagtactactcccgaaccgacggtacccacgtcggacctacctcccgaagacgtacgttcgagtcggactcgggtcggtacgacggacacggtccttacgcctctaccacctntacgacgtcacggtcgacggtactccgtaggtaatttntttacggctaaggttcttacgttacgtcgtacgtaagtcgttagttacgtacgggttacctccgttaccgggacgggtttacccgtaaccgggaaccgggtaaacggtaccggttaacgggaaacggttaaccgtaaacgtaaccggttaccgtaggtacggtaccgttaacacccgttaactaccgttacgtacgtttcccgtacttcccgttacccggttacccncttaccgtcg

SEQ ID NO: 245377 - DNA, 1163 bp, Homo sapiens
  misc_feature: GYAE6OF02FN176.5.59.F04.1.454.CMB.1.raw
tcagatcagacacgcacgaccggtgctcgatttagtacacacacttagggatttggggtgctcagtttaggacccagagggaaccatggaaaccccagcgcagcttctcttcctctgctactctggctccagtatcgccgaaccggaagacgtcgtgttgtacgacgacgtacgttccacggacaccccgttacgttcgttttacgttccgtacccgtacggggtaaaagggaacgtcccgtacccccgtaccgttccttaccggacgaaccgggtaccggtaccgttaaccgtaaggtaacgttaaccgtttaaccgttaaaccgtaacggtttacccggttaacggtacccgttaccgtaaccggtaacgtaaccgtaaccggtaaaacccgtccgggtaaccggtaccggtttaacccccggttaaccggcccccttttacccgttaacccgtacttaacgttaacccgttttaaggttaaccgtttaaaaccgtccccttaacccgggaaccggtacccggtaaaccccggttacgggtaccgaaccgttacccccgttaacggtacggtaaaccgttttaccgggtacgggttaacgggttacccgggaacgggttccggggtacggttaacggggtaacgtaaccgggttaacccctttaaccgttaaccccggttacccttaccggtaaacccctaacggtttaccgaccggttaaacccggacggtttaaacccggttcggttaaacccgggaccgtttaaccgggtaaacggtttaaacggttttaccggttaaaccggtacccggtttaaaggggtttaacctttaccggtttaccggtttaacgtaacccggggttaacgtaacggtttaccgggttaaacgggtttcgtttaacccgggtaacccgttaacggggtttacccggttaaacccggggttacccggggtaaaaccgttaaccggggttaaaccgtttaacgggtaaaaacccgggtttacgaaaaacccgtttaacgggtacccgtttaacggacccgggttaacgttaaaccccgaaccggttaacccgttttacggttacccgtttagttttaaaccccgttacggttaaaccccccgtcccggttttaacccggacgtttttaaccccgg

SEQ ID NO: 245378 - DNA, 924 bp, Homo sapiens
  misc_feature: GYAE6OF02H0TYH.5.59.F04.1.454.CMB.1.raw
  modified_base (203)..(203): a, c, t, g, unknown or other
  misc_feature (203)..(203): n is a, c, g, or t
tcagatcagacacgcacgaccggtgctcgatttagtacacacacttagggattggggtgctcagttaggaccagagggaaccatggaaaccccagcgcagcttctcttcctcctgctactctggcctccagatgccaaccggaaagacttgtgttgacgcagtctccgaggccaccctgttctttgtctccgaagggggaaancgccctaccctctcctgaccgagggccagtcaagtaattcgttaaccaacgtgggtttcctaacgtcctagggtaccagtccaaacggtaaaaccgttgggccctaacgggtttaccccacggtccccttcctactatcgtaagttacggttaactaccttacccgaaccgtaacgggggaccctaccgttcgggaacctaccgttacccccgaaggtaaccgtaacgggttttccgaaagggttcgggaccgtacggggtccggggtttacgacggggggtaaccttaacgggttaacctttaccgtaaccgtttcccgttaacccacccgtaagttacccgaacggtaacgtaaacggtaccggttacgggtaacgtaccccggttaaggtaaacggtttacgtttttacgaacggtaacggttttacggttaaacttttaccggtttaagtaaccgtaacggacgtttaaggttaaacggttacgggtagtaaccccggttacgggttaaacccgggtacccgggtttaacggggaacccgggtaaacgggtaaaccgggttaaaggggtaaacgggtaaaactaaacccgttaaaagggttaacccggtacggtacgggtaacggtccgtaaccgttaaccggtagtttaacccgttaccggtttaccttaccggttaaccgttttaccccgtacccgttaccggttcgttaaccgg

SEQ ID NO: 245379 - DNA, 982 bp, Homo sapiens
  misc_feature: GYAE6OF02FMQ0U.5.59.F04.1.454.CMB.1.raw
tcagatcagacacgcacgaccggtgctcgatttagtacacacacttagggattgggggtgctcagttaggacccagagggaaccatggaaaccccagcgcagcttctcttcctcctgctactctggctccagatgccaaccggaaagactgtgttgacgcagtctccgaggctacctgtcttgtctaccgaggggaagcgccaccctctcctgcgacgggccagtcaagtacgttcgttaaccaacgtacgggttacgtacgtacccgttacggtaaccaggtaccaaaggtaaacccgtggggaccccgtaacgggtttcccccaacggtccccttaccccgtactaacgttttacctaaggttacgggttaacttacccgaccccgtaacccgggtaaccggggtcccgaaccgtttcggggaacctaaccgtacccccgtaaagggtacccgttaacggggtttaccaaggggttccgggacgtaggggtcccggggttacgttacgggggaacctacggttaacccgttacctacccggttacctacgttaacccagttacccgaaggtacccgaacggtaaccggtacgggtaacccggttccggtaacggtttaaaacgggttaccgtttttacggaacggtttaacggtttacggtttaaccggtttaccggttaccggtttaaccgaaccggtttaccgtaagggtttaacccggtttacgggtaaccggttaccggttaaccccgggttaaaccggggttaaccgggtttccccggggtaaaccggggtaaaccggggttaacccgggtaaaaggggtttaaacccgggtaaaacgttaaaccgggtaaaaccgtttacggttacgggggttaaacggtacccggttaacgggaacccttaaccggttaacggttacccgtttacggtttactacccgttaccttcccggtacccgtaccgttaccgtaccgg

SEQ ID NO: 245380 - DNA, 645 bp, Homo sapiens
  misc_feature: GYAE6OF02H2JM0.5.59.F04.1.454.CMB.1.raw
  modified_base (196)..(196): a, c, t, g, unknown or other
  misc_feature (196)..(196): n is a, c, g, or t
  modified_base (236)..(236): a, c, t, g, unknown or other
  misc_feature (236)..(236): n is a, c, g, or t
  modified_base (395)..(395): a, c, t, g, unknown or other
  misc_feature (395)..(395): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgaggggaaangccaccctctcctgcagggccagtcagaatgttaaccaanaggttcgagcctggtaccagcagaaacctggcctacggttcccagtccctcctcattctagttggtaactactcccgaccgacgggccacgtggcactccccagacgtaggttcagtggcgaggcggtcgtacgggcagtacttcactctcacatcaancagacgtggacgtccgtagtaacgttagtttcgagttagtagttatttacgttagtacgtagtacgtagttagttggtaacgtccgttaccggtaaccggttacgggttaccgggaccgtaaacgggtaccgtaaacgggtacggaaaacttaaccggaaaacgtacgtaggtacggtccggtacgaccgtaccgtacgttccgtcgttacgtttaccgtacgttccccgttcccgtacctacgttccgg

SEQ ID NO: 245381 - DNA, 666 bp, Homo sapiens
  misc_feature: GYAE6OF02FT7QQ.5.59.F04.1.454.CMB.1.raw
  modified_base (194)..(194): a, c, t, g, unknown or other
  misc_feature (194)..(194): n is a, c, g, or t
  modified_base (487)..(487): a, c, t, g, unknown or other
  misc_feature (487)..(487): n is a, c, g, or t
  modified_base (511)..(511): a, c, t, g, unknown or other
  misc_feature (511)..(511): n is a, c, g, or t
  modified_base (614)..(614): a, c, t, g, unknown or other
  misc_feature (614)..(614): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcaccctgtctttgctccgagggaangccaccctctcctgcagggccagtccaagtaatcgttaacccaaacgtaggttccgtagccgttaggtacccagccaacggaaacctggcccagggttccccagccccttcctcagttctagtggttaactactcccgaccgtagggccctacgtcggactacgtcccgagtacgtacggttcaggtcggcacgggtcgggtctagggacacgtactcacttcgacctaacgatccgagcacgtacgtggacgtccgtagaacgttagtttcgacgtagttgttaacttacgngttacgagtacttagtagtgtacnccgtagtaccggtaggtcccggaacggtacgggtaaccgaagggttaacgaaacgttaaccgaaacgtacgttaggtacggtacccttaggaccctaaccgtnttaccggttagttaccgttacgttaaccgttccgtccccgtactacgtttcg

SEQ ID NO: 245382 - DNA, 742 bp, Homo sapiens
  misc_feature: GYAE6OF02H01QX.5.59.F04.1.454.CMB.1.raw
  modified_base (130)..(130): a, c, t, g, unknown or other
  misc_feature (130)..(130): n is a, c, g, or t
  modified_base (145)..(145): a, c, t, g, unknown or other
  misc_feature (145)..(145): n is a, c, g, or t
  modified_base (164)..(164): a, c, t, g, unknown or other
  misc_feature (164)..(164): n is a, c, g, or t
  modified_base (206)..(206): a, c, t, g, unknown or other
  misc_feature (206)..(206): n is a, c, g, or t
  modified_base (691)..(691): a, c, t, g, unknown or other
  misc_feature (691)..(691): n is a, c, g, or t
  modified_base (699)..(699): a, c, t, g, unknown or other
  misc_feature (699)..(699): n is a, c, g, or t
  modified_base (719)..(719): a, c, t, g, unknown or other
  misc_feature (719)..(719): n is a, c, g, or t
tcagatcagacacgcacgaccggtgctcgatttagtacacacacttagggattggggtgctcagttaggacccaggagggaaccatggaaaccccagcgcagcttctcttcctctgctactctggctccngatcgcaaccggaanctgtgttgacgtcagtccnccaggccacccgtgttctttagtactccggtaaggggaaacncgccctacccgttctccgtcgccgacgggaccctaaggtccagttaacgttcgttaacccaggtacggtttacgacgtccgttcgtacgacgtacaaacgaaccgtcggtaccgtaccggttaccccggtacccctccgtacaattccttaaggtggttacctacctacccgacgggtaacggtccctaacggtggtacaccctacccaaggtaccgtcggtactagggtacgccggagggtccggtggtacggacgaacgtttctaccgtacccgtctaacccagtacctcgtaaaccgcgtaaacggtaccgtacggacgtaccgtaagtaccggttttaacttacggtcgttaacggttacgttacgttacggtcgtaacgttactaggtacggttacgtagtacgtcgttaacgaccgggttacgtaccggaacgtaacggacgtaaggacgtaaacaagtaacgacggttcgaggtaccnggtaaccncttaaccgtgttactccgtntaccgttcccgtacgatcggttc

SEQ ID NO: 245383 - DNA, 815 bp, Homo sapiens
  misc_feature: GYAE6OF02H8CIS.5.59.F04.1.454.CMB.1.raw
  modified_base (195)..(195): a, c, t, g, unknown or other
  misc_feature (195)..(195): n is a, c, g, or t
  modified_base (313)..(313): a, c, t, g, unknown or other
  misc_feature (313)..(313): n is a, c, g, or t
  modified_base (736)..(736): a, c, t, g, unknown or other
  misc_feature (736)..(736): n is a, c, g, or t
  modified_base (803)..(803): a, c, t, g, unknown or other
  misc_feature (803)..(803): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgtcagtctccaggcaccctgctttgtctccgagggaancgtccaccgttctccctagcagggccagtcctaagaattgttaccaaactagggtttcgaagtccttacggtacctaggcaagtaaacctcggaccagggttccccagtccctccgtnaactcgtaactggtaacttaacaccccggtaaccgaggtaccctaacggttggaccctacgtccccgaagtaaccgtacggggtttaccacggtacggacgtaacgggtccggggttccttaaggggggtaccaacgggttacccggtttaactaacccgttcccgttaccgaaacccttaagtacccgaacggtccaaagggtacccgttaggggacgtacccgttacggtaaaaggttttcgtttaaccggcgttaaagttcggtaaacctttaagtttcgaaccgtttgaaccgtattaacggttcgacggtacccttaaggaacccgttaacggttcgggacccgtaaaacggggtacctaaaccgggttaaggtaaacgtaaccgtaaaacgttaacgtacgggttcggtaaccggtnaaacccctacgtaacgttaacttccggtttctaacggttacccttaccggtttaccccgaacccgtntttaaacccggg

SEQ ID NO: 245384 - DNA, 728 bp, Homo sapiens
  misc_feature: GYAE6OF02GUUE2.5.59.F04.1.454.CMB.1.raw
  modified_base (191)..(191): a, c, t, g, unknown or other
  misc_feature (191)..(191): n is a, c, g, or t
tcagatcagacacgcacgaccggtgctcgatttagtacacacacttagggattggggtgctcagttaggacccagagggaaccatggaaaccccagcgcagcttctcttctcctgctactctggctcccagatgccacggaaagctggtgttgacgcagtctccgaggccacctgtcttgctcgagggaangccacctctctgcaggccagtcagtaatcgtaaccaagtacggttcgagcctaggtaccagcaagtaacctggccaggttcccagtccctacctcatctatgtaatactccgaaccgtaggccctacgtggacctacctcccaagtacgtaggttaccgtaggtcgacgtaggtccggttacgtggggaaccaggtaccctttacgaccttacgtaccgaacccgtactaccggacggtaccgtaaccggtaacgttacgggacccggtacccgttagggtaaacccggtttagttttaccgggacttaacggggtttactttaacggttaccgttagttaccgtaaggtaccgttaggtacgttagggtacctaccgtaaccggtacgggtaaccgttcggaaccgtaaacgggtacgtaggtaacgggtaactaaacggaaccgtggttacggtacggtactaccgggactaaccggtagttacccgttaagttcttaccggttaccttccccggtaaccgtacttacgtaccgg

SEQ ID NO: 245385 - DNA, 758 bp, Homo sapiens
  misc_feature: GYAE6OF02H6ELT.5.59.F04.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatgcccaccggaaagactgtgtgacgcagtctccaggccaccctgtctttgtctaccgaaggggaancgccaccctctcctgaccgacgggcctagtacgaagtaagttacgttaaccaaacgtacgggttacgtaacgccgttacgggtaaccaacggtacctaaacgtaaacccgttacggaccgtaacggttaccccgaagtccccttaccacttaataccgttagttacggtaactactaccccgaaacgtaccggtacctaacgcggtacctaaccgtccgaacgtaaccgtaggtacacggtacggaccgtaggtcgggtacgtacgggactaagtaccttcaccgtcgaacctaccgtatacgacgtacgaacggtacgtaggaccgtactacggtaagttacgttagagtacgttagttaacttgtagtaccgtagtactaaggtacgtacggtacgtaacctcgggtaacgggttacgttccggaaaccggtacgggaaaccgttaagggtaacgtaaacgtaacgtaaacgacgtacggtccggtaacgcgtaaccgtacgaacgtttcgtacgtcctaaccgtacctttaccccgtaccgtaccgtagttacgg

SEQ ID NO: 245386 - DNA, 791 bp, Homo sapiens
  misc_feature: GYAE6OF02H5KFA.5.59.F04.1.454.CMB.1.raw
  modified_base (200)..(200): a, c, t, g, unknown or other
  misc_feature (200)..(200): n is a, c, g, or t
tcagatcagacacgcacgaccggtgctcgatttagtacacacacttagggattggggtgctcagttaggacccagagggaaccatggaaaccccagcgcagcttctcttcctcctgctacctctggcctccagatgccaaccggaaagcttgtgttgacgcagtcctccgaggcaccctgtcttgtctccgaggggaaancgccaccctctcctgcgagggcctagtcgaagaacttcggttaaccaaacgtagggtttaccgaacgtccttagggtaccaaggcgtaaacgaaaccgtggacccgtaacgggttccccaaggtccccttaccgtacaattccgtaagttggtaataacctcccgaaccgaagggtccacgtcggactaacgtcccgaagacgtaggttacgaaggtcggactaacggtccggggtactacggggaaactacggtaaccttaccgaaccgttccgtacctaaacctatacgaacgtacccgaaagggtacccgtggaacgtacccgttaaggtaaacgtttacgttttacggaacgttacgttagttaacgttacgtacgtacgtacgtacgtaagttacgtcggtaacgtaccgtaccggtaacgggttaccggttacgggtaacggaacgggtaaccggtaaagggtaacgtaaaacggtaaacgtaaaacggttactacgggtacgttacggtaccgaaccgtacgtaacgttcgtaacgtttcccgttaacttaccgtttacccgttaccgtacccgttagtaccgg

SEQ ID NO: 245387 - DNA, 886 bp, Homo sapiens
  misc_feature: GYAE6OF02ID8Z8.5.59.F04.1.454.CMB.1.raw
  modified_base (141)..(141): a, c, t, g, unknown or other
  misc_feature (141)..(141): n is a, c, g, or t
  modified_base (192)..(192): a, c, t, g, unknown or other
  misc_feature (192)..(192): n is a, c, g, or t
tcagatcagacacgcacgaccggtgctcgatttagtacacacacttagggattggggtgctcagttaggacccagagggaaccatggaaacccagcgcagcttctcttctctgctactctggctccagatgccaccggaanactgtgtgacgtcagtctcaggcaccctgtctttgtctccgaggggaaacncgtccacccgttctccgtagaccgacggggccctaagtctaaggtaacttaggttaacccaaaaggtcgggtttacgtaacggtccgttacgggtaacccacggtaacgaaacggtaaacccgttacgggtaccccgtaaccgggtttaccccgaacggtccccctttaccggtaaccctaacttacccgtttaacggttacgggtttaaactaaccggttacccccgtaaccggaaccgggggttacccctaacgggttacggccgtaaaccgtacccccgtaagggttaaaccggttacggggtttaccggaacgggtacggtaccggtaaacgggtcggggttaaccggttcgggggggaaactaaccgggtaccttaccgtaccgttacttacccggaaaccttacgtaccgaaccgtcggtaaacgggtaacggtacgggtaacggtccggtttaaacggtaacggttttagtttaccggaacgttaggttagtttaaacttccgttaggttaccgtagtacgtaacgttgacggttagtaccttacgggtaaccggtacggttccggtaaccggtaagggtaccaaagggttaacgaaacgtaccgtaaaacgagttacgtaggtacctggtaccaacgtctttacgttacgttcctacctacgttcccgtattccccgtagttcccg

SEQ ID NO: 245388 - DNA, 731 bp, Homo sapiens
  misc_feature: GYAE6OF02G3ERB.5.59.F04.1.454.CMB.1.raw
  modified_base (213)..(213): a, c, t, g, unknown or other
  misc_feature (213)..(213): n is a, c, g, or t
  modified_base (458)..(458): a, c, t, g, unknown or other
  misc_feature (458)..(458): n is a, c, g, or t
  modified_base (547)..(547): a, c, t, g, unknown or other
  misc_feature (547)..(547): n is a, c, g, or t
  modified_base (722)..(722): a, c, t, g, unknown or other
  misc_feature (722)..(722): n is a, c, g, or t
tcagatcagacacgcacgaccggtgctcgatttagtacacacacttagggattggggtgctcagttaggacccagagggaaccatggaaaccccagcgcagcttctcttcctctgctactctggcctccagatcgccaaccggaaagactgtgttgacgctagtcctccgaggccacccgttggttccttttggcctaccggaagggggaaancgccctacccttcgtccgtggccgacgggaccagttaccgaagtaattaccgttaacaaacggttacgggttccgaacgtcccgttaggaccagaccgaaacggtaacctcggtactaccgttcccgacgtcctcctcgactcggttatacggttactacctaccaccgggtacggtacccacggtcggactaccgtaccgataccgtagttcgacgttcggcggaggcgggtacacggaccgtntaccttcgactccgtacacctacgtcgtaccgagaccgtaagtcgaccgtacgtagtacgttgttacggtatacggtacttaacggttntcggtacgtacggtactaggttctgggtacctaggtaccggtaacggtaccgttaaccgggaccggtaacgggtaaccttaagggtaagtaaaacctacgggaaataccggtcggtactacggtccgtaaccacgtcgttaaccgttgaacctcgttacccgtaccggtcctccngttaaccgg

SEQ ID NO: 245389 - DNA, 740 bp, Homo sapiens
  misc_feature: GYAE6OF02GTAE2.5.59.F04.1.454.CMB.1.raw
  modified_base (201)..(201): a, c, t, g, unknown or other
  misc_feature (201)..(201): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaaccggaaagactgtgttgacgcagtctccaggcaccctgttctttgtctccgaaggggaaagngcccaccctctcctgcgacgggccagtccaagtatcgttaaccaacgtacggttcgtagcctggtaaccagcaacgaaccgtggaccgtacggttcccgagtccctacctcactctagtaggtatacgtacccgaaccgacgggtccacgtcggacctactcccgaaggtacgtacggttccaaggtcggacgtacgggtcgggtacgttacggggaaacctacggtaccttacctaccttacctaccgaacctaatccgacgacgaacggtaccgtaggtacggtaccctaagggtaaacgtttacgttttacgggaacgttaggttaacgttaacgtttacgtacggttacaggtaaccgtaagttaggttacgggtactaccgtacggtaccgggttaccggttaccggaccgggtaaacgggtaacgaaagggtaacgtaaacgtaacgtaaacgtacgttagggtcgtacgtacgaacctacgtacgttacgttcgttacttaccgtacctttcccgtccgtacctataccggg

SEQ ID NO: 245390 - DNA, 632 bp, Homo sapiens
  misc_feature: GYAE6OF02GLQMH.5.59.F04.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
  modified_base (329)..(329): a, c, t, g, unknown or other
  misc_feature (329)..(329): n is a, c, g, or t
  modified_base (380)..(380): a, c, t, g, unknown or other
  misc_feature (380)..(380): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccggaaagactgtgttgacgcagtctccaggcacctgtctttgctccgaggggaangccaccctctcctgcaggccagtcagatgtacacnggtcagctggaccagcagaacctggcctaggtccagccctcctcatctatggtatactccaacgagggccagtggcactcccagactaggttcagtggcnggcggtctgggacagtactcactcgtcaaccatcacgcgagtacgtggacncgtagaagttatttagacttaggttcgtaacttacgtgtacgtacgtactaaggttacgttagggtactaccgtccggtaaccgggtacggtttacccgggacgtaaacggggtaacggtaaacgggtaacggtaaaacgtaaccgaaaacccggttaacgtacgggtacgtaccggtacggaaccgtaccgtacgttaccgttcgttaccgttacctacgtttacccgtcccggtacccttagttacccgg

SEQ ID NO: 245391 - DNA, 635 bp, Homo sapiens
  misc_feature: GYAE6OF02J13J1.5.59.F04.1.454.CMB.1.raw
  modified_base (156)..(156): a, c, t, g, unknown or other
  misc_feature (156)..(156): n is a, c, g, or t
  modified_base (322)..(322): a, c, t, g, unknown or other
  misc_feature (322)..(322): n is a, c, g, or t
  modified_base (422)..(422): a, c, t, g, unknown or other
  misc_feature (422)..(422): n is a, c, g, or t
  modified_base (480)..(480): a, c, t, g, unknown or other
  misc_feature (480)..(480): n is a, c, g, or t
  modified_base (614)..(614): a, c, t, g, unknown or other
  misc_feature (614)..(614): n is a, c, g, or t
  modified_base (629)..(629): a, c, t, g, unknown or other
  misc_feature (629)..(629): n is a, c, g, or t
tcagatcagacacgcacgaccggtgctcgatttagtacacacactttagggattggggtgctcagttaggacccagagggaccatggaaacccagcgcagcttctcttcctcctgctactcgtggctcccagatgccaccggaagctgtgtcgacncagtcctaccagggccacccttgtcctttgcctccgagggggaaatgcccaccttctcctgccagggcctactgaacggaattcggttaccaacgaggtttcgaagtccgtagggacccagccgaaggtaaacccttggccgtaccgttaccccgagtccccttcnctaatccttagtagtactcgtacccgacacgggccaacgttggaccctataccaacggacttacggtctaacggtggaccgggtacgtcggacgttacgntacgtccagtccataccactagcggactagtcgtcggatcctagtaagcgtttaacgntgttacgtctacgtgtacacgtatacggttacgtacgacgtcaccggtacgtaccgtacgacggaacggtaacggaatacgaagacgtaacgtacgttaggtcgtaccgtggtacctaacgcgttgtctactcncgttacctccgtacncgtacg

SEQ ID NO: 245392 - DNA, 743 bp, Homo sapiens
  misc_feature: GYAE6OF02FQLZ4.5.59.F04.1.454.CMB.1.raw
  modified_base (402)..(402): a, c, t, g, unknown or other
  misc_feature (402)..(402): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctcccagatcgccaccggaaagactgtgttgacgcagtctccgaggccaccctgttctttgtcctccgaggggaaagcgccctaccctctcctgccgtagggccagtcaagtatcgttaaccaacgtaggttcgtacgtccgtaggtaccaggccaacgtaaaccgtcgggaccctacggttaccccacgtccccttcctactattcctagttcggtaacttacctacccgaccgacggacctacgtcggacaacctccgagtacgtacgttacgnggtcgacgtgggccgggtacgcgggtaccgtacgttaccttccgacgtttccgtaaccaccgtaataccgacgtccgtaacgtacggtccggacgtaccgtaagtaacgttacgtttccgacgttagttacgttacttacggtacgttacgacggtacttaaggttcgttaggtaccgtaccgtacccggtacggttaccggtaccgggaaccggtaacgggaaccgtaacgggttaaagaaacccgttaagaaaccggtacggttacgtccggtacgaccgactaaccgtatcccgttacgtccttaccggttccttaccccggtctaccgtcttaccgg

SEQ ID NO: 245393 - DNA, 887 bp, Homo sapiens
  misc_feature: GYAE6OF02H3GM8.5.59.F04.1.454.CMB.1.raw
  modified_base (207)..(207): a, c, t, g, unknown or other
  misc_feature (207)..(207): n is a, c, g, or t
tcagatcagacacgcacgaccggtgctcgatttagtacacacacttagggattggggtgctcagttaggacccagagggaaccatggaaacccagcgcagcttctcttcctctgctactctggcctccagatgccaaccggaaagtactgttgttgacgcagtcctccgaggccacccgttgttctttcgcttaccgaaggggaaancgcctaccctctccgtgcgacgggccagtacaagtaacttacgttaaccaaacgttcgggttaccggtaacgtccgttacgggtaaccacgacgaaaccggtaaaccgtcggtaccgtaccggttacccaacgtcccctaccgtactacgttacttacgttacggtaactaccgtacccgtaccgacggggtaccctacggtcgtacctaaccgtaccgtaacgtacgtacgggttcgtagggtcggcggtaacgggtccgggttaacggtacgggtactaacggttaccttccgtaccgtccgtaaccgtacctaacgtacgacggtaccggtacgtaccgggtacggtcgtaaccgtaggttaaacgtttaccggtttacgaacgttagggttaccttacgttaccgttacgtacgtaacgttacgtacgttaacggttacggtaccggtaccgtcggttaaccgggtaccggttaccggtaaacccgggtaaaccgggtaacgggttaaacgggtaaacggtaaaacccgtaacgggttaaaacccggggtaattaccggggtacgggtaccctacgggttaaccccgtaaacgttaacgtttccgttaccggttttaccttaccggttacccttttacccccggggtttacccttacgtaccggttttaacccggg

SEQ ID NO: 245394 - DNA, 718 bp, Homo sapiens
  misc_feature: GYAE6OF02GRSBT.5.59.F04.1.454.CMB.1.raw
  modified_base (577)..(577): a, c, t, g, unknown or other
  misc_feature (577)..(577): n is a, c, g, or t
tcagatcagacacgcacgaccggtgctcgatttagtacacacacttagggattggggtgctcagttaggacccagagggaaccatggaaaccccagcgcagcttctccttcctcctgctactctggcctcccagtatgaccaaccggaaagactggtgttgacgcagtctccaggccaccctgttctttgtcctccgaaggggaaacgagcccacccctctccgtgcgacgggccaggtcaagtaatacgttaaccaacgtagggttaccgtagtcccgtagggtaaccacggtacaacgtaaaccgtcggccgtaaccggttccccacgtcccctactacctatcgttaagtaggtaacttacctacccgaaccggacgggtaccaccgttcggacacctccgaagacgtagtcggagtcggacgcggtacgggtcgtagggaactaggtaccttactacgtactccaactacgtaccaacacgacggtacgtcggggtaactccggtagtaaacggtttagtttcaccggttattaacgttagttacgtctaccgtgaagtagtacgttaggacncgtacgtacgacgttaccggacgaacggtaacgtaagggtaacaaactaaaccgtaagtaccgttagggacgtccgtaaggcccttaacctgttaccttaccgttactaccgttccgtaccctacttaccgacgttacccg

SEQ ID NO: 245395 - DNA, 1079 bp, Homo sapiens
  misc_feature: GYAE6OF02FPIWQ.5.59.F04.1.454.CMB.1.raw
  modified_base (203)..(203): a, c, t, g, unknown or other
  misc_feature (203)..(203): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatgccaccgggaagactgtgttgacgcagtctccaggccaccctgttctttgtcctaccgaaggggaaacncgacctaccctctccgtgcgtacgggccaggtcaacgaacttcgtaacccaacgtagggttccgtagcccgttggtaacccagaccaaaggtaaaccgtcggacccgtaacggttaccccaacgtccctaccgttaccacttaccttagttacggtaattacctaccaaccgagggccctacgtacgcctaccgtcccaacgtacgtacggttcgaggtcgggccgtaacgggtccggggttacgttacgggggaaccgttaacggtaccctttacgacccgttaacctaccctaaacccgtaaccgttaccgaacggtacccgtaaaccgggttaacccggtaggggtaacccgttcccggtttaaagggtaaaaacgggtttttaccgtttttttaaccggggtaacccgtttaaacgggttttaacggtttaaacccggtttttaaaccggtttacgggtttaaaccggtaaaccgggtttacccggtttaaaacggggttttaaacgggtttacgggttttaaacccgggtaccccggtttaaacggggtaaccccgggggttttaaacccgggggttttaacccggggggaaaaccccggggttaaaaccgggggtaaacccgggggtttaaaaggggggttaaaaccccgggttaaaaaaccggtttaaaaccccgggtaaaaacccgggttaaaaccgggtttttaccgggggtaacggggtacccggtttaaaaccgggtaccccgttaaaacccgttaaccgggtttaacccgtttaaccgggttttaacccttttacccgttaccccgtttttaacccccgggttaccccccgggtttaaccgttttaaccccgggttaaccccgg

SEQ ID NO: 245396 - DNA, 628 bp, Homo sapiens
  misc_feature: GYAE6OF02JSNIH.5.59.F04.1.454.CMB.1.raw
  modified_base (128)..(128): a, c, t, g, unknown or other
  misc_feature (128)..(128): n is a, c, g, or t
  modified_base (142)..(142): a, c, t, g, unknown or other
  misc_feature (142)..(142): n is a, c, g, or t
  modified_base (190)..(190): a, c, t, g, unknown or other
  misc_feature (190)..(190): n is a, c, g, or t
  modified_base (524)..(524): a, c, t, g, unknown or other
  misc_feature (524)..(524): n is a, c, g, or t
  modified_base (535)..(535): a, c, t, g, unknown or other
  misc_feature (535)..(535): n is a, c, g, or t
  modified_base (577)..(577): a, c, t, g, unknown or other
  misc_feature (577)..(577): n is a, c, g, or t
  modified_base (600)..(600): a, c, t, g, unknown or other
  misc_feature (600)..(600): n is a, c, g, or t
  modified_base (613)..(613): a, c, t, g, unknown or other
  misc_feature (613)..(613): n is a, c, g, or t
  modified_base (623)..(623): a, c, t, g, unknown or other
  misc_feature (623)..(623): n is a, c, g, or t
tcagatcagacacgcacgaccggtgctcgatttagtacacacacttagggattggggtgctcagttaggaccagagggaaccatggaaacccagcgcagcttctctcctcctgctactctggctccanatgccaccggaaanctgtgtgacgcagtctccgagcaccctgtctttgactccgaagggaancgccaccctctcctgcacgggcctagtacacggtaatcgttaaccaacgtaggttaccggtacgcccttagggtaacccaggactaacggaaacccgtgggcccgtaacgggttccccagtcccttaccgtaccagttacctagttcgggtactaaccgtaccccgaccacggggtcccctacgtgggacctaccgttccccgaaggtaccgtacggttcaggttccggacgcggtacggttcggtaaggacacgtaccgttcacgtctaccgacctagtacagtcaacgtcgtcggactccgtagaattcgttacagtcgtacgtactacgtnacgatcggtanacgtagtacgcgtcacggtactcgacgtagacgagtacgaanaccgagtacgagcagtacgcacnttctatcggtacnctacggcctnactcg

SEQ ID NO: 245397 - DNA, 835 bp, Homo sapiens
  misc_feature: GYAE6OF02F1UPJ.5.59.F04.1.454.CMB.1.raw
  modified_base (360)..(360): a, c, t, g, unknown or other
  misc_feature (360)..(360): n is a, c, g, or t
  modified_base (771)..(771): a, c, t, g, unknown or other
  misc_feature (771)..(771): n is a, c, g, or t
  modified_base (791)..(791): a, c, t, g, unknown or other
  misc_feature (791)..(791): n is a, c, g, or t
  modified_base (797)..(797): a, c, t, g, unknown or other
  misc_feature (797)..(797): n is a, c, g, or t
  modified_base (809)..(809): a, c, t, g, unknown or other
  misc_feature (809)..(809): n is a, c, g, or t
  modified_base (823)..(823): a, c, t, g, unknown or other
  misc_feature (823)..(823): n is a, c, g, or t
tcagatcagacacgcacgaccggtgctcgatttagtacacacacttagggattggggtgctcagttaggacccagagggaaccatggaaaccccagcgcagcttctcttcctcctgctactctggcctaccagatcgccaaccggaaagaccttggttgttacgaacgctagttcctaccgaggccaccccttggtttctttcgtacctaccgggaagggggtaaaacgccgacccgtacccttccgttccgcggccggtaaccgggggtcccaaggttaccgaaaggttaacgttaccggtttaaaacccgaacggttacgggtttaaccggtaccgtacccgttacgggtaaacccgngtaaccgtaaaccggtaaacccgtcgggaacccgttacggttacccccacgtaccccttccgactacgttactacggtttaacgttacgtacccttacccggaaccggtacgggtacccacggttaccgacctaccgtaccgacggtaaccgttacgggttacgacgggtacggtaccggaggggttccggtacggtaggtacccgtacgttacctaccgtaccgttccgtaacctaacccgagttaccgaccggtcgtaaaaccgggttccggaggttacccgttaaccgtaggtaaacggttttgttaccggtaagttacggtttaattaccggtacgtaccgagttaacgtcgttaagacgttcggtactcggtacgtccggtacggtcgaacggtacgagtacgtanaacggtacaggtactcggancgtacncgtctagttccntcgtactccgtccncgttactcgtcg

SEQ ID NO: 245398 - DNA, 700 bp, Homo sapiens
  misc_feature: GYAE6OF02JSTW8.5.59.F04.1.454.CMB.1.raw
  modified_base (142)..(142): a, c, t, g, unknown or other
  misc_feature (142)..(142): n is a, c, g, or t
  modified_base (154)..(154): a, c, t, g, unknown or other
  misc_feature (154)..(154): n is a, c, g, or t
  modified_base (189)..(189): a, c, t, g, unknown or other
  misc_feature (189)..(189): n is a, c, g, or t
  modified_base (212)..(212): a, c, t, g, unknown or other
  misc_feature (212)..(212): n is a, c, g, or t
  modified_base (322)..(322): a, c, t, g, unknown or other
  misc_feature (322)..(322): n is a, c, g, or t
  modified_base (341)..(341): a, c, t, g, unknown or other
  misc_feature (341)..(341): n is a, c, g, or t
tcagatcagacacgcacgaccggtgctcgatttagtacacacacttagggattgggtgctcagttaggacccagagggaaccatggaaccccagcgcagcttctcttcctctgctactctggctcccagatgccaccggaanctgtgttgaacncagtctcgagccacctgttctttgctcgagggaancgccacctcgtctgacagggccngtcaagacttgttacccaagtaggttccgtagtccgtggtaacccagaccacgtaaacctcggacctacggttaccccacgtccctacccgttctagtccgttacggttntacttacgacccgttaccncggtaccgtacgtacgactaccgtacccgacgacgtacgttcaacggtcggacacggtcgttacggcgggactacgtacctttacggacccttacgtaccgacggttacacgttaaccggaccgacgttaccgtaacgggcgtaacccgtaggttaacgttactttcggtacgtaagtttacggttattaacgttcggtagtacgtacgtacggtagttacgtcgtacgacgtacgggtacgttccggaaccgaaggtaccgaaggtaccgtaaaggtaacacgttaacgtgtacggtcaacgttccaagtccgtacgttccgttcacggttacccgtactcccgtaccgtgttacccg

SEQ ID NO: 245399 - DNA, 812 bp, Homo sapiens
  misc_feature: GYAE6OF02FYNPO.5.59.F04.1.454.CMB.1.raw
  modified_base (151)..(151): a, c, t, g, unknown or other
  misc_feature (151)..(151): n is a, c, g, or t
  modified_base (165)..(165): a, c, t, g, unknown or other
  misc_feature (165)..(165): n is a, c, g, or t
  modified_base (189)..(189): a, c, t, g, unknown or other
  misc_feature (189)..(189): n is a, c, g, or t
  modified_base (205)..(205): a, c, t, g, unknown or other
  misc_feature (205)..(205): n is a, c, g, or t
  modified_base (330)..(330): a, c, t, g, unknown or other
  misc_feature (330)..(330): n is a, c, g, or t
  modified_base (561)..(561): a, c, t, g, unknown or other
  misc_feature (561)..(561): n is a, c, g, or t
  modified_base (805)..(805): a, c, t, g, unknown or other
  misc_feature (805)..(805): n is a, c, g, or t
tcagatcagacacgcacgaccggtgctcgatttagtacacacacttagggattggggtgctcagttaggacccagagggaaccatggaaaccccagcgcagcttctcttcctcctgctactcgtggcctcccagatcgccgaaccggaaanactgttgttggacncagtctccgaggccacctgtcttntcgtcgaagggaacgngccctaccctcctacctgccgaggccagtcagacttcgtaaccaacgtaggttcgtacgccgttcggtaccagtaccaacggtaaacctcggaccgtaccggtttacccaccgtcctacccgtanacttcgtagttacggtaacttccgtaacccgaccccggacgggtcccaacgtcgggtacccaaccgtaccccgtaaggtaccgttaacgggtttaccgaggttacggggacctaccggggtttccggggacggttaggggaaaccctagggttacccttaccgaccttccgtaacctaacgtaccgtctacggctaacgtaacgtacgggaccggtacgagttaaaggttntttacggacgttaggtactttacgttcgtaccgtagtacggtacgtacggtttaggacgttaccggtacggttaccgtaacccgggggttcggtttaacccgggtacggtaaaccggggtacgtaaaggggtaaccgtaaacgaccgtaaaacggacggtttacgggcgtaacgggtcccgtaacccgtaacggtcctttaaccgttacggtccctttaacaccttcccggtttccgacccttntacccgg

SEQ ID NO: 245400 - DNA, 943 bp, Homo sapiens
  misc_feature: GYAE6OF02JPBMQ.5.59.F04.1.454.CMB.1.raw
  modified_base (132)..(132): a, c, t, g, unknown or other
  misc_feature (132)..(132): n is a, c, g, or t
tcagatcagacacgcacgaccggtgctcgatttagtacacacacttagggattggggtgctcagttaggacccagagggaaccatggaaaccccagcgcagcttctctcctctcgctactctggcctccagntcgccaaccggaagacgtgtcgttacgaccgctacgtcctaccggaggaccgtacccgtgttcgtttcgtaccgtaccggaaagggggtaaacacggccctacccgttactccgttacggccgtacgggtcccgtacggtcgaacggtaacttaccggtaacccgtaccgtaaggggtttaccaccggtacccgtacggtacccgtacggtacgaaccggtaaccgtaccggtacccgtaccgggtacccctacggtaccccttccgtactaaccgtcttaaccgtacgtaccgtaccctacccggtaccgtacccggtactaccggtacggaccgtttaacccggaccgtacgtaacgggtacccgttaggtaaccgggtacgtaaccggtcgggttaccggggtaaccggtcggggaaaccgttacggtaaccccggtttaactaaacccgtttcccggaaccgtaaaccgtttcgaacccgtaccggggtacctaaaccgggtttcgggtacggtacccgacgtagttaaccggttacgttaccgagttaacgggtacgttaacgtacccgtagttaacgggtaccttacggacgtttaaacggtcggttaccgttaaaccgttacccggtaacgggttaccggtaccgggtaaaccggtaccgggttaacggtaaacgggttaaccgaaaccgttaaacgtaacgggtaccgtaacgggttcgtaccggtttaaccggaacttaacgtcgttaacggtttctaaccgtaccggtttaccaccggtttacccgtaccgtagtacccgg

SEQ ID NO: 245401 - DNA, 783 bp, Homo sapiens
  misc_feature: GYAE6OF02JXQFD.5.59.F04.1.454.CMB.1.raw
  modified_base (194)..(194): a, c, t, g, unknown or other
  misc_feature (194)..(194): n is a, c, g, or t
  modified_base (374)..(374): a, c, t, g, unknown or other
  misc_feature (374)..(374): n is a, c, g, or t
tcagatcagacacgcacgaccggtgctcgatttagtacacacacttagggattggggtgctcagttaggacccagagggaaccatggaaaccccagcgcagcttctcttcctcctgctactctggctcccagatcgccaccggaaagactgtgttgacgcagtctccaggcaccctgtcttgctccaggggaanagccaccctctcctcgcgtacgggccacgtcaagtactcgttaaccaacgtacggttcgtacgccgtaggtaccagccgtaagtaaaccccgtagggccccacgggtttaccccaaggtcccctccctacacgttacctgttacggttactactacccgtaaccgacggtaccctaacgnggtaccaccgtaccccgaggtaacctagggtttcaacggttcggaccgtacgggcggggttaccgacggggtaacctacggtaccttacccgtaacttccgtaccctaaaccggtacttacccggaagacccgtacggtaccgttacggtaaccggtacgtaggtaaaacgtttcgttttacgggaccgttaagggttacgttaacgtttacgttacggttaccgtagtaccgttagggttacttcgggtactccgtacgtacggtccggttacgaccgtaaacgggtaacccggttaagtaaccgggtaaacgtacgttaaaaccggtaccgttagtacgggtaccgaacgtccgtaaccctagttcccttggttacctacgtctacccgtttacgtcctacgttccg

SEQ ID NO: 245402 - DNA, 810 bp, Homo sapiens
  misc_feature: GYAE6OF02GIOO8.5.59.F04.1.454.CMB.1.raw
tcagatcagacacgcacgaccggtgctcgatttagtacacacacttagggattggggtgctcagttaggacccagagggaaccatcggaaaccccagcgcagcttctctctctgctactctgctccagatcgccgaccggaaagactgtgttacgacgcgacgtcgtccgaggcctacccttgttcctttcgtccgtacggaacggggaaagacgtcccaccttcctccgtagaccggtacggccgacgttaccgaacgtaacgttacgttaaccaacggtcgggttaccgtacgtacccggtacgtaaccaacggtacctaacggtaacccgttacggaccgtaccggtttcccgaacgtccccttaccggtacctacgttccttaaggttacggttaaccttaccgtaccccgaaccggtaccgggtacctaccgggtacggacctaccgttaacccgaacggtaccgttacggttaccgacggtaccggcgtaccgggtcggtacgttacgggaactacgttaccgtactccgaactaccgacctacgacgtacgacgtacgacgtcggtactaccgtaggtagttcgttcgagttacgtacgttatacgtagtcgtagactaggttacgtaacggtcgtcgtaacggtacggtaaccggtcggtaaccggaacgggtaaccggtaagttaacgaaaccgtaacggtaaacgaccggtacggtacgtaccggtaccgtacccgacttaccttacgttcgttaaccttccggttaccgttacccgtccgttaccgtacccgttacggg

SEQ ID NO: 245403 - DNA, 728 bp, Homo sapiens
  misc_feature: GYAE6OF02GX0U6.5.59.F04.1.454.CMB.1.raw
  modified_base (550)..(550): a, c, t, g, unknown or other
  misc_feature (550)..(550): n is a, c, g, or t
  modified_base (556)..(556): a, c, t, g, unknown or other
  misc_feature (556)..(556): n is a, c, g, or t
tcagatcagacacgcacgaccggtgctcgatttagtacacacacttagggattgggtgctcagttaggacccagagggaaccatggaaaccccagcgcagcttctcttcctcctgctactctggctcccagatgccaaccggaaagactgtggttgacgcacgtctccgacggccacccgtcgttcgtttcgtccgtaccgaggggaaagacgcctacccggggggggggtcctccgtcgcgacgggccgacgtacgaagtaacgtacgttaaccaaacgtacggttacgtacgtccgtacggtaccgacgacgaacgtaaaccgtcggaccgtacggttaccccgaccgtaccctcctaccgtactacttagtacggtacttactacccgtaccgacggtacctaccgtcggaccgactaccgacgaaccgtacggtacgacggcggacgacggtcggtcggtacgggacgacgtactcgtacctctaccactactacacgacgacgtacgcggactacgtagtagttattgacgtagtactagttacncgttanactcgtagttcgtagacgtcgtacggtaccggttacggtcggaccggaacggaacggaagtaaccggaactaaccggaaacgtgtacgggtacgaccgtaaggacccgtaattaccggttcgttacgttccttaccggtaccgtttccccggtaccgtaccgtagttcccgg

SEQ ID NO: 245404 - DNA, 721 bp, Homo sapiens
  misc_feature: GYAE6OF02I19EM.5.59.F04.1.454.CMB.1.raw
  modified_base (554)..(554): a, c, t, g, unknown or other
  misc_feature (554)..(554): n is a, c, g, or t
tcagatcagacacgcacgaccggtgctcgatttagtacacacacttagggattggggtgctcagttaggacccagagggaaccatggaaacccagcgcagcttctcttcctcctgctactctggctccagatgccaccggaaagactgtgttgacgcagtctccgaggccacctgtcttgtctaccgaaggggaaagacgccaccgtctccgtagcgacgggccagtcaagtaattcgtaaccaacgtacgggttacgtacgtccgttacggtaaccacggacgaacgtaaccgtcggacccgtacggttacccaacggtccccttaccgtactacgttacgttaacgtacggttaactaccgtacccggaaccggaaccgggtccctaacggtcggacctaccgtacccggtaagtaccggtaacgttcgtaacggtcgggacgacgggtcgggtcgtacgggactacgtaccttcacgttcactacactacgacgtacgacgtacgtggacgtactagggatttagttcgaagtacgtcgttatacggtacngagtacgttaagtacggttacgcgaaccttaccgggacggttacggtacgggtaaccgaagggtaacccggttaaggaacgtaacgtaaacgaacgtcggtacgtaggctacgacgtacacgttggtacctttccgtagacccttaccggtcctaccggtcgtacgg

SEQ ID NO: 245405 - DNA, 909 bp, Homo sapiens
  misc_feature: GYAE6OF02IKJXB.5.59.F04.1.454.CMB.1.raw
tcagatcagacacgcacgaccggtgctcgatttagtacacacacttagggattggggtgctcagttaggacccagagggaaccatggaaaccccagcgcagcttctcttcctcctgctactctggcctcccagatgccaaccggaaagactgtgttgacgcagtctccgaggccacccttgtctttgtcctaccgaggggaaacgacgccctaccctctccgtgccgacgggccagtacagtaattacgttaaccaacgtaggttacgtacgtaccgtacggtaccagacaacgaaacccgtcgggacctacggttccccacgtccccttacctacgtattcctaagttcggtaattacctacccgtaaccggacgggtaccctaacgtcggacctaaccgtaccccgaaggtaccgtacgggtttacgaacgggtcggaccgtacgggtaccggggttcgtaacggggacctaacggtaccctttactaacccgttccgtaacctacctaacgtccgaacggcctaacgggtaaccgtgggtaaccgtcggttaaacgtaaggtttacttttagggaaccgttttaaggttaacgttaaccgtttaacgggttcgttaaaccgtaacggttacggttaaaggttaggttaccgggttaaccggtaccgttaaccgggttaacccggggtttacggtttacccgggaaaccgggttaaacggggtaaccgggttaaaacgggttaaaccgggtaaaacttaaacccggggtaaaacgtttccggtaggggttaacccgtaccggtaaccgtaaaccctaacgttacggtttacccgttacgttttaacccgttaacccgttaccccgttttaccccggtaaccccgtttaccggttacgttaacccggg

SEQ ID NO: 245406 - DNA, 553 bp, Homo sapiens
  misc_feature: GYAE6OF01CIXC9.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccggggaaggccctggagtggcttgcacactatttttcgattgacgaaaaatcctaacaacacatctctgaagaccagagtcaccatctccaacggacaacctccaaaagccaggtcgtcctacatgatcaacctggaccctgcgacacagccacatatttctgtgctacgggtttctttctactaatatagcagctcggtcgggccgtatttcgactccgtggggccacgggaaccctggtcctacccgtctcctcacgccttaccaccgtaacgggcccatccccgtccttcccccgtcgg

SEQ ID NO: 245407 - DNA, 616 bp, Homo sapiens
  misc_feature: GYAE6OF01CSZOJ.18.63.F08.1.454.CMB.1.raw
  modified_base (324)..(324): a, c, t, g, unknown or other
  misc_feature (324)..(324): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagccccggggaaggccctggagtggcttgcacactatttttcgatttgacgaaaaatcctaacaacacatctctagaanaccagagtcaccatctccaaggacacctaccaaaagccaggtcggtccttaccatgatcaacctggaccctgcggacacacgccactatatttactgtgctacgggttttctttcgtactaaatataggcaagtccgtacggtccgggtaccgtaagtttcgaacgttcccgtggggacccgaacgggtaaccccgtcgggtacctacccggtcctccctccgtacgtcccttacccgacccgtaaccggggtacccctaacgttcccccgttccgttccccccgtcccggg

SEQ ID NO: 245408 - DNA, 558 bp, Homo sapiens
  misc_feature: GYAE6OF01BTAL9.18.63.F08.1.454.CMB.1.raw
  modified_base (406)..(406): a, c, t, g, unknown or other
  misc_feature (406)..(406): n is a, c, g, or t
  modified_base (513)..(513): a, c, t, g, unknown or other
  misc_feature (513)..(513): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagccccggggaagccctggagtggcttgcacactattttttcgattgacgaaaaatcctacaacacatctctgaagaccagagtcaccatctccaaggacacctaccaaaagccaggtcggtccttaccatgatcaacctggaccctgcggacacagccanatattctgtcgctacgggtttctttctactaatatagcagtctcggtccgggaccgtaagtttcgactccgtggggcccagggtaaccctggtccaccgtctcctcncgccttcccaccgacgggccccagtcccgtccttcccccgtcggg

SEQ ID NO: 245409 - DNA, 633 bp, Homo sapiens
  misc_feature: GYAE6OF01CDGVU.18.63.F08.1.454.CMB.1.raw
  modified_base (384)..(384): a, c, t, g, unknown or other
  misc_feature (384)..(384): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggcctccgccgacggcccccggggaaggcccctggagtggcttgcacactattttttcgattagaacgaaaaatcctaacaacacatctctagaagaccagagtcaccatctacaaggacacctacaaaagccaggtcgtcctacatnactcaaccgtcgaccctgacggacacacgccaactattactttctagtcgtacgttacgggttttctttacgtactaaattatacgtacaggtcctccggtcgggacccgttaagtttcgtaaccgttccggtcggggacccaacggggtaacccttcgggtaccctacccggtcctaccctcgacgtcccttacccgaaccgtaaccgggacccctacgtcccccgttcccgttccccccgtcccggg

SEQ ID NO: 245410 - DNA, 625 bp, Homo sapiens
  misc_feature: GYAE6OF01EMROO.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggaaggccctggagtggcttgcacactattttttcgattgaacgaaaatcctacaacacatctctagaagaccagagtcaccatctaccaaggaccacctaccaaaacgccaggtcggtccttacatcgatacaacctcggaccctgccggacacacgccaactattatttctgtcgtccgtacgggttttctttctactaatatacgcacgtctcggtccgggaccgtaagtttcggaccttcccggtcgggggcccgaacggggtaaccccttcgggtaccctacccggttcctccctccgacgtcccttacccgaacccgtaccgggacccctacgttcccccgttcccgttccccccgtcccggg

SEQ ID NO: 245411 - DNA, 561 bp, Homo sapiens
  misc_feature: GYAE6OF01BZX2K.18.63.F08.1.454.CMB.1.raw
  modified_base (411)..(411): a, c, t, g, unknown or other
  misc_feature (411)..(411): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagccccggggaaggccctggagtggcttgcacactatttttcgattgaacgaaaaatcctaacaacacatctctagaagaccagatcaccatctccaacggacaacctaccaaaacgccaggtcggtccttaccatgatcaacctgaccctgcggacacagccaanatatttctgtgctacgggtttcttctacaaatatagctagctcgtcggcctaatttcgactccggtgggaccgagggaccctggtaccaccgtctccncncgccttacccgaccgtaacgggcccctagtcccgtccttcccccgtcggg

SEQ ID NO: 245412 - DNA, 561 bp, Homo sapiens
  misc_feature: GYAE6OF01BI33K.18.63.F08.1.454.CMB.1.raw
  modified_base (402)..(402): a, c, t, g, unknown or other
  misc_feature (402)..(402): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagccccggggaagccctggagtggcttgcacactatttttcgattgaacgaaaaatcctacaacacatctctgaagaccagagtcaccatctccaaggacacctacaaaagccaggtgtccttacatgatcaacctggaccctgcggacacagccanatatttctgtcgctacgggttttctttctacaaattatagcagtcctcggtccgggtcctaagtttcgaccttccgtggggccagggtaaccctggtaccaccgtcctcctcgacgtccttcccaccgacgggcccctatcccgtcccttccccgtcgg

SEQ ID NO: 245413 - DNA, 623 bp, Homo sapiens
  misc_feature: GYAE6OF01ANXHX.18.63.F08.1.454.CMB.1.raw
  modified_base (497)..(497): a, c, t, g, unknown or other
  misc_feature (497)..(497): n is a, c, g, or t
  modified_base (559)..(559): a, c, t, g, unknown or other
  misc_feature (559)..(559): n is a, c, g, or t
tcagtacgagtatgcacgaccggtgctcgatttagcgatcgtataaggggggactcctgtcgccccaccatggacacactttgctacacactcctgctgctcgacccaccccttcctgggtcttgtcccaggtcaccttgaaggagtctggtcctgtgctggtcgaaacccacagacgaccctcacgctcgacctgcctccgtctcgttgggttctcactcagcagtactagagtgggtgtgagcgtggctccgccgaccggccccggggacggcccgtgggagtggcttgcacacttatttttcgattagaacgtaaaactcctaaccaacacacttctactagaacgaccagacgtccaccatccaccgtaacggaccacctaaccaaacgccgtagggtccgtaccttaccatcgactaccaaccgtcggaccctggaccgacacacgccaactattactttctgtcgtcgttacgggtttcttactactaatntacgctagctcggtcggaccgtattcgacgtccggtacgggcctagggtaccctcggtaccncccgtctccctcgcgtcccttaccgaccgaccggtcccagttcccgttcccttcccggtcccgg

SEQ ID NO: 245414 - DNA, 541 bp, Homo sapiens
  misc_feature: GYAE6OF01A0HRU.18.63.F08.1.454.CMB.1.raw
  modified_base (499)..(499): a, c, t, g, unknown or other
  misc_feature (499)..(499): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacgcccccggggaaggccctggagtggcttgcacactattttttcgattgaacgaaaaatcctaacaacacatctctagaagaccagagtcaccatctaccaagacacctacaaaagccaggtcgtccttacatgatcaacctcgaccctgcgacacacgccacatatttctgtgcgtacggtttcttctacaatatagcagctcgtcggcgtattgactcgtgggccacgggacctggtccaccgtctcctcncgtccttaccaccgacggcccatcccgtccttcccccgtcgg

SEQ ID NO: 245415 - DNA, 582 bp, Homo sapiens
  misc_feature: GYAE6OF01CJIC0.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcgcgctgacctgctccgtctctgggttctcactcagcagtactagaatgggtgtgagctggctccgccaggccccggggaaggccctggagtggcttgcacactatttttcgattgacgaaaaatcctaacaacacatctctagaagaccagagtcaccatcctacaacggacacctacaaaacgccaggtcggtacctacatcgatcaacctgaccctgacggacacacgccactatatttctgtgcgtacgggttttcttcctataaattatagcacgtcgtcggtcggaccgtaatttcgactccgtagggccgtagggaccctggtccacccgttctcctacgtcgtccgttaccaacccgtaacgggcccctagttccccgtcccgttcccccgtccggg

SEQ ID NO: 245416 - DNA, 542 bp, Homo sapiens
  misc_feature: GYAE6OF01B4PFH.18.63.F08.1.454.CMB.1.raw
  modified_base (414)..(414): a, c, t, g, unknown or other
  misc_feature (414)..(414): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagccccggggaaggccctggagtggcttgcacactatttttcgattgacgaaaaatcctacaacacatctctgaagaccagagtcaccatcctccaaggacacctaccaaaagccagtcggtccttaccatgatcaacctggaccctgcggacacagccacatatttcngtgcgtacgggtttctttctacaatatagcagctcgtcgggaccgtaatttcgactcgtgggccacgggaccctggtccaccgtctccncngtcctccaccgacggcccatcccgtcctccccgtcgg

SEQ ID NO: 245417 - DNA, 546 bp, Homo sapiens
  misc_feature: GYAE6OF01BM401.18.63.F08.1.454.CMB.1.raw
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccggggaaggccctggagtggcttgcacacatttttcgattgacgaaaaatcctacaacacatctctgaagaccagagtcaccatctccaaggacacctaccaaaagccaggtcgtccttaccatgatcaacctggaccctgcgacacagccacatatttctgtcgctacgggtttctttctacaaatatagcagctcgtcgggccgtaattcgactccgtgggccagggaaccctgccaccgtctccncncgccttcccacccgacgggccccactcccgtccttcccccgtcgg

SEQ ID NO: 245418 - DNA, 622 bp, Homo sapiens
  misc_feature: GYAE6OF01EEPUK.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccggggaaggccctggagtggcttgcacacatttttcgattgacgaaaaatcctaacaacacatctctgaacgaccagagtcaccatctaccaaggacacctaccaaaagccaggtcggtccttacatgatacaacctgaccctgcggacacacgccacattattcgtgtcgcgtacgggttttctttcgtactaaatatagcagtctacggtcgggaccgtaagtttcgaccgttcgtcggggccctaaggggtaaccccttcgggtaccctacccggtccttccccgtactaccggtcccgtttaccccaacccggtaacggggtaccccctaccgttcccccggtttccccttcccccccggtaccggg

SEQ ID NO: 245419 - DNA, 552 bp, Homo sapiens
  misc_feature: GYAE6OF01BKJB6.18.63.F08.1.454.CMB.1.raw
  modified_base (410)..(410): a, c, t, g, unknown or other
  misc_feature (410)..(410): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
  modified_base (507)..(507): a, c, t, g, unknown or other
  misc_feature (507)..(507): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacgcccccggggaaggccctggagtggcttggcacactattttttcgattgaacgaaaatcctacaacacatctctgaagaccagagtcaccatctaccaaggacacctaccaaagccaggtgtccttacatgatcaacctcggaccctgcggacacacgcccanattatttctgtgctacggtttcttctanaatntancagctcgtcggcctaagttcgctcgtcgggcctacgggaccctggtccaccggtcctcctcncgccctccaaccgtacggcccctagtccgttccctccccgtccgg

SEQ ID NO: 245420 - DNA, 603 bp, Homo sapiens
  misc_feature: GYAE6OF01D08RK.18.63.F08.1.454.CMB.1.raw
  modified_base (489)..(489): a, c, t, g, unknown or other
  misc_feature (489)..(489): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggaaggccctgggagtggcttgcactactattttttcgattagaacgtaaaatcctacaacacatctactagaacgaccagacgtacaccaatcctaccaaacggtaccaacctaaccaaaacgcctaagggtcgtaccctttaaccaatacgacttaccaacctcggaccctggaccggaacacgaacgccaatattattctgtacgtcgttacgggtttcttctacaattnagctagcgtcgtcggactagttcgacgtccgtgggaccagtacggacctcggtccaccgttctcctcaccgtctacccgaccgaacggccctacgttcccgtcccgttcccccg

SEQ ID NO: 245421 - DNA, 556 bp, Homo sapiens
  misc_feature: GYAE6OF01BY9ND.18.63.F08.1.454.CMB.1.raw
  modified_base (449)..(449): a, c, t, g, unknown or other
  misc_feature (449)..(449): n is a, c, g, or t
  modified_base (512)..(512): a, c, t, g, unknown or other
  misc_feature (512)..(512): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccgacggcccccggggaaggccctggagtggcttgcacactattttttcgattgaacgaaaaatcctacaacacatctctgaagaccagagtcaccatctccaaggacacctaccaaaagccaggtcggtccttaccatgatcaacctgaccctgcggacacagccacatacttctgtgctacgggtttctttcgtacaaatatancagctcgtcgggccgtaatttcgactccgtcgggccacgggaccctggtccaccgtctcctcncgccttcccaccgtacggccccattcccgtcttcccccgtcggg

SEQ ID NO: 245422 - DNA, 654 bp, Homo sapiens
  misc_feature: GYAE6OF01BNB65.18.63.F08.1.454.CMB.1.raw
  modified_base (190)..(190): a, c, t, g, unknown or other
  misc_feature (190)..(190): n is a, c, g, or t
tcagtacgagtatgcacgaccggtgctcgatttagcgatcgtataagggggtacgtcctggtgccccaccactcggacgtaccacttttgctacactactcctgctgctgaccaccccttcctgggtcttgtcccaggtcaccttggaaggtgtctggtctgtgtctggtgaaacccataagagaccctnacgctgacctgctccgtctcgtgggttctcgactcagcagtactaggaactgggtgtgagcctggcctcccgccgaccggcccccggggaaggccctggacgttggtcttgacactacttattttttcgatttacggaacggtaaaaactccctaacgaaccacagtacgtctagaagaccagacgtcacctatacgtaccaagaccaacctaacaaagccaggtcgttacctacatagactcgaacgtcggaccctggaccgacaccacgcccactaattactttctagtacgtaccgttacggttttccttactactaatatacgcagtccgtccggtcgggaccgttaagttcgaccgtcggacgggaccgtacgggtaccctcggtaccgtaccgtcgtccgtacgcgtacctacccgaaccgtaccggaccctacgttcccgtcccgtccccggtccgg

SEQ ID NO: 245423 - DNA, 795 bp, Homo sapiens
  misc_feature: GYAE6OF01C41QA.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctcgtgggttctcactcagcagtactaagaagtggggtgtggagcgtggcctccggcccgacgggcccccgggggaaggccccgtgggacggtcggcttcgacctactactttattttttacgattacgaaacgtaaaaactccctaaacaaccacacttcctacgtacgaacgaccagtacgtaccaccacttacctaccgaaacggaccaaccctaaccgaaaacggaccgtacgggtacgttaccttaaccgactacgtaactaccaaccgtcggacccgtcgaccggacaccacgacctaactattactttcgtaggtcgtccggttacgggttttctttacgtaacctaaattactaacgccgtacgtccgttacgggtaccgggtaccgttaacgtttcgtaacccggttcccgggtacgggggacccggtaaccggggttaaccccgtccgggttacccgtacccggtttcccgttacccgttaccggacccgtttaccccgtttaccccggaaaccccgggttaaaccccggggtaccccccttaaccgggtttcccccccttccccggtttacccccccggtcccggggg

SEQ ID NO: 245424 - DNA, 655 bp, Homo sapiens
  misc_feature: GYAE6OF01DCCNA.18.63.F08.1.454.CMB.1.raw
  modified_base (414)..(414): a, c, t, g, unknown or other
  misc_feature (414)..(414): n is a, c, g, or t
tcagtacgagtatgcacgaccggtgctcgatttagcgatcgtataagggggtacgttccggtagtggacccaccatcgggacccacgactttgcgtacacacgtcctgctgcctggacccaccccttcctgggtcttaggtcccacggtccaccttgaaggagtctggtcctggtgcgtggtacggaaacccacagagaccctcacgctgacctgctccgtctctgggttctcactcagcagtactagaatgggtgtgagctggcctccgccacggcccccggggaagcccgtggagtggcttgcacactatttttcgattgacaaaaatcctaacaacacatctctagaagaccaagactcaccaatctacaaggacacctaaccaaagccagtcgtaccttacgaactgacncaaccgtcggacctcgacggacaccacgaccactattactttacgtcgtgtccgttacgggttttcctttactacttaatatacggtcacgtccgtccggtcgggaccgttagtttaccggtaccgtccggtcggggtccgtaacgggtaaccccgtcggtccgtaaccgttccctccctcgacgtcccttaccgaacccgtaccgggaccctcttaccccgtcccgtttccccgtcccgg

SEQ ID NO: 245425 - DNA, 593 bp, Homo sapiens
  misc_feature: GYAE6OF01ANRN0.18.63.F08.1.454.CMB.1.raw
  modified_base (427)..(427): a, c, t, g, unknown or other
  misc_feature (427)..(427): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaagtgggtgtgagctggctccgccacggccccggggaggccctggagtggcttggcactactattttttcgattgaacgtaaaaatcctaacaacacatctctgaagaccagagtcaaccatcctaccaaggaccaacctaccaaaagccgagtcggtcctacatgactcaacctgaccctgcgacacagccacattattctgtntccgtacggtttccttactactaaatagtagcacgtcgtcggtccggtccgtaatttcgtacgtcccgtgggacccgtacgggtaccctggtaccgtacccgtccttccctccactcccgtaccaacccgtacggaccctacgtcccctcccgttccccgtccggg

SEQ ID NO: 245426 - DNA, 643 bp, Homo sapiens
  misc_feature: GYAE6OF01DFD8W.18.63.F08.1.454.CMB.1.raw
  modified_base (329)..(329): a, c, t, g, unknown or other
  misc_feature (329)..(329): n is a, c, g, or t
  modified_base (387)..(387): a, c, t, g, unknown or other
  misc_feature (387)..(387): n is a, c, g, or t
tcagtacgagtatgcacgaccggtgctcgatttagcgatcgtataagggggactcctgtgccccaccatggacacactttgctacacactcctgctgctgaccaccccttcctggtcttgtcccaggtcaccttgaaggagtctggtcctgtgctggtgaaacccacagagaccctcacgctgacctgctccgtctctgggttctcactcagcagtactagaatgggtgtgagctcggcctccgcccgacggcccccggggaaggccctgggagtcggcttgcacgtactatttttcgattagaacgtaaaatcctaacaacacatctntgaacgaccagagtcacatctacaaggaccacctaccaaagccaggtcgtcctacatnactcactcgacctgacgacacacgaccatattattctagtcgcgttacggttttcttacgtactaattatacgactacgtccgtccggtaccgggaccgttaagttcggtaccttccggtacggggacccgtaaccggggtaacccgttccgggtccgaacccggttccttcccgtacgtccgtacccgtttacccgaaacccggtaaccggaccccgtacgtttccccccgttacccttccccccggtacccggg

SEQ ID NO: 245427 - DNA, 640 bp, Homo sapiens
  misc_feature: GYAE6OF01D8QI4.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggaagccctggagtggcttgcacactatttttcgattgaacgaaaatcctacaacacatctctgaacgaccagagtcaacctatcctaccaaaggaccaacctaccgaaaaacgcccgtaaggtcgtacccttaccagtcgactacaaccgtcggaaccctggaccggacacgacgcctactattatttctgtcgtcgtacgggttttctttcgtaactaaattatacgactagtctaccggtacgggaccgttaactttcgaccttccggtcggggacctacggggtaaccctcggtaccacccgttcctcccgtactacggtacccttacccgacccggtaacgggtcccctaacgttccccgtcccgttcccccgtccggg

SEQ ID NO: 245428 - DNA, 782 bp, Homo sapiens
  misc_feature: GYAE6OF01C7EUI.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggcctccgccgacggccccggggaaggcccgtggagtggcttgcactactatttttcgattagaacgaaaatcctaacaacacatctactagaacgaccaagacgtaccacctatacctaccgaaacggaccaaacccgtacccaaaaacgcccgtaagggtttacggttacccttaaccgacgttagtaactacccgtaaacccgttacgggaccccgttagggacccggaaccaacccgaacggacccctaaacgtaactttacgttttacgttaggtcggttacccgtttacggggtttttccctttacctaacttaaagtttactaacggccgtaacggtcccgttaccgggtacccgggtaccgttaatttcgggaacccttcccggggtacggggacccgtaaccggggtaacccccttgggtacccgtaacccggttcccgtacccgttctaaccggtacccctttaaccccggaacccggtaacccggggtacccctaccgtttaccccccggtcccccgtttccccccggtcccggg

SEQ ID NO: 245429 - DNA, 755 bp, Homo sapiens
  misc_feature: GYAE6OF01CR0FK.18.63.F08.1.454.CMB.1.raw
  modified_base (139)..(139): a, c, t, g, unknown or other
  misc_feature (139)..(139): n is a, c, g, or t
  modified_base (167)..(167): a, c, t, g, unknown or other
  misc_feature (167)..(167): n is a, c, g, or t
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (290)..(290): a, c, t, g, unknown or other
  misc_feature (290)..(290): n is a, c, g, or t
tcagtacgagtatgcacgaccggtgctcgatttagcgatcgtataagggggactcctgtgcccacatggacacactttgctacacactcctgctgctgacccaccccttctgggtcttgtcccaggtcaccttgaaggngtctggtcctgtgctggtacaaacccanagacgaccctnacgctgacctgctccgtntcgtggtctcactcagcataacgtagaagtgggtggtagagtcgcggtcgccgaccgacggccccggggaacggccgtggaggtgtcgttaganactactatttttacgtattagaacgaaaactacctacaaacacaattctactagaaacgaaccagacgtactaaccaactactaaccgaaacggaaccaacctaaaccgaaaacgacgtacggtacgtaccttacatagctaacaccgtacgccgtacgcggactaacacgaccaactagtactttactcggtagttacccgtacggggttttactttaccttaactaaagttactacgtaccgacgttccgggttaccgggttaccggggtaaccggttaacgtttacccggtaaccgtttcccgggaacgggggtaacccgtaaccggggttacccggtaccgggtacccttaaacccggtcccttaacccgttacggtaccgtacccggtttacccaaacccgggtaaacccgggtccccttaaacccgtcccccgtttcccggttaacccccggtcccggg

SEQ ID NO: 245430 - DNA, 614 bp, Homo sapiens
  misc_feature: GYAE6OF01EXQYZ.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccgacggccccggggaaggcccgtggagtggcttgcacactatttttcgattagaacgaaaactcctaacaacacatctctagaacgaccagagtcaccactcctaccaacgaccacctaaccaaaacgccgaggtcgtaccttaccatacgactccaaccgtcggaccctcggaccgaccacacgaccactattactttctgtcgtacgtcggttttcttctactaatatagcagtctcggtcggtacctagtttcgacgttccggtcggggccgacgggtaacccgttcggtaccctacccgtcctcctccgacgtcccttacccgaacccgtacgggcccctagttccccgtcccgtcccccgtccgg

SEQ ID NO: 245431 - DNA, 641 bp, Homo sapiens
  misc_feature: GYAE6OF01A4ANZ.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggccccggggaaggccctggagtggcttgcacactatttttcgattgaacgaaaactcctaacaacacatctctgaagaccagacgtacaccatctccaaggacacctaccaaaagccaggtcgtcctaccatgatacaacctcggaccctgacggacacgacgaccactattactttcgtgtcgccgtacgggttttcctttctactaaattacgtacgcacgtccgtcggtcgggtaccgtaagtttcggaccgttccggtacggggcccgtaacggggaaccccgttcgggtaccctacccgggttcccttcccgttccgacggttccccttaccccgaacccgtaaccggggcccctacgttcccccgttcccgtttccccccgtccggg

SEQ ID NO: 245432 - DNA, 682 bp, Homo sapiens
  misc_feature: GYAE6OF01DHQXU.18.63.F08.1.454.CMB.1.raw
  modified_base (514)..(514): a, c, t, g, unknown or other
  misc_feature (514)..(514): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctcgtgggttctcactcagcagtactagaagtgggtgtgagcgtcggcctccgccgacggcccccggggaacgcccgtggacgtggcttggcactactatttttaccgagttacgaacgtaaaaactaccctaacaaaccacaacttcctacgtagaacgaccagaacgtcacctatcctaccgaacggaccaacctaaccaaaacgaccgacggtacggtcctaacctatacgtactacctaaccgtcggacccgtcgacgaacacacgaccactattacttctgtgtcttacggtttctacgtactaatacgtacncgtagtccgtacggtccgggtaccgttaagttcgaccgttaccggtcggggaacccgtacgggtacccgtcggttacctacccgttccgtacccttcgaccgttccttaccccgaacccggtaaccgccccgtaacgttcccccggttccgtccccccggttacccgg

SEQ ID NO: 245433 - DNA, 549 bp, Homo sapiens
  misc_feature: GYAE6OF01B9SN1.18.63.F08.1.454.CMB.1.raw
  modified_base (419)..(419): a, c, t, g, unknown or other
  misc_feature (419)..(419): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccaggcccccggggaagccctggagtggcttgcacactattttttcgattgaacgaaaaatcctacaacacatctctagaagaccagagtcaccatctccaaggacacctaccaaaagccaggtcggtcctaccatgactcaaccgtgaccctgcggacacacgccacatatttcngtgctacgggtttcttctactaatatagcagcttcggtcggcgtattgacgtccgtgggaccacgggaccctggtccaccgtctcctcacgcttccaaccgtacggccctatcccgtccgtccccgtcgg

SEQ ID NO: 245434 - DNA, 649 bp, Homo sapiens
  misc_feature: GYAE6OF01BRC5J.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaagtgggtgtgagctggcctccgcccacggcccccggggaaggccctggagtggcttgcactactattttttcgattggaacgaaaaatcctaacaacacatctactgaagaccagagtcacatctaccaagacacctacaaaagccaggtcgtcctacatgatcaacctggacctgcgacacacgaccacattatttctgtcgtcgtaccggttttctttactactaaattagtagaccgagtccgttcgggttaccgggtaccgttaaagtttccgtaacgttccccggtacgggggtacccgtaaccggggtacccccttcgggtaccctaccccgttccgttccccgtacgtaccggtacccgttacccgaacccgtaaccggggccccctaacgttccccggttccccgtccccccgtcggg

SEQ ID NO: 245435 - DNA, 566 bp, Homo sapiens
  misc_feature: GYAE6OF01APJ8M.18.63.F08.1.454.CMB.1.raw
  modified_base (326)..(326): a, c, t, g, unknown or other
  misc_feature (326)..(326): n is a, c, g, or t
  modified_base (340)..(340): a, c, t, g, unknown or other
  misc_feature (340)..(340): n is a, c, g, or t
  modified_base (428)..(428): a, c, t, g, unknown or other
  misc_feature (428)..(428): n is a, c, g, or t
  modified_base (484)..(484): a, c, t, g, unknown or other
  misc_feature (484)..(484): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagacccctcacgctgacctgctccgtctctgggttctcactcagcagtactagaatgggtgtgagctggcctccgccacgccccggggaaggccctggagtggcttgcactactattttttcgattgacgaaaaatcctacaacacatctctgaanaccagacgtcaccntctccaaggacacctaccaaaagccaggtcggtccttaccatgactacaacctcggaccctgcggacacacgacccatacttatttcngtgccgttacggttttcttcctactaatatagcagcctacgcggtctattgctcgngggccacggacctcggtacaccgtcctcctcaccgtcctaccgacccgtaacgggcccctatccccgttcttcccccgtcgg

SEQ ID NO: 245436 - DNA, 677 bp, Homo sapiens
  misc_feature: GYAE6OF01B0487.18.63.F08.1.454.CMB.1.raw
tcagtacgagtatgcacgaccggtgctcgatttagcgatcgtataagggggactcctgtgccccaccatggacacactttgctacacactcctgctgctgaccacccttctggtcttgtcccaggtcaccttgaaggagtctggtcctgtgctggtacgaaacccacagagaccctcgcgctgacctgctccgtctctggtctcactcagcagtactagatgggtgtgagcgtgctccgccgacggacccgggaaggcctggacgtggcttgctacgtacttatttttcgattagaacgtaaaaactcctaacaacacatctctaggaacacagagtacaaccataccaccaaaggaacctaaccaacaaaacgcgtaacggtcgtaccttaacgattacgactacgaaccgtcggacccgtgaccggaacaacacgaccctaatacttaattccgttagtcgtaacgttaccgggttttacttacgtaactaaacgtacgttagacgtacgccgtaccgggtcggtaaccgtagtttacgaccgtttccggacgggacccgtaacgggtaaccctcgggtaccaacccggttcctacccgttacgaacccgtcctttacccggaaacccgacggtaccccgttaacccgtcccgtttccccgttaccccgtccggg

SEQ ID NO: 245437 - DNA, 612 bp, Homo sapiens
  misc_feature: GYAE6OF01E0D3N.18.63.F08.1.454.CMB.1.raw
  modified_base (415)..(415): a, c, t, g, unknown or other
  misc_feature (415)..(415): n is a, c, g, or t
  modified_base (451)..(451): a, c, t, g, unknown or other
  misc_feature (451)..(451): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccgacggcccccggggaaggccctggagtggcttgcacactatttttcgattgacgaaaaatcctaacaacacatctctgaacgaccagagtcaccatctaccaaggacacctaccaaagccaggtcggtcctacatgatacactgacctgcgacacagccacattatttcngtcgcgttacggtttctttactacgtaaatatacgnacgcttcgggtccggaccgtaagtttcgaccttccgtacgggggacccacggggtaccccttgggtaccctaacccggtccttcccgtaccgtacgtcccttaccccgaaaccgtaccgggtaccccctacgtttccccgtccccgttccccccgtccggg

SEQ ID NO: 245438 - DNA, 1037 bp, Homo sapiens
  misc_feature: GYAE6OF01CON4H.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctctgggttctcactcagcagtactagaagtgggtgtgagcgtggcctcccgccgacggcccccggggaagcccgtggagtggcttcgcactacttattttttcgattacggaaaccgtaaaaacttacccctaacaaacctactaacttcctacgtaggaaacgaccaagtacgtaccaacccgtactaccgtacccgaaacggaccctaaccccgttaaacccgaaaaacggcccgtaacggggtttaccggttacccctttaaccgtaacgttacggtaaaccttaccccgtaaaccccggttaccgggacccccgttacgggaacccgggaacccaacccgtaaccgggaaccccctaaaccgttaaccttttaacgtttttacccggtttacgggttaccggttaaccccgggttttaacccgggggtttttttacccctttttacccgtttaacccgttaaaaacgtttaacgttaacgggtaccgttaaccgggttacccggtttaccccgggggtttacccgggggttaaccccggtttaacggtttttacccgggttaaccccgggtttacccccggggttaccggggggtaaacccccggttaaaccccgggggggtttaacccccgttaccggggttaccccgtaacccccgggttttccccgttaccccccgttacccggttaacccccgggtttacccccggtttaaccccccggtaaaacccccccgggttaaaaccccggggggtaccccccctttaaaccccccgggttttaccccccccggttttcccccccggttttaccccccccgggttaccccccggggg

SEQ ID NO: 245439 - DNA, 650 bp, Homo sapiens
  misc_feature: GYAE6OF01C5A7V.18.63.F08.1.454.CMB.1.raw
tcagtacgagtatgcacgaccggtgctcgatttagcgatcgtataaggggggactcctgtgccccaccatggacacactttgctacacactcctgctgctgaccaccccttcctggtcttgtcccaggtccaccttgaaggagtctcggtacctgtgctggtagaaacccgacagagaccctcacgctgacctgctcgtctcgtggttctcactcagcagtactagaagtgggtgtgagctggctccgccgacggcccccggggaagcccgtggagtcggcttcgacactactagtttttcgattagaacgtaaaactcctaacaacacatccactgaagaccaagacgtccacactactacgaaggaccaccaccaaaagccgaggtacgtacctaacatcgactacaacctcggacctgacgacacagaccatattgttctgtcgcgttacggtttctttacgtacttaatacgtacgactacgtacgtccggtacgggtaccgtaacgttcgaccgttccggtacggggacccgtaaccggggtaaccctcgggtacccacccggttccttaccgtacgtacgtacccgttaccgaacccgtaaccggtacccctaccgttccccgttccccgttacccccgtccgg

SEQ ID NO: 245440 - DNA, 659 bp, Homo sapiens
  misc_feature: GYAE6OF01ETNHD.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctgctccgccacggcccccggggaaggcccgtggagtggcttgcacacatttattggagtgataataagcgactacagcccaatctactgaagagcgaggctaccgaccataccaaccgaacggaccaaccctaacccaaaaaccgtaggtacggttacccttaacaactacgaaccaaactacgtacggaacccttaggtaacgaaccaccgagggaccagtacttaattactagtcgtaccaactacgaggtacgtagaattaccttaagtaagtagtaaacgttacgtcgggggttacgtttaggtaccgttacggtaccggggaccgtaacggggtaacccgttcggtacccgtaccggttcccgttcccaccgtacgtcccgtaacccgacccgtaacgggcccctaacggttcccccgg

SEQ ID NO: 245441 - DNA, 894 bp, Homo sapiens
  misc_feature: GYAE6OF01D0RN2.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgcgtggtagaaacccacagacgaccctcacgctgacctgcctccgtctcgtgggttctcactcagcagtactagaagtgggtgtgagcgtcggcctcccgaccggaccgggccccggggaacgcccgtgggagtggtcttgaccacttaactttagtttttcgattagaaaccgtaaaactcctaacaacactactctacgtagaacgacagactcaacctacgtacaccgaaacgaccaaccctaacgaaaacggcccgtaagggtttccggttaacccttaacctacgtacgtaaccgtaccgtaaacccgttcgggtaaccccgtcggacccggaacccaaaccgtaacccgaacccgtaacttaaacgttttaaccgtttcgtcgggtttacccggtaccggtttttaaccggggttttttccctttttaacggtaaaacccttaaagttaacgttacggtaccgtaaccggttcccggtttacccggggttacccgggttaccgtttaaccggttttacccggtacccggtttaccccgggttaccgggggtaaccccggttaaaccggggttaacccccgttaccgggttaccccgttacccccgttccgtacccccgttaaccgaaccccgggtttaccccgtacccccggaaacccgggtaacccgggttaccccccttaaccccggtttccccccttttaaccccccccgttccccgggttcccccccgggg

SEQ ID NO: 245442 - DNA, 615 bp, Homo sapiens
  misc_feature: GYAE6OF01BVTXW.18.63.F08.1.454.CMB.1.raw
  modified_base (483)..(483): a, c, t, g, unknown or other
  misc_feature (483)..(483): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctctgggttctcactcagcagtactagaatgggtgtgagctggctccgccacggccccggggaaggccctggagtggcttgcactactatttttcgattacgaacgtaaaactcctaacaacactatctctagaacgaccagacgtacacctactacctaccaacggacctaacctaaccaaaacgccgtagggtcgttacccttacatcgactacaaccgtcggaccctggaccgacacacgccatattacttctgtcgacgttacggtttcttacgtactaaatntagcagtctcggtcggacgtattcgacctccggtcgggaccgacgggtacctcggtacctaccgtcctccacgtcgtcccttaccgaaccgtaaccggtcccaaccgttcccgtccccgttccccggtccgg

SEQ ID NO: 245443 - DNA, 721 bp, Homo sapiens
  misc_feature: GYAE6OF01D6PIP.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctcgtggttctcactcagcagtactagaagtgggtgtgagcgtggcctccgccgacggcccccggggaaggcccgtggagtggcttgcactacttatttttcgattacgaacgtaaaactcctaacaaccactactctctagaacgaccagacgtacaccgatcctaccgaaacggacctaaccctaaccaaaacgcccgtaagggttcggttacccttaaccaacgtacgaaccttacccgtaaacccgtaccgggtaaccccgttacggacccggtaaccaaccgtaccgaccaaccttaatttactttcgtagttcggtaccgttaccgggtttttcctttactaactaaattacgtaacgtccgacgtccgttacggtaccgggtaccgttaagtttcgtaccgtaccggtcgggacccgaaccgggtacccgtcggtaccctacccgttccgttccaccgtacgtcccgtacccgaaccggtaccgaccctaccgttccccttcccgttccccgtcccggg

SEQ ID NO: 245444 - DNA, 760 bp, Homo sapiens
  misc_feature: GYAE6OF01BX5ES.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctctggttctcactcagcagtactagaagtgggtgtgagcgtggcctccgccgacggccccggggagccctggagtggcttgcacactatttttcgattagaacgaaaatcctaacaacactatctctagaacgaccagacgtaccacctaatcctacccgaaacggtacccaaccctaacccgaaaacggcccgtaacgggttcgggttaccctttaacccgaattacgaaccttaccgaaacccgtccgggtaaccccgtcgggacccggaacccacgaccgacccaacgtatttaacttttcgtggttaccgtaccgttaccggggtttttcctttaccgtaactaaagttacgtaacgcgtacgtccgttccgggtaccgggtacccgttaagtttccggaccggttcccgggtacggggaccccgtaacggggtaaccccgttcgggtacccgtaccccggttccttaccccgtaccgtccgtacccttaccccggaacccggtaacccgggtaccccctaccgttccccccggttccccgttccccccggtacccggg

SEQ ID NO: 245445 - DNA, 820 bp, Homo sapiens
  misc_feature: GYAE6OF01B6Z7T.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctctggttctcactcagcagtactagaagtgggtgtgagcgtggctccgccgacggcccccggggaaggcccgtgggagtgggccttcgcgtaccactattttttcgattagaaccgaaaatacctaacaacacacttctctagaacgaccagacgtcacctatacctaccaacggacacctaaccaaaacggcccgaggtcggtacctaccatgaactacctaacgtacggtacccgtcggaccggactaacgcgaccaactattactttaccgtgtaccgtccgttaacgggttttttcctttaaccgtacttaaaagttacgttaacgccgttaacggtccggtttacccgggttacccgggggtacccggtttaaatttttacccggggaaccttttacccccggggtaccgggggtaacccggtaccgggggtaaaccccccgtttcgggtacccccgttaaacccgggtttccccttccccccgtttaaccggttcccgggttacccccgttttaacccccggaaaccccggggttaaacccccgggtaccccccgtttaaccccggtttccccccggtttaccccccggttttcccccccccggtaaaccccggggg

SEQ ID NO: 245446 - DNA, 712 bp, Homo sapiens
  misc_feature: GYAE6OF01DAJWP.18.63.F08.1.454.CMB.1.raw
  modified_base (479)..(479): a, c, t, g, unknown or other
  misc_feature (479)..(479): n is a, c, g, or t
tcagtacgagtatgcacgaccggtgctcgatttagcgatcgtataagggggactcctgtgccccaccatggacacactttgctacacactcctgctgctgaccaccccttcctggtcttgtcccaggtcaccttgaaggagtctggtcctgtgctggtgaaacccacagagaccctcacgctgacctgctcgtctctgggttctcactcagcagtactagaatgggtgtgagctggcctccgccgacggccccggggaaggcccgtggagtggcttgcacgtacttatttttcgattagaacgtaaaaactcctaacaacactactctctagaacgaccagtaacgtccaccgtatccactaacggaaccaacctaaccgaaaacgcccgtaagggttcggttaccttaacctaagtcgaacttaccgaaccgttcggaccctagggaccgaaccgacacgtaccactattactttcgngttcggtaccttacgggttttcttactacgtaaacttagacgtactaggttccgtaccgggttccgggaaccgtttaacgtttcgaccgttcccggtacgggggtcccgtaaccgggtaacccgttcgggtacctaccccgggttcctacccgtccgtaaccgttccccgtaacccgaaccccggtaaccgggtccctaccgtttcccccgttccgttccccccgttaccggg

SEQ ID NO: 245447 - DNA, 637 bp, Homo sapiens
  misc_feature: GYAE6OF01B1VGU.18.63.F08.1.454.CMB.1.raw
  modified_base (170)..(170): a, c, t, g, unknown or other
  misc_feature (170)..(170): n is a, c, g, or t
  modified_base (608)..(608): a, c, t, g, unknown or other
  misc_feature (608)..(608): n is a, c, g, or t
tcagtacgagtatgcacgaccggtgctcgatttagcgatcgtataagggggactcctgtgccccaccatggacacactttgctacacactcctgctgctgacccaccccttcctgggtcttgtcccaggtcaccttggaaggagtctggtcctgtgctggtgaaacccanagacgaccctcacgctgacctgctccgtctcgtggttctcactcagcagtactagaagtgggtgtgagtcgtggcctccgccgaccggcccccggggaaggcccgtgggacgtggcttcgcacgaactttatttttacgattacggaaacgtaaaaactacctaacaaaccaactactcctactagaaacgtaccagactaccaccactcctaacgaacggaccaacctaaaccaaaacgccgtaagggtccgttaccttaaccatacgactacgtaaccgtacggaccctcggaaccgacaccacgaccctaatactttattcgtgtcgtacgttcggtttcttactaactaatgtagcagtccgtcggtcggacgtagttcgacgtcggcggcgacggtacccgtgcctaccgtctcctctcctcctaccgaaccncggacctccgtcccgttcccgtcccgccg

SEQ ID NO: 245448 - DNA, 848 bp, Homo sapiens
  misc_feature: GYAE6OF01CADQT.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtcgaaaccccacagacgaccctcacgctcgacctgctccgtctcgtcggttctcactcagcagtactagaagtgggtgtgagcgtcggccgtcccgaccgacggacccccgggggaacggcccgtgggaggtcggtacgttcgaccgtacctaactttacgtttttttacggactttacggaaaaccgtaaaaaactccccttaaacaaaacctaccacttacctacgttagaaacgaccgaaggtacgtaccctaacctactaccgtaaccaaacggaaccaacccgtaaaccgaaaacgcccgtaacggtttacgtacccttaaccgaagtacgtaactaccgtaacccgtacggtacccgtacggaccgaacacgacgactaacgtatttacgtttcggagttccggtacgtttacccgggtttttctttaccgtaaacgttaacttacggtacgaccgtaacggttcccgtacggggttacccgggtacccgtttaaggtttccggaaccgttcccgggtacggggtaccccgaaaccgggttaccccggtccggttaacccgtcccgttacccgttaccccgtacggttaccccgtaccggtttaaaccccccgaacccggtaaacccgggtacccccttaacggtttcccccccgtttaccccgttccccccggtacccccggg

SEQ ID NO: 245449 - DNA, 719 bp, Homo sapiens
  misc_feature: GYAE6OF01EQQR4.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctctggttctcactcagcagtactagaagtgggtgtgagtctcggcctccgccgaccggcccccggggaaggccctgggagtggcttgcactactatttttcgattagaacgtaaaactcctaacaacactatctcgtagaacgaccagacgtccaacctactcctaccgaacggaaccaacccgtaacccgaaaacggtcccgagggttacggttacccttaccagttacgactaccgtaacccgtcggacccgtgaccgacaccgacgacctaacgtattaactttcgtagtcgtaccggtttaccggttttactttaccgtaactaattacgtaacgcctacggtaccgttccgggtaccggtacggttaacgttttccggaaccgttccggtaccggggccctaacggggtaaccccttcgggtaccccttacccggttcccttacccgtacgtcccggtaccctaccccgaccggtaccggcccttacccgtccccgtttcccgtccccccgtccggg

SEQ ID NO: 245450 - DNA, 832 bp, Homo sapiens
  misc_feature: GYAE6OF01DUP9B.18.63.F08.1.454.CMB.1.raw
tcagtacgagtatgcacgaccggtgctcgatttagcgatcgtataagggggactcctgtgccccaccatggacacactttgctacacactcctgctgctcgacccacccccttccgtgggtcttgtcccaggtctaccttggaaggtagtctggtcctgtgctggtacgaaacccacagacgaccctcacgctgacctgctccgtctcgtggttctcactcagctagtactaagtaagtgggtgtgagcgtcggccgtccgaccggaaccggggacccccgggggaacggtcccgtaggggacggtcggtcttacgacctaacttacgtttactttttacgacgttaacgaaacgtaaaactacctaaacaaacctaactactacgtacgtaacgaaacgaaccaagtacgtaccaaccgtactacccgtaaccgaaacggaaccctaaccgtaaaacgaaaacccggtcgtaacgggttacccggtaaccctttaacgtaacgttacgtaaaccggtaaccttaaacccggtaccgggtaacccgtaccgggaccgaaccaaccggtaaccacctaaacttaacgtttaccgttgttaccggtacggttacccgggtttacggttttacctttaacgtaaactaaacgtagtaccgtacgacggtaccgttaccgggaccggtaacgtttacgttacgtaccgtccgggacggggtaacccgacgggttacccgtcggtacccgtacccggtcctacgtaccgtccgtaccctaacccggaaccccggtacgtcccgtacccgttacccggttccccgttcccggacccgg

SEQ ID NO: 245451 - DNA, 681 bp, Homo sapiens
  misc_feature: GYAE6OF01DXOOH.18.63.F08.1.454.CMB.1.raw
  modified_base (510)..(510): a, c, t, g, unknown or other
  misc_feature (510)..(510): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaagtgggtgtgagctggcctccgccgaccggccccggggaaggcccgtggaggtcggcgttgcactacttatttttcgtattacgaacgtaaaactacctaacaacactactctactagaacgaccaagacgtacaccacgtacctacaacgacacctacaaaacgccgagtacgtaccgtacatcgtactacgaaccgtcggacctcggacgaaccaccaacgtccaactaatttacgttactaggttcgtaccgttacgggtttttcctttaactacttaaacttntaacgctacgtcgtccgggtacggtacctaagtttaccgacgttcccgggtcgggtaccggaccgggtaaccccgtcgggtacccgacccggttccttacccgaccttccgaccgttaccccaaccggtacccgggaccctaccgttccccgtccccgttccccggtccgg

SEQ ID NO: 245452 - DNA, 667 bp, Homo sapiens
  misc_feature: GYAE6OF01DJPQ4.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctggtcttgtccaggtcaccttgaagagtctggtcctgtgctggtacgaaacccacagacgaccctcacgctgacctgcctccgtctcgtgggttctcactcagcagtactagaagtgggtgtgagctggcctccgccgacggcccccgggaagccctggagtggcttgcacacttattttacgattagaacgaaaatcctaacaacactatcctactagaacgacagacgtacaccatacctacgaacgaccacctaaccaaacgccgtagggtaccgtaccttaccaagtcgtactaccaaccgtcggaaccctgaccgacacacgaccaactacttactttcgtgtcggtacgtacggttttctttactacgtaactatacgacgtacgtcgtcggtacggtaccgttagttcgaccgttccggtacgggacccgtaccgggtaacccgtcggtcccgtaaccggttccctcccgttacggtaccgtacccttaacccgaacccggtaccggacccgttacccgtacccggttccccgttcccccgtcccggg

SEQ ID NO: 245453 - DNA, 733 bp, Homo sapiens
  misc_feature: GYAE6OF01B1Q7J.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtagaaacccacagacgaccctcacgctgacctgctccgtctcgtggttctcactcagctagtactagaagtgggtgtgagcgtggcctccgaccgacggaccccggggaacggcccgtggaggtcggtcttgcactacttactttttcgagttagaacgtaaaactcctaacaacactatctactagaacgaccgagtacgtacaacctactaccgtaccgaaacggaacctaaccgtaaccgaaaacggcccgaacgggttacggttaccctacgaattacgaactaccgtaaccgtccggtacccgtaggaccggaaccacgacgtacctaacttacgttactttcgtagtcggttaccttacgggttttcctttacgtaactaaagtacgtagacgtacgtccgttaccgggtacggtaccgttaaagtttccgaccggttccggtacggggaccgtaaccggggtaaccccgttcgggtacccgtacccgttcctacccgttacgcgttacccctaccgaacccggtaccggtacccccttagttcccccggttccgttcccccgtccggg

SEQ ID NO: 245454 - DNA, 854 bp, Homo sapiens
  misc_feature: GYAE6OF01A1GWC.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaagtgggtgtgagctggcctccgccgaccggaccccggggaacggcccgtggagtggcttgcactactatttttcgattgaacgtaaaatcctaacaacacatactctagaacgaccagacgcaccctaatcctaccaaacggtaccaacctacccgaaaaacgacccgtaacgggttaccggttacccctttaaccaacgttacgtaaaccttaacccgtaaaccccgttacccgggtaaccccgttcggaaccccgggaaccgaaccccgaacgggtaaccccctaaccgttaaatttaaccgtttttaccgttagggtttaccggttacccggttttaaccggggttttttcccttttaccttaaaccgttaaaatttaacgtaacgtaccgtaaacggttccgttacccggggttaccggggtaaccccgttttaaaggttttaccgggtaccccgttacccggggttaccgggggacccggtaaaccccggggttaaaccccgtttccgggtacccttaacccggtttcccttcccgtacccgtaccgtccccgtttaccccggaaccccgtaacccgggtaccccgttacccgttccccggtttcccccgttcccccggtcccggg

SEQ ID NO: 245455 - DNA, 702 bp, Homo sapiens
  misc_feature: GYAE6OF01CEMBG.18.63.F08.1.454.CMB.1.raw
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
tcagtacgagtatgcacgaccggtgctcgatttagcgatcgtataagggggactcctgtgccccaccatggacacactttgctacacactcctgctgctcgaccaccccttcctgggtcttcgtcccaggtcaccttggaaggagtctggtcctgtgctggtacgaaacccacagacgaccctcacgctgacctgctccgtctcgtggtctcactcagcagtactagtagtgggtgtgagcgtcggcnccgccgaccggaccccggggagccgtggagtgtctgacactagttnttttacgattacgaaacgtaaaactcctaacaacactacgtctcgtaagaacgacagtacgtccaacgtctaccgtaccaacgacccaacctaacgaaaacgtccgaggttaccggtcctaacagtctaacgtccaacccgtcggtaccgtcgaccgtaaccaccgacgacctaacgtatttcgttacgtggttaccgttaccgtttaccggttttattaccgtaacttaagtacgtacgtacgcgtaccgttccgggtaccggtacgtttacgtaccggtccgttaccggacggtaccgaacggtacccgtccgtaccgtacccgtcctcccgttacgaccttaccgtaaccccgaacggttaccccgaccttacccggttcccttacccccggtccgtaccccggg

SEQ ID NO: 245456 - DNA, 697 bp, Homo sapiens
  misc_feature: GYAE6OF01D7X2D.18.63.F08.1.454.CMB.1.raw
  modified_base (333)..(333): a, c, t, g, unknown or other
  misc_feature (333)..(333): n is a, c, g, or t
tcagtacgagtatgcacgaccggtgctcgatttagcgatcgtataagggggactcctgtgccccaccatggacacacttttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaagtgggtgtgagctggcctccgccgacggcccccggggaaggcccgtggagtggcttgcactactatttttcgattagaacgtaaaatcctaacaacacatctctgaanaccagagtcaccatctaccaaggacacctaccaaacgccaggtcggtacccttacatgactacaaccgtcggaccctgtaccggacaccgacgaccactattactttctgtcgtcgttacggttttctttacgtacaaattactagcgtacgtcgttacggtccgggtacgttaacgtttcggtaaccgttccgggtcggggacccgtaaccggggtaaccccgttcgggttacccgtaccccgttcccgttcccgttacccgtacgttacccccttaaccccggaaccccggtaaacccggggtaccccccttaaccccggttttcccccgtttacccccgtttcccccccggtcccccgggg

SEQ ID NO: 245457 - DNA, 647 bp, Homo sapiens
  misc_feature: GYAE6OF01ENE4A.18.63.F08.1.454.CMB.1.raw
  modified_base (168)..(168): a, c, t, g, unknown or other
  misc_feature (168)..(168): n is a, c, g, or t
  modified_base (509)..(509): a, c, t, g, unknown or other
  misc_feature (509)..(509): n is a, c, g, or t
  modified_base (581)..(581): a, c, t, g, unknown or other
  misc_feature (581)..(581): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccanagacgaccctcacgctgacctgcctccgtctcgtgggttctcactcagacagtactagaagttggggtgtggagcgtcggcctccggaccgaccggggacccccgggggaaggcccgtagggacgtcggtacttcgacactacttagtttttcgattagaactaaaactcctaacaacactactctactagaacgacagtacgtacacctactacctaccgaacgaccaacctaacaaacgccgaggtacgtcctacgatagactacaccgtcgacctcgacgacacacgacactagttacttgtgtacgtcgttacggttttcttactactaatagtacncgtacgtcgtaccggttcggtaccgttagtttccgacgttacgggcgggtaccgaggtacccgtcgtacccnccgtcctacactacgtactacccgaaccggtaccgtacctaccgtcccgttcccgtccccgtccgg

SEQ ID NO: 245458 - DNA, 727 bp, Homo sapiens
  misc_feature: GYAE6OF01D2YFV.18.63.F08.1.454.CMB.1.raw
tcagtacgagtatgcacgaccggtgctcgatttagcgatcgtataagggggactccggtgtgcccacatggacacactttgctacacactcctgctgctgaccacccttctgggtcttgtccaggtcacttgaagagtctggtctgtgctggtgaaccacagagaccctcacgctgacctgctccgtctctgggttctcactcagcagtactagaatgggtgtgagctggcttccgccgacggtccccggggaaggtcccgtggagtcggcttcgacctacacgtatttttaccgattacgaacgtaaaaacttccttaacaaacactactctacgtcgaacgacctaaggtacgtacacctaacttcctaccgaaacggacctaacccgtaaccgtaaaaacgtcccgaagggttacggttacccttaacctactacgtaacttaccaaaccgttcggaacccgtcgaccggaacaccgaacgacctaactagttaactttcgtagttcgtacttacgggttttacttctactaaattacttacgacacgtacgtcgtaccgggtacttacgttttacgaaccgttccggtacggggaccgtaacggggtaacccgttcgggtaccctacccggttccttacccgtacgtaccgtcccgtttacccaaccccgggtaacgggtaccccctaccggtttaccccgttcccgttccccccggtccggg

SEQ ID NO: 245459 - DNA, 782 bp, Homo sapiens
  misc_feature: GYAE6OF01EXIDQ.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctcgtggttctcactcagcagtactagaagtgggtgtgacgcgtcggcctccgacccgaccgggaccccccgggggaacggcccgtggaggtcggtcgttcgacctacctaactttacgttttttcgtaagttagaaaccgtaaaaactcctaacaacactacgtctacgtacgaacgaccagacgtaccaacctactacctaccgaacggacctaacccgtaaccaaaacgtccggtacgggttaacgttacccttaaccgaagttacgaacgttaacccaaccgtccgggacccgtacggacccggaaccaacggtaaccgaccccttaactaactttacgtttacggttacgttaccgggtcgttttaacccgggtttttcctttacttaacctaaatacgttacgcgtaacgtccggtacgggtacccggggtaaccgtttaagtttccggaccggttacccgggtacggggacccgtaaccggggtacccgttcgggtaccctaccggttcccttaccgtcgtcgcccttacccgaccgtaccgggtcccctaccggttccccgtcccgttaccccggccg

SEQ ID NO: 245460 - DNA, 794 bp, Homo sapiens
  misc_feature: GYAE6OF01EF3DD.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtacgaaacccacagacgaccctcacgctgacctgctccgtctcgtggttctcactcagcagtactagaagtgggtgtgagcgtggcctccgccgaccggcccccggggaacgcccgtgggacgtggtcttcggactacctactttattttttacggactttagaaaccgtaaaaacttaccctaaccgaaaccaaccgtacttccgttacttaacggaaacgtaacccgaacggtacgtacccaacctacgtacctaacccgaaacggaaccctaacccgtaaaccgaaaacgtacccgacgggttaccggttacccttaaccgtagttacgaacttaccgtaaacccgttccggacccgtcgacccggtaccaaccgacgacctaactatttacttcttgtccggtacgtttaccgggttttacctttactaactaaacttacgtagccgtagtccgttaccgggtaccgggtaacgttacgtttaccgtaccgttaccgggtacggggtacccgtacggggtaacccttccgggtaccgttaccccgttcgttacccctacggtccgttacccctacccggaacccgtacccgggtacccctacccgtttcccgttccccgttcccccggtcgg

SEQ ID NO: 245461 - DNA, 830 bp, Homo sapiens
  misc_feature: GYAE6OF01EJ35M.18.63.F08.1.454.CMB.1.raw
  modified_base (197)..(197): a, c, t, g, unknown or other
  misc_feature (197)..(197): n is a, c, g, or t
tcagtacgagtatgcacgaccggtgctcgatttagcgatcgtataagggggactcctgtcgccccacatggacactactttgctacacactcctgctgctcgaccctaccccttcgtgggttcttcgtccgaggtcctaccgttaggaaggtcgtcgtggtcctgtgcgtacgtacgaaacccacgagacgaccctnaccgtctacgtacctcgtccttccgttcgttcggttacggttacctcgtaccgtcgacgtacgtaaacgtagtaaggtaggttggtcggtaacgcgtcggtaccggccgtccggaccggacccggggtaccgggacgtccggtaggtcgtcgtcgtacactacgtttacgtttactttagaacgtaacaaaacgttaactaccgaactaacgtatacgtacgtacgaacgaacgtacacggtactaaccggtactaccgttaaccgtaacgaaacccgtaccgtaaaacctaaaacccgtaacggtaccggttacggtaacctaccttaaggacttacgtactacgaacgtccgcgaacgacgtaccgacgtaccgaacgttactttacgttacgttacggtaccggtttacgttacccgggtttaaagtttaccctttaaactaacgttaaaccgtttcgaaccgtacgtaccggttccgaacggttaacggtacgtttaaccgtcggttacccggaacgggttaaccgacgttaaccggtccgttcccgtaactccgttacccacggtactaccgtacccgtacgacccggtcttacccggggtaccctttccggtacccgccggtacccg

SEQ ID NO: 245462 - DNA, 725 bp, Homo sapiens
  misc_feature: GYAE6OF01BWLEX.18.63.F08.1.454.CMB.1.raw
  modified_base (235)..(235): a, c, t, g, unknown or other
  misc_feature (235)..(235): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtacgaaacccacagacgaccctcacgctgacctgctccgtctcgtgggttctcactcagcagtactagagtgggtgngagcgtggcctccgccgacggccccggggagcccgtggacgtggcttgcacgtactttatttttacgatttacgaaacgtaaaaactcctaacaacactatctactaagaacgaaccagacgtaccaacctactaccgtaccgaaacgacccaaccctaacccgaaaagcccgtaggtaccgttaccctaaccgtagtctaactaccaacccgtcggacccgtcggaccgacacgacgacccaattacttagttctggtacgtccgttaccggttttcttacttaataacgttatacgaccgtacgtcccgtacgggttaccggacccttaaagtttccgacccgttccggggtacgggaacccgtaaccgggtaacccgttccgtacccgtaccgttcccttacccgtacgtccgtacccgttacccgaacccggtacccggttacccctaccgtttcccccggtcccctttcccccgggtaccccggg

SEQ ID NO: 245463 - DNA, 716 bp, Homo sapiens
  misc_feature: GYAE6OF01DNHGO.18.63.F08.1.454.CMB.1.raw
  modified_base (646)..(646): a, c, t, g, unknown or other
  misc_feature (646)..(646): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctcgtgggttctcactcagcagtactagaagtgggtgtgagcgtggcctccgcccgacggcccccgggggaaggcccgtggagtggcttgcactacttagtttttcgattagaactaaaaactcctaacaacactatctctagaacgaccagacgtaccaccactcctaccgaagaacccaaccctaaccaaaacgccgtaggttacggttacccttaaccgtatacgtactaccgaacccgtcggacccgtcgaccggaaccaccgaacgaccctaactaactttacgtttctcggttcgtccgttaccgggttttccttacctaactaaacttagtacgtcgacgtcgtaccgggtaccgggtaccgttagttcggtacccgttccgggtccggggacccgtaaccggggtacccgttcggtacccttacccgtcccttacccgtaccnccgtacccctaccccgaacccggtacccggacccctacggttcccccggtccccttcccccggtacccgg

SEQ ID NO: 245464 - DNA, 803 bp, Homo sapiens
  misc_feature: GYAE6OF01CB959.18.63.F08.1.454.CMB.1.raw
  modified_base (140)..(140): a, c, t, g, unknown or other
  misc_feature (140)..(140): n is a, c, g, or t
  modified_base (211)..(211): a, c, t, g, unknown or other
  misc_feature (211)..(211): n is a, c, g, or t
  modified_base (623)..(623): a, c, t, g, unknown or other
  misc_feature (623)..(623): n is a, c, g, or t
tcagtacgagtatgcacgaccggtgctcgatttagcgatcgtataagggggactcctgtgccccaccatggacacactttgctacacactcctgctgctgacccaccccttcgtggtcttgtcccaggtcaccttgaagngtctggtcctgtgctggtacgaaacccacgagacgaccctcacgctcgacctgcctccgtctcgtggttcncactcagtacagttaacgtaagaaggttgggtgtacggacgccgtcgggaccctcccggacccggaccggggaccccgggggaacgtcccgtaggtacggtcggtccttacggacctactacgttttactttttacggaacgtttaacgaaaaccgtaaaaactcccgtaaacaaacctacgtaacgttaccgtacgtaacggaaaccgaacctaacgtaaccggttaccaacctaacgtacctaacccgaaacggtaccctaaaccggtaaacgaaaacgtccggtacggttccgttaaccggttaacacggttacgaacctaaccgtacccgtacgggacctacggacccggtacacgaccgtacacttattacttcgtagtctcgtttaccgttacttacgaacttaancgtacgcgtacgtcgttaccggtaccgtacgttacgtaccgtacggtaccggtccgggtaaccgtaccggtaccgtaccgggttccacccggttacctccgtaaccgtcgttaaccccctaccgggtaacccgaacccggttcccttacccgttccccggttccgtacccccggtcccgg

SEQ ID NO: 245465 - DNA, 1038 bp, Homo sapiens
  misc_feature: GYAE6OF01AD9R7.18.63.F08.1.454.CMB.1.raw
tcagtacgagtatgcacgaccggtgctcgatttagcgatcgtataagggggactcctgtgccccaccatggacacactttgctacacactcctgctgctcgaccctacccctttccgtgggttcctttcgtcccgacggtcctaccgttaggaacggtagttccgttcggttcccttgtcgtccgttagggtaaccgaaaaccccaacgaacggaaccgaccccgtaccgaccgtccgtcgtacccttcggcccgtttcccggttccgttccggtttcgggtttccctaccgtaccgttaccgaacgtaacccgtaagtttaaacgtaacggtaaggggttggggttggtacggtacggtccggttccggtacccgtcccggacccggaccccgggggacccccggggtaaccggtccggtaggtcggttcggtccgttaccgaccttaaccgttacgttttacgtttttacgaacgttaacgtaaaaacctaacctacctaaacctaactacctacttaccgtacgtaaccgaaccgaaccgtacgtaccgtaaccgtaacctaccgtaacccgaaccggtaacccgaaacccgtaaaccccgtaaaccggtaaacccggtaccggttaccgggtttaacccgtttaacccgtaccgttaacgtacgttaaaacccgtaacccggtaaccccggttacccgttaacccggtaccggggaccctaaaccgacccgttaaacccctccggttaaaactttccggtttaccgtttacggtaccggttttaacccggtttacgggtttttaccgttttacctaaacgttaaccgttaataccggttacgtacccgtaacgggtttcccgggtacgggttaccgtaacggtttaccgttccggtacggttacccgggacggtaacccgtacgggtcccgttaccgtacccgtcccgtccgttaccggacttcccgacccggttaaccaccccggggtccctaccccggtttacccgtccccccgtttcggtccccgtcccgg

SEQ ID NO: 245466 - DNA, 747 bp, Homo sapiens
  misc_feature: GYAE6OF01DFHG5.18.63.F08.1.454.CMB.1.raw
tcagtacgagtatgcacgaccggtgctcgatttagcgatcgtataagggggactcctgtgccccaccatggacacactttgctacacactcctgctgctcgacccaccccttccgtgggtccttcgttcccaggtcaccttggaaggagtctggtcctgtgctggtacgaaacccacagacgaccctcacgctgcctgcctccgtctcgtggttctcactcagcagtacgagtagtgggtgtgacgcgtcggtccgtcccggccgaccggggacccccgggggaacggtccccggtgggtacgtcgggtccttaggacctaactactttacgtttttaccgtaagttacgtaaacgtaaaaacttacctaaccaacaactacttaccgtactaggaaccgaaccgtaagaacgtaccaaccctactaccgtaccaacggaccctaacctaaccgaaaccgacgtacgttacgttacctacgtacgtacgtactaccgtacccgtaccggtcccgtacgaccgtacccacgaccgtacctaacttactttacgtttactcggttaccgtacgtttaccggttttaccttacgtacttaacgtcgtacgtacgtcgtaccgtcggtaccggtacgtacgttcgacgtccgggtacggaccggtaccggtaccgtcgtccctaccgtccgtccctcgcttacccgtaccgacccgtcggcccttaccgtcccgtccccgtccgtcccggg

SEQ ID NO: 245467 - DNA, 595 bp, Homo sapiens
  misc_feature: GYAE6OF01B5MGM.18.63.F08.1.454.CMB.1.raw
  modified_base (456)..(456): a, c, t, g, unknown or other
  misc_feature (456)..(456): n is a, c, g, or t
tcagtacgagtatgcacgaccggtgctcgatttagcgatcgtataaggggactcctgtgccccaccatggacacactttgctacacactcctgctgctgaccaccccttcctggtcttgtcccaggtcaccttgaaggagtctggtcctgtgctggtgaaacccacagagaccctcacgctgacctgctccgtctctggttctcactcagcagtactagaatgggtgtgagctggctccgccacggccccggggaagccctggacgtggcttgcacactatttttcgattgaacgaaaaatccgtaacaacacaatcctactagaacgaccagagtcaaccatcgaccaaggacaccgtacaaaagccgaaggtcgtaccttaccatgactacaacctggaccctgcggacacagcactatactttctgtgctaacgggtttcttacttacaattntagcagctcgccggtaccgtaagtttcgactcgtacggggcctaacgggtaaccctgggtcccaaccggtcctcccttcgcgtacccttaccaacccgtaacgggccccaagttccccgttacccgttccccgtccggg

SEQ ID NO: 245468 - DNA, 759 bp, Homo sapiens
  misc_feature: GYAE6OF01AYUX9.18.63.F08.1.454.CMB.1.raw
  modified_base (331)..(331): a, c, t, g, unknown or other
  misc_feature (331)..(331): n is a, c, g, or t
tcagtacgagtatgcacgaccggtgctcgatttagcgatcgtataagggggactcctgtgccccaccatggacacactttgctacacactcctgctgctgaccacccttcctgggtcttgtcccaggtcaccttgaaggagtctggtcctgtgctggtgaaacccacagagaccctcacgctgacctgctccgtctctgggttctcactcagcagtactagaatgggtagtgagcgtggcctccgccgacggcccccggggtaaggcccgtggagtggcttgcacgtacttattttttcgattagaacgaaaactcctaacaacacatctntagaacgaccagacgtaccacctacgtcctaccgaacggaccaacccgtaaccgaaaaacgtccgtaacgggtcggttacccttaacctaagtcgaactaccgaacccgttcggaccctggaccggaaccacgaccgaaccactacttactttacgtggttacgtccgttaccgggttttacctttacgtaactaaagttactaacgtaccgaacggttccgtaccgggttaccggggtaaccgttaacgttttaccggtaccgttcccgggtacggggtacccgtaaccggggtaaccccgttcgggtaccccgtaacccggttcccgttacccgttaccgccgttaccccgttaccccgaaccccgtaaacccggggtccccctaacccgtttcccccggttcccccgtttcccccggtccccggg

SEQ ID NO: 245469 - DNA, 880 bp, Homo sapiens
  misc_feature: GYAE6OF01AKY83.18.63.F08.1.454.CMB.1.raw
tcagtacgagtatgcacgaccggtgctcgatttagcgatcgtataagggggactcctgtgccccacatggacacactttgctacacactcctgctgctgaccacccttcctgggtcttgtcccaggtcaccttgaaggagtctggtcctgtgctggtcgaaacccacagacgaccctcacgctgacctcgctccgtctcgtcggttctcactcacgcacgtactagagtgggtagtgagcgtcggcctccgaccgacggaccccggggagtcccgtggacgtcggctcggactacctacgttacgtttttacgacttacggaaacgtaaaacctccgtaaacaactaccgtacttaccgtactaacggaaacgtaccggtaacgtaccggtacctaacccgtacgtaccgtaaccggaaaccggtaaccctaaccccgtaaacccgtaaaaacggtcccggtaacgggtttacccggtttacccttaaccgtaacgttaccgaaaccgttacccggtaaacccggttacccggtaaccccgttacgggacccggaaccctaaccggtaccgtaacccgtaacgttaacgtttaccgtttacgttcgggttaaccgttacccggttttaacccgggttttcctttaaacccgtaaaccgttaaacggttacgtaaccgtcgtaaccggttccgggttaaccgggttacccgggtaaccgtttacgtttaccggtaccggttcccggggtacgggtaccccgggtaaccgggttacccgttcgggtacccgttacccgggtaccttcccggaccgtaaccccgttccttaacccggacgtacccggtccctaccggttccccgtacccgtcccggtacccgg

SEQ ID NO: 245470 - DNA, 997 bp, Homo sapiens
  misc_feature: GYAE6OF01EWB2P.18.63.F08.1.454.CMB.1.raw
  modified_base (146)..(146): a, c, t, g, unknown or other
  misc_feature (146)..(146): n is a, c, g, or t
  modified_base (178)..(178): a, c, t, g, unknown or other
  misc_feature (178)..(178): n is a, c, g, or t
tcagtacgagtatgcacgaccggtgctcgatttagcgatcgtataagggggactcctgtgccccacatggacactactttgctacacactcctgctgctcgaccctaccccttcgtgggtcctttgtcccaggtcacttggaaggngttctggtcctgtgcgtaggtacgaaacccanagacgaccctcacgcttacgaccttgccgttccgtcgttcgttcggttcctacactcgacgactagtactaggtagtgggtgtgagtcgtcgccgtccggaccggacccgggaccccggggtacgtccggtaggtacggttcggtacgtaccaccgttaacttaacgtttttacgtttttacgaacgttaacgtaaaaaacccgttaaaaccttaccgaaaccaacttacctacgttcctaacggtaaggaacccgacgtaaacggtaccttaacccgaacttaccgaacccgttaaacccgaacgtaaacccgtaaccctaaaccggtaaacggtaccggttacgggtttccccttaaacccttacgtaactttaccggtaacctacccggtttaacccgtacccgggtacccgggttacggaaaccggacctaaacccgtaacggacccttaaatttacgttttaccggtttccgtttagggttacccgggttaaccgttttttacccgggtttaacctttaacttaaaacggtaacgttttaaccgaacggttaccgtcgggttaaccccgggttacgggttaaccccgggtacgtttttaaccggggtttacccacccgggggttttaccgggggtaacccgggttaaaccccggggtaaccgggtttaaccccggtcccggttaaccccgttaccccggttccgttacccgtacccgtttacccggtaccccgtttaaccccggaaccccggtttaacccggttccccgtaaccccgttttccccccggttaacccccgttcccgggtccccgg

SEQ ID NO: 245471 - DNA, 749 bp, Homo sapiens
  misc_feature: GYAE6OF01BY36S.18.63.F08.1.454.CMB.1.raw
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (589)..(589): a, c, t, g, unknown or other
  misc_feature (589)..(589): n is a, c, g, or t
tcagtacgagtatgcacgaccggtgctcgatttagcgatcgtataagggggactcctgtgccccaccatggacacactttgctacacactcctgctgctgacccaccccttcctgggtcttgtcccaggtcaccttgaaggagtctggtcctgtgctggtacgaaacccacgagacgaccctcacgctgacctgcctccgtctcgtggttctcactcagcagtactagaagtgggtntgngcgtggctccgccgaccggaccccggggagcccgtggtacgtcggtcttcgactactacttagttttttacgagttacgaaacgtaaaacttccgtaacaacactacttctacgtacgaacgaaccgagtacgtaccactactcgtacccgaacgtacccaacccgtaaccgaaacgtcccgtacgggttacggtaacccttaacctagtacgaaccctacctaaccccggtaccggtaccccgtacgggacccgtaaccgtaaccgaccgtacccctaacttacgtttaacctttcgttcggtaccggtccggtttaccggtttttacttacgtaactaatcgtaacncgtacgtccgtaccgggtcggtaccgtagttccgtacgtccggtaacgggcccgtaaccgggtaccctcggtaccgtacccgttccgtacctaccgtccgtccctaacccgacccggtaacggttccccaccgtttcccccgtcccgttcccccgccggg

SEQ ID NO: 245472 - DNA, 751 bp, Homo sapiens
  misc_feature: GYAE6OF01AENLY.18.63.F08.1.454.CMB.1.raw
  modified_base (142)..(142): a, c, t, g, unknown or other
  misc_feature (142)..(142): n is a, c, g, or t
tcagtacgagtatgcacgaccggtgctcgatttagcgatcgtataaggggggactcctgtgccccaccatggacacactttgctacacactcctgctgctgacccacccttcgtgggtcttcgtccaggtcaccttgaaggntctggtcctgtgcgtggtacgaaacccctacagacgaccctcacgtctcgaccttgccttccggttctcgttcgggttacctctacgtcaggtacaagtaactaggtaaggtgggtcgtagcgcgtcgtccgtaccggccgacccggggacccggggacggccgtggcgtcggctgacctactactttagttttcagttaaccgaaactaaaacctacctaaccaaactaccaacgttcctacggtaacaacgggaaccacgtacgacctaccagttacccaacggaaaccgtactaacctaaccggaaaacgtcccggtaacggtcgtaacccttaacagtaacctaaccgtaacccgtaccgaccggtacccacggggaactaaccgacctaacgtaccgtacttacgtttaaccttcgtacggttcggttacggtttacccgttttactacccgttaacaacgtactacggcgtacgtaccgtcgggtaacgtccttaggttaccgccgttccggacgggtacctaaccgggtcttaaccggcccacgttcctctacgctacccgtacgacccgtccgacctccgtaacccgttccgtcccgccgg

SEQ ID NO: 245473 - DNA, 756 bp, Homo sapiens
  misc_feature: GYAE6OF01AQCCP.18.63.F08.1.454.CMB.1.raw
  modified_base (690)..(690): a, c, t, g, unknown or other
  misc_feature (690)..(690): n is a, c, g, or t
  modified_base (698)..(698): a, c, t, g, unknown or other
  misc_feature (698)..(698): n is a, c, g, or t
tcagtacgagtatgcacgaccggtgctcgatttagcgatcgtataagggggactcctgtcgccccaccatggacacactttgctacacactcctgctgctcgaccaccccttcctgggtcttgtcccaggtcaccttgaaggagtctggtcctgtgcgtggtacgaaacccacgacggacgacccctcgacgtctacgaccgtcgcctccgtctccgttggttcctctaactcagcgtaagtaacgtaagtagtgggtagtgagcgtcggcctccggccgaccgggccccggggacgccgtggagtcgtcgtcgctacctactttactttttagagttacgtaaaaccgtaaaactccctaaaccaacctactacttaccgtacgtaacgaacgaaccagtaccgtacctaccgtactaccctaaccgaaaccgtaaccctaacccgtaaaccgaaaacggtcccggtaacggtttacccggttaccttaaaccgtctacgtaacctaccgtacccggtaccggcccgtagccggaacccacggaaccgccctaagttactttaacgttcgtcgttaccgtaccggtttaccggttttcttaacctacgtaacgtactacgtcgtacgtcggtacggtccggtaactagttcgtaccgtccggacggaccgtccggacgtccggtacccncggtcccntccgtctacccgtacccgaccgtacccgtcctacccgtccccgtcccgtcccgtccgg

SEQ ID NO: 245474 - DNA, 881 bp, Homo sapiens
  misc_feature: GYAE6OF01CHWIK.18.63.F08.1.454.CMB.1.raw
tcagtacgagtatgcacgaccggtgctcgatttagcgatcgtataagggggactcctgtgccccaccatggacacactttgcctacacactcctgctgctcgaccacccttcctgggtcttgtcccaggtcaccttagaaggtagtctggtcctgtgctggtgaaacccagagacgacctcacgctgacctgctccgtctcgttggtctcactcgagcagtactagaacgtgggtgtgagtcgtcggcctccgacccgaccgggtccccggggaacggtccgtcgggagtcggtcttcggacctaacgttactttagttttttacgagtttacgaaaccgtaaaacgttaccctaaacgaactactacgtcctacgtaacgaacgaccgtaagtccgtacctaccacgttaccgaaccgtaaacggaccctaaccctaaaccgaaacggtccgtaacggtttacgttacccgttaacgagtacgtaactaaccgtaccgtaccggtaccgtaccgaccgggactaaccgaccggtaacctaacgttactttaccggtttacgtcggttacgtacccgggtttaccgggtttttctttaaccgttaacgtaaacgtttacgtaacgtaccggtaacgtcccgggttaccgggttacccgggttaaccgtttaacgggttttcccgaacccggttacccgggggttccggggtaaacccggtaacccgggttaacccggtttccgggtaccccggttaacccgtttccccgtaaccgttaccccggttaacccgttaccccgttaaccccgaaacccggggttacccctaccccgggtttaacccgtcccccggttttacccccggttccccggtaccccggg

SEQ ID NO: 245475 - DNA, 768 bp, Homo sapiens
  misc_feature: GYAE6OF01ANYOS.18.63.F08.1.454.CMB.1.raw
  modified_base (323)..(323): a, c, t, g, unknown or other
  misc_feature (323)..(323): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccgacggccccggggaaggcccgtgggagtcggctgcgactacttatttttcgattagaactaaaactacctacaacacntactctagaacgaccgagacgaccaaccagtcctaaccgaacggaccaacccgtaaccgaaaacgccgtacgggtacgtacccttaacgtatacgaactacccgtaaccgtcgtaacccgtacggaccggtaaccaccgacgacctacgtaacttagtttcctggtaccgtaccggtttaccggtttttccttacgtaacctaaacgttacgtacgtaccgtacggtccgttcccgggttaacccgggtaccgttaaacgtttccgacccggttaccgggtaccggggtacccgggtaaccgggtacccgttcggggtcccctaacccgggttccctaccccttacggtacccgttacccggttaaccccgtaaacccccgggtaccggggttaccccctaacccgggtttcccccgtttccccccggttccccggtaccccggg

SEQ ID NO: 245476 - DNA, 810 bp, Homo sapiens
  misc_feature: GYAE6OF01DL72X.18.63.F08.1.454.CMB.1.raw
  modified_base (88)..(88): a, c, t, g, unknown or other
  misc_feature (88)..(88): n is a, c, g, or t
  modified_base (126)..(126): a, c, t, g, unknown or other
  misc_feature (126)..(126): n is a, c, g, or t
  modified_base (742)..(742): a, c, t, g, unknown or other
  misc_feature (742)..(742): n is a, c, g, or t
tcagtacgagtatgcacgaccggtgctcgatttagcgatcgtataagggggactcctgtgccccaccatggacacactttgctacacnctcctgctgctcgaccctcccttcgtggtcttcgtccnggtccacttagaaggtgtctggtcctgtgcgtaggtacaaacccagtacgacaccctcacgctcgtacctcgtccttccgttcgttccggttcggttacctccgtaccgtacacgtaacgtaacggttaacgttaagggtaagggttcggggttggtaccggtacggtccgggtccgggtaaccccgtcccgggaccccgggaaccccgggggccccgggggtaaccggtccccggttaggggtcggttccggtacgttacgacgttaaccgtttcttttaacgttttacgtacgtaaacgaaaacgttaaaccttacctaaaccacgtactacttcgtacgaacgtaacacgtacgacctaccactacgtaccgaacgaaccgtaacctaaccgaacgtaaccgtcgttacggtaccgttactaactacgtacaccgttaccgaccgtaccggaccacggacgaccgaaccgccgtactacttacgtttactcgttcgttacggttacgtttacggtttactactaataactacgtcacgtacgtccgtacgtcgtacgtgtaccgtcggtccggacggaccgtcgtcccgacgttccgtacccgtcgttacccncgttacccgacctaaccgggtaccctaccggtccctaacccggttcccgttaccccgtcgtaccccgg

SEQ ID NO: 245477 - DNA, 687 bp, Homo sapiens
  misc_feature: GYAE6OF01BXKIE.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtagaaacccacagacgaccctcgcgctcgacctgcctccgtctcgtggttcctcactcagcagtactagaagtgggtgtgagctggcctccgccgacggccccggggagcccgtggagtcggtcttcgctactacttagtttttacgacgttaaggaaacgtaaaaactacctaacaaacacgtactactacgtaacgaagaccgaagacttacgaacctaacttccgaccgaaacggtaccaaccgtaaccaaaacggccgtaacggtacggttaccttaaccagttacgacttaaccgaacgtcgaccgtgaccgacacctagcctaacgtattacgtttcgtagtcggtacgtttaccggttttactaccttaacaacgttagactaccgagtccgtacggtaccggtaccttagtccgtacgtccgtacgggactaccgggtaaccctcggtaaccgtcccgtacctcctacgtctacccgtacaaccggtacccggcctacccgtttcctcccgttcccgccgg

SEQ ID NO: 245478 - DNA, 879 bp, Homo sapiens
  misc_feature: GYAE6OF01A1RVW.18.63.F08.1.454.CMB.1.raw
  modified_base (144)..(144): a, c, t, g, unknown or other
  misc_feature (144)..(144): n is a, c, g, or t
  modified_base (301)..(301): a, c, t, g, unknown or other
  misc_feature (301)..(301): n is a, c, g, or t
tcagtacgagtatgcacgaccggtgctcgatttagcgatcgtataaggggggactcctgtgccccaccatggacacactttgctacacactcctgctgctgacccacccttcgtgggtcttcgtcccaggtcaccttggaaggngtcgtgtcctgtgctggtacgaaacccagagacgaccctcacgctcgacctgcctaccttctcgttcggttcctacactcagtactagtacgtaagtaggttggtgtgacgtcgtcgccgtccgaccggaccgggacccgggaacggtccgtacggnggtcggtctcgaccgtacgttattttacgttttacgtacgttaacggtaaacgtaaacttaccgtaacaacctacgtacttacgtacgtacggtaacgaccacgtacgtacctaaccgtactaccgtaaccaaaccgtaccaaccgtaaacgaacgtccgtacggtaccttacctacatacgacgtacgtaaccgtcgtacctccggaacgaccaaccacgtaacctacgttaactttcgttacggttccgtacgttaaccggtttacggtttaccttaaacggttaaactaacgttcgtaacgtaccgtaaacgggttcccggttaaccggggtttacccgggtaaacctttacgggttaaccccggtcccggggttaacccggggtaccccgggtaaacgggttaacccccgggttaacccggtcccggtttaaccccgtttaacccgggccgtttacccccggttaacggtaaccccgttaccccgttaaacccccgggaacccgggtttaaaccccgttccccggttaaaccccgtttccccccgggtttaccccgttccccgggtaccccggg

SEQ ID NO: 245479 - DNA, 882 bp, Homo sapiens
  misc_feature: GYAE6OF01EHB5Q.18.63.F08.1.454.CMB.1.raw
  modified_base (215)..(215): a, c, t, g, unknown or other
  misc_feature (215)..(215): n is a, c, g, or t
tcagtacgagtatgcacgaccggtgctcgatttagcgatcgtataagggggactcctgtgccccaccatggacacactttgctacacactcctgcctgctcgacccaccccttcctgggttcttgtccccaggtcaccttgaagagtctggtcctgtgctgggtacgaaacccacagacgaccctcacgctgacctgctcgtctcgtggttctcnctcagcagtacgtagaagtgggtcgtgagcgtcgcctccgccggaccggccccggggaacgccgtagggaggtggtcgttacggacctaccttacgtttaacgtttttcggtaatttaacggaaaaccgtaaaaacctccccgttaaacaaacctaaccgtaactacttacgtacgaaaccgaaccgtagtacgtaccgtaacctactacccgtaacgtaaccggaacctaaccccgtaaaccgaaaacgtacccggttaacgggtaccgttaccctaacgtaacgtacgtaacgtacccgtaaccgtaccggtacccgtacgggaacccggtacctaaacccgtacgacccgtaactttaactttaccgtttcgttacgggttaccgtacgggttttacccggttttttaaccttaccgttaactaaacgtttacgtaaccggtaccttacggtaccgggttacggttacccgggttacggttaacctttaccggtaccgggttccggtaccggggtaacccggtaacccggggtccggtaaccggtccctaacccggttccctttaacccgaccggttaaccttccccggttaaaccccgaaacccggttaccccggtacccgtaccccgtttacccccgttccccgttccccggtacccccggg

SEQ ID NO: 245480 - DNA, 639 bp, Homo sapiens
  misc_feature: GYAE6OF01BGNV6.18.63.F08.1.454.CMB.1.raw
  modified_base (232)..(232): a, c, t, g, unknown or other
  misc_feature (232)..(232): n is a, c, g, or t
  modified_base (497)..(497): a, c, t, g, unknown or other
  misc_feature (497)..(497): n is a, c, g, or t
  modified_base (531)..(531): a, c, t, g, unknown or other
  misc_feature (531)..(531): n is a, c, g, or t
tcagtacgagtatgcacgaccggtgctcgatttagcgatcgtataagggggactcctgtgccccaccatggacacactttgctacacactcctgctgctgaccacccttcctgggtcttgtcccaggtcaccttgaaggagtctggtcctgtgctggtgaaacccacagacgaccctcacgctgacctgcctccgtctctgggttctcactcagcagtactagaagtgggtntgagcgtggcctccgccgaccggccccggggaacggcccgtggacggtggtcgttcgacgactactttatttttacgattacgaaacgtaaaactcctaacaactacgactctactagaacgaccagtacgtccaccgtactcctaccgaacggaaccaccgtaaccgaaacgcccgtacgggtcgttaccttacgagtcgtaactaccgtaaccgtcggtacccgtggaccgaactacggacctaccaacgtattactttacgnggtacgtcgttacgggtttctactacaatagacncgtcgcgtcggtcggactacgttcgcctcggcggccgtacggacccttcgcctcgtcctcctcgcctcgtacccgacgtaccgcctacgtccctcccgtcccgtccgg

SEQ ID NO: 245481 - DNA, 695 bp, Homo sapiens
  misc_feature: GYAE6OF01EZYT8.18.63.F08.1.454.CMB.1.raw
  modified_base (545)..(545): a, c, t, g, unknown or other
  misc_feature (545)..(545): n is a, c, g, or t
  modified_base (555)..(555): a, c, t, g, unknown or other
  misc_feature (555)..(555): n is a, c, g, or t
tcagtacgagtatgcacgaccggtgctcgatttagcgatcgtataagggggactcctgtgccccaccatggacacactttgctacacactcctgctgctgaccaccccttctgggtcttgtcccaggtcaccttgaaggagtctggtcctgtgctggtacgaaacccacagacgacccctcacgctgacctgcctccgtcttcgtcgggttctacactcagctagtactagtagtgggtgtgagtctcggcctcccggccgaccgggacccccgggggaacgtcccgtagggacggttcggtcttaggacctactacgttttatttttaccgagttacgaaacgtaaaactcctaaccaacactatactacagtaacaccagaccgtacacctactaccgtaaccgaacggaccctaaccctaacgaaacggccgtacggttccgtaaccctacagtacgtactacgtaacccgtcgtacccgtcgacgacctacacgacctaagtactttatttactggtacgttcgtttacgttttcctttanactaatgtangtacgtcgtcggtaccgtacgttacttcgcctccgggtcggaccgtacggtaccgtcgtccgtaccgttccgtacctacgtcctacccgttacccgaacccggtaaccgtccctaccgtccccttccgtccccccgtcgg

SEQ ID NO: 245482 - DNA, 747 bp, Homo sapiens
  misc_feature: GYAE6OF01D70SQ.18.63.F08.1.454.CMB.1.raw
  modified_base (199)..(199): a, c, t, g, unknown or other
  misc_feature (199)..(199): n is a, c, g, or t
tcagtacgagtatgcacgaccggtgctcgatttagcgatcgtataaggggggactcctgtgccccaccatggacacactttgctacacactcctgctgctcgacccacccccttcctgggttccttcgtcccaggtcaccttggaaggagtctggtcctgtgctggtacgaaacccacagacgaccctcacgctgcctncctccgtctcgttggttctcactcagcagtaactaggaagtgggtgtgacgtcgtcggcctcccggacccggacccggggacccccgggggaacggtcccggtgggtaggtcggtcttcggacctacttactttagtttttacgtaagttacgtaaaaccgtaaaactacctaaaccaactactactctacgtaagaacgacgagacgtaccacctactaccgtaccgaaaccggaaccaacctaaaccgaaaacgtccgtagggttaccgttacccgttaacactacgtactaaccgtaaccgtcggaccgtcgacgacgacacgactacgttacttacgttctgtacgtcgtttacggttttctttacaacgtaatatacgacgtcgtcgtacgggtacggtaccgttaagttccggtaccgtcgggaccgggtaccggaccggtacccgtcggtacccgtaccgttcctacgtaccgtaccgtcccgtaacccggacccgtacccgcccgttacccgttccccgttccccgtccccggtccccgg

SEQ ID NO: 245483 - DNA, 547 bp, Homo sapiens
  misc_feature: GYAE6OF02JCN6Y.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccggggaaggccctggagtggcttgcacacattttttcgattgacgaaaaatcctacaacacatctctgaagaccagagtcaccatctccaaggacacctccaaaagccaggtggtccttacatgatcaacctggaccctgcggacacagccacatatttctgtgctacgggtttctttctcaaatatagcagctccgtcgggccgtaatttcgaccttccgtggggccagggaaccctggtccaccgtctcctcacgtcttccaccgacgggcccatcccgtccttcccccgtcgg

SEQ ID NO: 245484 - DNA, 547 bp, Homo sapiens
  misc_feature: GYAE6OF02JDYYX.18.63.F08.1.454.CMB.1.raw
  modified_base (500)..(500): a, c, t, g, unknown or other
  misc_feature (500)..(500): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccggggaaggccctggagtggcttgcacacattttttcgattgacgaaaaatcctacaacacatctctgaagaccagagtcaccatctccaaggacacctccaaaagccaggtggtccttaccatgatcaacctggaccctgcgacacagccacatatttctgtgctacgggtttctttctcaaattatagcagctcgtcgggccgtaatttgactccgtgggccagggaaccctgtcaccgtctcctcncgtccttcccgaccgtaacggcccactcccgttccttcccccgtcgg

SEQ ID NO: 245485 - DNA, 565 bp, Homo sapiens
  misc_feature: GYAE6OF02IP4ZF.18.63.F08.1.454.CMB.1.raw
  modified_base (516)..(516): a, c, t, g, unknown or other
  misc_feature (516)..(516): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggagccctggagtggcttgcacactattttttcgattgaacgaaaaatcctaacaacacatctctagaagaccagagtcaccatctaccaagacacctacaaagccaggtcgtaccttacatgactcaaccgtgaccctgcggacacagtccacattattctgtgacgtacggttttctttactacaaatatagacagtcctcggtcgggacctaatttcgactccgtgggaccagggtaccctggtccaccgtcctccncacgtccttcccgaacgtacggcccctatccccgttcttcccccgtcgg

SEQ ID NO: 245486 - DNA, 550 bp, Homo sapiens
  misc_feature: GYAE6OF02ICAKZ.18.63.F08.1.454.CMB.1.raw
  modified_base (407)..(407): a, c, t, g, unknown or other
  misc_feature (407)..(407): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccggggaaggccctggagtggcttgcacacattttttcgattgaacgaaaaatcctaacaacacatctctgaagaccagagtcaccatctccaaggacacctaccaaaagccaggtggtcctaccatgatcaacctggaccctgccgacacagccanatatttctgtgctacgggtttctttctctaaattatagcagtctcggtcgggacctaatttcgacttccgtgggccagggaccctggtcaccgtctcctcacgtccttccgaccgacgggccctatcccgtcctccccgtcgg

SEQ ID NO: 245487 - DNA, 561 bp, Homo sapiens
  misc_feature: GYAE6OF02IRB44.18.63.F08.1.454.CMB.1.raw
  modified_base (442)..(442): a, c, t, g, unknown or other
  misc_feature (442)..(442): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccgggaggccctggagtggcttgcacacatttttcgattgacgaaaaatccctaacaacacatctctgaagaccagagtcaccatcctaccaaggaccaacctaccaaaagccgaaggtggtccttaccatgatcaacctggaccctgcgacacagccacatattctgtgctacgggtttctttctcaaatntagcagctcggtcggaccgtaagttgacttccgtgggccgagggaaccctggtccaccggtctccctcacgtccttacccgaccgtacgggccctacgtcccgttccttcccccgtcgg

SEQ ID NO: 245488 - DNA, 557 bp, Homo sapiens
  misc_feature: GYAE6OF02HDDB8.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggaaggccctggagtggcttgcacactatttttcgattgacgaaaaatcctacaacacatctctgaagaccagagtcaccatctccaagacacctaccaaagccaggtgtccttacatgactcaacctggaccctgcgacacacgccacattattctgtgcgtacgggtttcttcttacaaatatagcagctcggtcggacgtaattcgactcgtcgggccgagggaccctggtccaccgtcctcctcgtacgtcctaccgacccgaacgggcccacgttcccgtcccttcccccgtccgg

SEQ ID NO: 245489 - DNA, 574 bp, Homo sapiens
  misc_feature: GYAE6OF02ICWL7.18.63.F08.1.454.CMB.1.raw
  modified_base (459)..(459): a, c, t, g, unknown or other
  misc_feature (459)..(459): n is a, c, g, or t
  modified_base (529)..(529): a, c, t, g, unknown or other
  misc_feature (529)..(529): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacgcccccggggaaggccctggagtggcttgcacactattttttcgattgaacgtaaaaatccctaacaacacatctctgaagaccagagtccaccatcctaccaaggaccacctaccaaaagccaggtcggtacctaccatgatccaacctggaccctgaccggacacgacgccactattacttctgtgcgttacggtttctttcactaaatntagctagctacggtcgggcctaatttcgaccttcgtgggccacgggtaccctggtccaccggtctcctcncgtccttccaccgtacggccctacgtcccgttcctcccccgtcgg

SEQ ID NO: 245490 - DNA, 629 bp, Homo sapiens
  misc_feature: GYAE6OF02IN3N1.18.63.F08.1.454.CMB.1.raw
tcagtacgagtatgcacgaccggtgctcgatttagcgatcgtataagggggactcctgtgccccaccatggacacactttgctacacactcctgctgctgaccacccttcctgggtcttgtcccaggtcaccttgaaggagtctggtcctgtgctggtgaaacccacagacgaccctcacgctgacctgctccgtctcgtgggttctcactcagcagtactagaatgggtgtgagctggcctccgccacggcccccggggaagccctggagtggcttgcacactatttttcgattgaacgtaaaaatccctaacaacacatctctagaacgaccagacgtccaccatcctaccaacgaccaccctacaaaacgccgaggtcggtccttaccatgactcaaccgtcggaccctgaccggacacacgaccactattactttctgtcgccgttacgggttttctttctactaaattactagacagtccgttcggtccgggaccgttaagtttcgaccgttccggtacggggacccgtaacgggtacccgttggtaccgtacccgtcttcccgtctaccgtcccttacccgaaccgacgggcccctacgtccccgttcccttcccccgtcggg

SEQ ID NO: 245491 - DNA, 565 bp, Homo sapiens
  misc_feature: GYAE6OF02GK3SS.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacgcccccggggaacggccctggagtggcttgcacactatttttcgattgacgaaaaatcctacaacacatctctgaagaccagagtcaccatctccaaggaccacctaccaaaagccaggtcggtccttaccatgatcaacctcggaccctgcgacacagccacatatttctgtgctacgggtttctttctacaaatatagcagccgtcgtcgggaccgtaatttcgaccttccgtggggacccagggacccgtggcctacccgtctcctcacgtccttccgaccgaacgggccctactcccggtcccttccccgtcgg

SEQ ID NO: 245492 - DNA, 771 bp, Homo sapiens
  misc_feature: GYAE6OF02HCOAG.18.63.F08.1.454.CMB.1.raw
  modified_base (282)..(282): a, c, t, g, unknown or other
  misc_feature (282)..(282): n is a, c, g, or t
  modified_base (316)..(316): a, c, t, g, unknown or other
  misc_feature (316)..(316): n is a, c, g, or t
tcagtacgagtatgcacgaccggtgctcgatttagcgatcgtataagggggtacgttccggtcgtgcccacccagtggtaccacactttgtctacactactcctgctgcgtgaccaccccttcctgggtcttgtcccaggtcaccttgaggagtctgggtcctgtgctgggttcgtaaacctacagtacgtaacccgtcaccgctgacctggctccgtacgttcgtgggttctcggactctagtcagtactaggaatcgggtgtagagtctcggctcgaccncgcccgggaagcctggagttgcttcgcagtactnttttcgattggacgaaaactacctacaacgtacgatcgtcgtagaacaccagtacgtccaacctactcgtacaaggacctaccgtaacctaaaacgaccgttaaggtcggtaccttaaccgagtacgacgtacctaaccgttcggacccgtcgaccggtaccaacgaacgacccaaacgtaacgttactttacgtacggttacgtaccgttaccgggttttcttttaccgtaacgttaaaattacgtaacgtaccgtacgtaccggttacggttaccgggtaccgtaaacgttttcgaccgttaccggtacgggtacccgtaacgggtacccgttacgggttaccgttacccggttaccttaccgttaccgtacccgttcccgttaccccgtaaccggttaaccggtaccccgtaacggtttaccccgggttaccccgtttacccccggtccggg

SEQ ID NO: 245493 - DNA, 536 bp, Homo sapiens
  misc_feature: GYAE6OF02FSF7G.18.63.F08.1.454.CMB.1.raw
  modified_base (414)..(414): a, c, t, g, unknown or other
  misc_feature (414)..(414): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacgcccccggggaaggccctggagtggcttgcacacatttttcgattgacgaaaaatcctacaacacatctctgaagaccagagtcaccatctccaaggacacctccaaagccaggtggtccttaccatgatcaacctcgaccctgcgacacagccacatatttctgtncgtacgggtttcttctacaaatatagcagctcgtcggcagtatttgactccgtgggccagggaccctggcctaccgtctcctcacgtccttccaccgacggcccactcccgtcttccccccg

SEQ ID NO: 245494 - DNA, 583 bp, Homo sapiens
  misc_feature: GYAE6OF02GLPM1.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacgcccccggggaaggccctggagtggcttgcacactattttttcgattgacgaaaaatcctacaacacatctctgaagaccagagtcaccatctccaagacacctacaaaagccaggtcgtccttacatgatcaacctgaccctgcggacacacgccacatatttctgtcgctacgggtttctttctacaaatatacgctagcttcggtccgggtacctaagttttcgaccttccggtcggggacccaacggggtaccctggtccaccggtcctccctcacgtccttacccaccgtaaccgggcccctaacgtccccgttccgttcccccgtccggg

SEQ ID NO: 245495 - DNA, 558 bp, Homo sapiens
  misc_feature: GYAE6OF02HZ40D.18.63.F08.1.454.CMB.1.raw
  modified_base (383)..(383): a, c, t, g, unknown or other
  misc_feature (383)..(383): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacgcccccggggaaggccctggagtggcttgcacacattttttcgattgaacgaaaaatcctaacaacacatctctgaagacccagacgcaccatctccaaggaaccacctaccaaaagccaggtggtccttaccatnatcaaccctgaccctgcgacacagccacattatttctgtgcgtacggtttctttctcaaatatagcagtctacggtcgggcctaatttcgactccgtgggaccagggacccctggtccaccgtctcctcagtccttccgaccaacgggccccattccccgtccttccccgtccgg

SEQ ID NO: 245496 - DNA, 662 bp, Homo sapiens
  misc_feature: GYAE6OF02H6V3Z.18.63.F08.1.454.CMB.1.raw
  modified_base (459)..(459): a, c, t, g, unknown or other
  misc_feature (459)..(459): n is a, c, g, or t
tcagtacgagtatgcacgaccggtgctcgatttagcgatcgtataaggggggactccgtgtgccccaccatggacacactttgctacacactcctgctgctgaccaccccttcctgggtcttgtcccaggtcaccttgaaggagtctggtcctgtgctggtgtaaacccacagagaccctcacgctgacctgctccgtctctgggttctcactcaggcagtactagaatggggtgtgagctggctccgccgacggcccccggggaaggccctggagtggcttgcactactattttttcgattgaacgaaaactcctaacaacacatctcgtagaagaccagacgtccactatccgtaccgaaggaccaaccctaccaaaacgccgaggtcggtaccttacctatcgactccaacctcggaccctgcggaacacacgacccaacattaatttctacggtntacgtaccggtttctttacctactaaatacagacgagtcctcggtccgggaccgtaagtttcgaccgttccggtacggggaccgtaacggggtaccctacggggtcctaacccggttccttccgtaccgtaacggttccctttacccgaaccggtaacccgggacccctaccggtttccccgttccccgttaccccgtccggg

SEQ ID NO: 245497 - DNA, 568 bp, Homo sapiens
  misc_feature: GYAE6OF02F5C0G.18.63.F08.1.454.CMB.1.raw
  modified_base (375)..(375): a, c, t, g, unknown or other
  misc_feature (375)..(375): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccggggaagcccctggagtggcttgcacactatttttcgattgacgaaaaatcctaacaacacatctctgaagaccagagtcaccatctccaaggacacctaccaaaagccaggtgtcctacatnatcaacctgaccctgcgacacagccacatattctgtgctacgggtttcttctactaaatatagcagtctcggtccgggtaccgtaatttcgacttccgtcggggcccaacggggtaccctggtccaccggtcctcctcgtacgtccttacccgaaccgacgggcccctacgtccccgttccttcccccgtcgg

SEQ ID NO: 245498 - DNA, 608 bp, Homo sapiens
  misc_feature: GYAE6OF02HO6JN.18.63.F08.1.454.CMB.1.raw
  modified_base (457)..(457): a, c, t, g, unknown or other
  misc_feature (457)..(457): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggaaggccctggagtggcttgcacactatttttcgattgaacgaaaaatcctaacaacacatctctagaagaccagagtcaccatctccaaggacacctacaaagccaggtcgtccttacatagactacaacctggaccagtacgcggaaccacacgacccaactattactttctggtagtccttacgggttttccctttnttaccaaattanacganacgtcgttcggtccgggaccgtaatttcgaccgtccgtacggggcctaacgggacccgtggtccaacccggttcctcctacgaccgtcttcccgaacccgtaccgggcccctacttccccggttccttcccccg

SEQ ID NO: 245499 - DNA, 550 bp, Homo sapiens
  misc_feature: GYAE6OF02I44H6.18.63.F08.1.454.CMB.1.raw
  modified_base (451)..(451): a, c, t, g, unknown or other
  misc_feature (451)..(451): n is a, c, g, or t
  modified_base (479)..(479): a, c, t, g, unknown or other
  misc_feature (479)..(479): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggaaggccctgggagtggcttgcacactattttttcgattgaacgaaaatcctacaacacatctctgaacgaccagacgtcaccatcctaccaaggaccacctaccaaaagccaggtcgtccttaccatgatcaacctcggaccctgccgacacagccacatatttctgtgcgtacgggtttcttctactaaatntagcagctcggtcggctaattgactcgnggcagggacctggtcaccgtctcctcgacgccttaccgaccgtacggcccacgtcccgtcctccccgtcgg

SEQ ID NO: 245500 - DNA, 736 bp, Homo sapiens
  misc_feature: GYAE6OF02IX0S5.18.63.F08.1.454.CMB.1.raw
  modified_base (291)..(291): a, c, t, g, unknown or other
  misc_feature (291)..(291): n is a, c, g, or t
tcagtacgagtatgcacgaccggtgctcgatttagcgatcgtataaggggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctggttctcactcagcagtactagaatgggtgtgagctggcctccgccgacggcccccgggggaacggcccgtggagtggcttcgcactactntttttcgattagaacgtaaaatcctaacaacacatctactagaagaccagtacgtaccaacctatacctacaaacggacaacccgtaacaaaacgccgaaagggttcggtaccttaaccgtaatacgtaactaccaaacccgtcgggtacccctggacccggaacaccgaaccgacccaactaacttaactttcgtagttaccggtccttaacgggttttcttttacgtaacctaaaattagtacgacgtacgtcgttaccggggttccgggaccgttaaacgtttcgaacccggttccggtacccgggggtacccgtaacggggtaaccccttccgggtaccttaacccggtcccgttacccttacgtaccgttacccgttacccgaaacccggtaccggggacccctaccggttcccccgttaccccgttccccccggtccgg

SEQ ID NO: 245501 - DNA, 637 bp, Homo sapiens
  misc_feature: GYAE6OF02ICL6B.18.63.F08.1.454.CMB.1.raw
  modified_base (381)..(381): a, c, t, g, unknown or other
  misc_feature (381)..(381): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggaaggccccgtggagtggcttgcacactatttttcgattgacgaaaaatcctaacaacacatctctgaagaccagacgtcaccatctacaaggacacctacaaacgcaggtcgtacctacagtnatacacctgacctgcgacacacgccaacatactttctgtgtacgtacgggtttctttactacgtaaaatatacgacagtccgtacgggtccggtaccgtaagtttcgaaccgttccgtaggggaccgtaacgggtaaaccccgttcgggtcccgtaacccgttccgttcccttacgaccggttaccctttaccccgaacccggtaaccgggccccgttaacctttccccggttaccctttccccccggttcccggg

SEQ ID NO: 245502 - DNA, 566 bp, Homo sapiens
  misc_feature: GYAE6OF02G417C.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccggggaaggcccctggagtggcttgcacacattttttcgattgacgaaaaatcctacaacacatctctgaagaccagagtcaccatctccaaggacacctccaaaagccaggtgtccttaccatgatcaacctggaccctgcggacacagccacatatttctgtgcgtacgggtttctttctactaatatagcagctcggtcgggccgtaatttgaccttccgtcgggccacgggacccctgggtccaccgtctccctccacgcctttcccgaccgtaacgggcccctacgtcccgttcccttcccccgtccggg

SEQ ID NO: 245503 - DNA, 593 bp, Homo sapiens
  misc_feature: GYAE6OF02HHKR1.18.63.F08.1.454.CMB.1.raw
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggcctccgccacggcccccggggaaggccctggagtggcttgcacactattttttcgattgaacgaaaatccctaacaacacatctctgaagaccagagtcaccatctaccaaggaccacctaccaaaagccaggtcgtaccttaccatgactcaacctcgaccctgcgacacagccactatntttcngtgcgttacggtttctttctactaatagtacgctagcgtcggtccggaccgtatttacgacttccggtcgggaccgtaacgggacccgtcggtaccacccgtccgtcctcgtacgtccttaccaacccggtacggccctaccgtccccgttcccgttcccccgtccggg

SEQ ID NO: 245504 - DNA, 666 bp, Homo sapiens
  misc_feature: GYAE6OF02IH5GH.18.63.F08.1.454.CMB.1.raw
tcagtacgagtatgcacgaccggtgctcgatttagcgatcgtataagggggacgtcctgtgccccacccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgcacgccccggggaaggccctggagtggcttgcacactatttttcgattgaacgaaaaatcctacaacacatctctgaagacccagaagtcaaccatactaccaaaggacctaacctaccaaaaaggccaagggttcggtaccttaccatgactaccaaccgtaggtaccctgacggacaaccacgaccaacagttaattttctaggtcgtccgtacgggttttaccttttctaccaaaatacttagcaacgtccgttcgtcggggaccctaaagttttcgaacctccgggtagggccccgtaaggggaaccccgttagggtccgtaacccgttcctaccgtttccgaacggttcccgtttaccccaaaccggaacccggggtaccccaacggtttccccgttacccttccccccgtacggg

SEQ ID NO: 245505 - DNA, 633 bp, Homo sapiens
  misc_feature: GYAE6OF02GGEOQ.18.63.F08.1.454.CMB.1.raw
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctggttctcactcagcagtactagaatgggtgtgagctggctccgccgacggcccccggggaaggccccgtggacgtggcttgacacactatttttcgattgaacgaaaaatcctacaacacatctctagaagaccagagtcaccatctaccaaggacaactaccaaagccaggtcgtacctacatgactcaactcggaccctgcggaacacacnccacattactttcngtcgacgttacgggtttcctttcgtactaaatatacgcgtacgcgttccggtacgggaccgttaagtttcgaccgttccggtcgggacccgtaacggggtaacccgttcgggtacctacccgttccgttccctaccgtaccggtacccttaccgaacccggtaaccgggtcccctacgtaccccgttcccgttcccccgtacccggg

SEQ ID NO: 245506 - DNA, 646 bp, Homo sapiens
  misc_feature: GYAE6OF02HVCW3.18.63.F08.1.454.CMB.1.raw
  modified_base (431)..(431): a, c, t, g, unknown or other
  misc_feature (431)..(431): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaagtgggtgtgagctggctccgccacggcccccgggggaagcccgtggagtggcttgcacactatttttcgattgaacgaaaaatcctaacacacatctctagaacgacagagtccaccactctacgaaacggacctaccctacaaaacgccaggtcgtaccttacatgactacaacctggaccctgcgacacgacgcacattatttcngtcgcttacgggtttctttctactaaatactagtcagtccgtcggtccgggtaccgtaagtttcgtaccttccggtacggggtaccgaccggggtaaccccgtacgggtccgtaacccggtccttacccgtccgtaccggtcccgtttacccgaacccggtaccgggtaccccctaccggtttcccccggtaccccttttcccccggtccccggg

SEQ ID NO: 245507 - DNA, 662 bp, Homo sapiens
  misc_feature: GYAE6OF02HW2BW.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacgccccggggaagccctggagtggcttgcacactatttttcgattgaacgaaaaactcctaacaacacatctctagaagaccagagtcaccatctaccaaggaccacctaccaaaagcctaggtcggtccttaacattcgaactccaaccgtcggaacccctgaccggtaacacacgaccaacattactttctgtcggtccgttaacggggttttccttttactactaaaacgttataacgtactaagtaccgtccgggttaccggggtaccgtaagttttacggaaccgttccggtacggggcccgtaacggggaaccccttgggtaccctaccgggttcctccttacgacgtcccttacccgaaccgttaaccgggacccctaaggttccccgttacccgttcccccgtacggg

SEQ ID NO: 245508 - DNA, 629 bp, Homo sapiens
  misc_feature: GYAE6OF02HM0DA.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggaacggcccctggagtggcttgaccacactattttttcgatttgaacgtaaaaatccctaacaacacatctactgaacgaccagagtcaccatctacaagaccacctaccaaacgccgaggtcgtaccttacatgactcaactcgacctgccgacacacgaccactattatttcgtgtcgtcgttacgggtttctttactactaaatagtagctacgcgtccggtacgggaccgttaagtttcgaccgttccggtcgggacccgacgggtacccgttcggtaccgtacccggtcctcccgtacgtaccgtcccgttacccgaaccgtacccgggtaccctacccgtttcccgtcccgttcccccgtaccggg

SEQ ID NO: 245509 - DNA, 611 bp, Homo sapiens
  misc_feature: GYAE6OF02I3GPQ.18.63.F08.1.454.CMB.1.raw
  modified_base (335)..(335): a, c, t, g, unknown or other
  misc_feature (335)..(335): n is a, c, g, or t
  modified_base (410)..(410): a, c, t, g, unknown or other
  misc_feature (410)..(410): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccggggaagccctggagtggcttgcacgactacttttttcgattgacgaaaatacctacacacatactctgagacagacgtcacncactacaacggacaccacaaacgaccagtcggtccttacactagtacactacctacgtacctacggacgacaacncgacactatactttctgtgacgtacggtttcgtttcctacgtaaataagttacacgagccgttccgttaccgggaccgtaagtttcgtaccgtaccgtcgggccgtaacgggtaacccgtcgtaccgtacccgtccttcctctacgtccttccgtaacccgaacgggtcccaccgttcccgttacccgttccccgtcccgg

SEQ ID NO: 245510 - DNA, 612 bp, Homo sapiens
  misc_feature: GYAE6OF02GBR2X.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccgacggcccccggggaaggccctggagtggcttgcacactatttttcgattgaacgaaaaatcctaacaacacactctctagaacgaccagacgtcaccatcctaccaaggaccacctaccaaagccaggtcgtaccttaccatgactccaacctcggacctcgcgacacacgccactattactttctgtcgtcgttacggttttcttactactaaattactagtacacgtctaccggtcgggtacctaagtttcgaccgttcgtacgggaccgaacgggtaccctggtacccgacccgttcctaccgtccacgtcccttacccgaccgacgggtcccctacgttccccgttcccgttccccgtccgg

SEQ ID NO: 245511 - DNA, 755 bp, Homo sapiens
  misc_feature: GYAE6OF02H7LJV.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctctgggttctcactcagcagtactagatgggtgtgagcgtggcctccgccgacggccccggggaagcccgtggaggtgcttgcacgtacttagttttttcgatttacgaacgtaaaaactccctaacaacactactctactagaacgaccagacgtccaaccacgtcctaccgaacggacctacccgtaaccaaaacggcccgtaaggttaccggttacccgttaaccagttacgtaacgtaccctaaacccggtaccgggtaacccgttcggacccggtaaccgaccgtacgaccctaactaagtttaacctttcgttacggtacggttaccgttaccgggttttacctttacgtaaaccttaaagttaaccgtagtaccgtacgtaccgttaccgggtacccgggtaccgttaacgttttccgacccgttccggtcggggacccgtaacgggtacccgttacggtaccgtacccgtcctacccgttacgtaccgtacccgttacccgaccggaaccggtcccgtaaccgttcccgttacccgttcccccgtaccgg

SEQ ID NO: 245512 - DNA, 616 bp, Homo sapiens
  misc_feature: GYAE6OF02I8UH4.18.63.F08.1.454.CMB.1.raw
  modified_base (179)..(179): a, c, t, g, unknown or other
  misc_feature (179)..(179): n is a, c, g, or t
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (567)..(567): a, c, t, g, unknown or other
  misc_feature (567)..(567): n is a, c, g, or t
tcagtacgagtatgcacgaccggtgctcgatttagcgatcgtataagggggacgtcctgtgccccaccatggacacactttgctacacactcctgctgctgaccaccccttcctgggtcttgtcccaggtcaccttgaaggagtctggtcctgtgctggtgaaacccacagagaccctnacgctgacctgctccgtctctgggttctcactcagcagtactagatgggtgtgagctggcctccgccgacggcccccggggaaggcccgtggagtggcttgcactactagttttttcgagttagaacgtaaaaactcctaacaacactaatcctacgtagaacgaccaaggactacacctatcctaccaaaggaccaccctaccaaaagccaggtcgtaccttacaatcgaactccgaacctcggaccctggacggacacacgccaatntatttcgngtacncgttacggtttctttacaacgtaaatactagctagcgttcggccgggtactaagtttcgacctccggtgggacccgacggtacccgtggtaccacccgttctaccngacctccgttaccgaaccgtcggccctactcccgttccgtccccgtcgg

SEQ ID NO: 245513 - DNA, 619 bp, Homo sapiens
  misc_feature: GYAE6OF02JDLYQ.18.63.F08.1.454.CMB.1.raw
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaagtgggtgtgagctggctccgccacgcccccggggaagccctggacgtggcttgcacactattttttcgattagaacgaaaaactcctaacaacacatctctgaacgaccagagcacactctaccaaggacacctaccaaacgccaggtcgtcctacatgatccaactcgaaccgtgaccggacacgagccactattacttctgtcgcgttacggtttcttactnaaatntacncagctcggtaccggtacgtacgtttcgaccgttccgtacgggtaccgaacggggtaccccttagggtaccctacccgttccgtaccctaccgtaccggtacccttacccgaccggtaaccgggacccctaacgttcccccggttcccgttcccccgtccggg

SEQ ID NO: 245514 - DNA, 680 bp, Homo sapiens
  misc_feature: GYAE6OF02H5AER.18.63.F08.1.454.CMB.1.raw
  modified_base (481)..(481): a, c, t, g, unknown or other
  misc_feature (481)..(481): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaagtgggtgtgagcgtggctcccgccgaccggccccgggggaacggtccccgtgggaggtcggtcttcggaccactaacttatttttttacgatttacggaaacgtaaaaactaccccgtaacaaaccaccgtatcctactagaacgaccaagacgtacaccactccacaacggacacctaccaaagccgaggtcgtactacatagactacaaccgtcgacccgtgacggaccacgacgaccacgtacttacgtttacncggttcgtaccgttacggttttccttttactaactaaattacgtacgtacgacgtccgttccggtaccgggtaccgttaagttccgaccgttccggacgggtacccggacgggtaaccgtccggtaccgtaccgtcctcccgtctacggtccctaccgaccgtaccgggccctcgtacccgttcccgtacccgtcccgg

SEQ ID NO: 245515 - DNA, 583 bp, Homo sapiens
  misc_feature: GYAE6OF02FSOLJ.18.63.F08.1.454.CMB.1.raw
  modified_base (360)..(360): a, c, t, g, unknown or other
  misc_feature (360)..(360): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccagcccccggggaaggccctggagtggcttgcacacatttttcgattgacgtaaaaatcctacaaacacatcctctgaagaccagagtcaccatctaccaaggacacctccaaaanccaggtcggtccttacatgatcaacctcggaccctgcggacacagccaacatactttctgtgctacgggttttcttactcaaatatagcagtctccggtcgggaccgtaatttcgaaccttccgtgggccacgggtaacccctgggtaccacccgtcctacctcgacgtccttacccgaaccgaacggggcccctacgtccccttccgttacccccgtccggg

SEQ ID NO: 245516 - DNA, 626 bp, Homo sapiens
  misc_feature: GYAE6OF02IW3WH.18.63.F08.1.454.CMB.1.raw
  modified_base (306)..(306): a, c, t, g, unknown or other
  misc_feature (306)..(306): n is a, c, g, or t
  modified_base (381)..(381): a, c, t, g, unknown or other
  misc_feature (381)..(381): n is a, c, g, or t
  modified_base (415)..(415): a, c, t, g, unknown or other
  misc_feature (415)..(415): n is a, c, g, or t
  modified_base (442)..(442): a, c, t, g, unknown or other
  misc_feature (442)..(442): n is a, c, g, or t
  modified_base (482)..(482): a, c, t, g, unknown or other
  misc_feature (482)..(482): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtagaaacccacagagaccctcacgctgacctgctccgtctcgtggttctcactcagcactagtggagtgggtgtgggctggactccgtcacgcccccaaggaaacggccctagggagtggcttggcactcatttattggatgaataanaagcgctacagcccatctctgaagagcacggctcaccaatccaaccaaagggaccaccctaacccaaaaaaccgngggttacgtccttaaacgaagtacgacctaaacngtaccggaacccgtgtaacggaccaanaggaccacgtaatacgtactgttagaccacaacgagggtntcgaatactttaatagtagaacttaggccggggttcgtttagaaccgtagtcggggacccgaagggaccccggttacgaccggtacctcgttacccgtcgtaccggacctcccgaaccggtaaccggccctaacggttccccgg

SEQ ID NO: 245517 - DNA, 623 bp, Homo sapiens
  misc_feature: GYAE6OF02HDOHA.18.63.F08.1.454.CMB.1.raw
  modified_base (289)..(289): a, c, t, g, unknown or other
  misc_feature (289)..(289): n is a, c, g, or t
  modified_base (475)..(475): a, c, t, g, unknown or other
  misc_feature (475)..(475): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaagtgggtgtgagctggctccgccgacggcccccggggaaggccctggacgtggcttgcacgtactntttttcgattagaacgtaaaatcctaacaacacatctactagaacgaaccagtacgtacaccgtatactaccgaaaggacctaacctaacaaacgaccaggttacgtaccttacatacgactacgaccgtcgaccctagacgacacacgacactatatacgtacgtacgacacgacgaggtcgtanaacttactaacgtagtacgtaagtcggtcggggtacgttagacgttacgtcgggaccgtaccgggaccgtacggtaccgtaccgtcctaccgtcgaccgtccctaccgaccggaaccggtccacgttacccgtcccgttccccgtccg

SEQ ID NO: 245518 - DNA, 696 bp, Homo sapiens
  misc_feature: GYAE6OF02ILERV.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtagaaacccacagagaccctcacgctgacctgcctcgtctctgggttctcactcagcagtactagaagtgggtgtgagctggctccgcgacggccccgggaaggccctggagtcgtcttgcactactatttttcgattagaacgaaaatcctaacaacacatctactagaacgaccagacgtcaccatctaccgaagacacctaccaaacgccacgggtgtacctacagtacgaacttaccgaacccttacggacccttaggaccggacaaccgtaacgcccaaacgtattactttacgtcggtacgtaccgtaaccggggtttttaccttttacgtaaccttaaaacgttaacgttaacggaccgtaacggtacccgttaccggttaccgggtaacccgttaaacttttcgggaacccttcccgggtacggggacccgtaacggggtaaccccgtgggtacctacccggttcctcccgtacgacgtcccctaccggacccgaacgggtcccctacggtaccgttccctccccgtcgg

SEQ ID NO: 245519 - DNA, 606 bp, Homo sapiens
  misc_feature: GYAE6OF02HN361.18.63.F08.1.454.CMB.1.raw
  modified_base (370)..(370): a, c, t, g, unknown or other
  misc_feature (370)..(370): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctacgctggtgaaacccacacagaccctcacgctgacctgcaccttctctgggttctcactcagcactagtggagtgggtgtgggctggatccgtcagcccccaggaacggccctggagtggcttgcactcatttattggagtgataataagcgactacagcccatcctctagaacgagcgaggctccacactcaccgaagggccacctaccaaaaaccgnggtacggtaccttaacaatcgaaccaacactcggaccctgtacgacacgtacggacactaattacttactgtagcacacgaggcgtgattacttatagtagaattacggtcgggggtacgtttcggacttacggtcggggacccgacggggtaacccgtcgggtaccgaccggttctacccgtaccgcgtcccctaccgacccggtaacggtccccgtacgttcccggttaccccg

SEQ ID NO: 245520 - DNA, 558 bp, Homo sapiens
  misc_feature: GYAE6OF02GR8UP.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacgcccccggggaaggccctggagtggcttgcacactattttttcgattgaacgaaaaatcctaacaacacatctctgaagaccagagtcaccatctaccaaggacacctaccaaaagccaggtcgtccttacatgatcaacctgaccctgcgacacagccacatattctgtgcgtacggtttctttctacaaatatagcagctcgtcgggtaccgtaatttcgacctccgtcgggccacgggaccctggtccaccggtcctcctcacgtccttaccaccgaacgggccctactcccgtccttcccccgtcgg

SEQ ID NO: 245521 - DNA, 675 bp, Homo sapiens
  misc_feature: GYAE6OF02IXOXI.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctggttctcactcagcagtactagaagtgggtgtgagctggcctccgccgacggccccgggaaggccctggagtcggcttgccgacactatttttcgattgaacgtaaaactcctaacaacacagtctctagaacgaccagacgtacaacctataccgtaccgaaacggtaaccacccgtaaccaaaacgtccgtaacgggttacggttacccttaccgacgttagaactaccgaacctcggaccctgacgactacacgaccactacttacttctgtacgtaccgttacggtttactttcgtactaaacgttactacgtacgacgtccgttcggtaccggtaccttaacgtttcgacgttccggtacgggtaccgaaccgggtaccgtaccggttaccacccgttctccgtactccgttaccctaccgaacccgacggtaccccgacgttccccggttacccgttccccgtacccggg

SEQ ID NO: 245522 - DNA, 757 bp, Homo sapiens
  misc_feature: GYAE6OF02GRWKU.18.63.F08.1.454.CMB.1.raw
  modified_base (229)..(229): a, c, t, g, unknown or other
  misc_feature (229)..(229): n is a, c, g, or t
tcagtacgagtatgcacgaccggtgctcgatttagcgatcgtataagggggactcctgtgccccaccatggacacactttgctacacactcctgctgctgaccaccccttcctggtcttgtcccaggtcaccttgaaggagtctggtcctgtgctggtgaaacccacagagaccctcacgctgacctgctccgtctctgggttctcactcagcagtactagaatgggtntgagctggctccgccgacggccccggggaagccctggagtggcttgcacactatttttcgagttgaacgaaaaatcctaacaaacactactctacgtagaacgacctaaggactaccaaccataccgtaccaaacggaccaacccgtaacaaaaacgccgaacgggtacggttaccttaacccgatacgtaacttaccgaaacctacgggtaacccctcgaccggaaccaaccgaacgacccaacctaacttaacgtttctagttcgtacgttacccgggttttctttcgttacctaaattagttaacgacctaggtccttaccgggttacgggtaccgtaaacgtttttcggaaccgtttaccgggtacggggtacccgttaacggggaacccctttaccggggtacccgtaaccccggttccgttacccgtccgtaacccgtaccgtttaccccgtaaacccggtaaacccggggtaccccctaaccggtttcccccggttttccccgttacccccggttcccggg

SEQ ID NO: 245523 - DNA, 742 bp, Homo sapiens
  misc_feature: GYAE6OF02JE4WZ.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaagagtctggtcctgtgctggtgaaacccacagagaccctcacgctgacctgctccgtctctgggttctcactcagcagtactagaatgggtgtgagctaggcctccgccacggcccccggggaaggccccgtggacgtgggcttgccactacttatttttcgattagaacgtaaaactccacaacacatctactagaacgacagagtaccaccatcctaccaacggaccacctaccaaaacgccgaggtcggtacccttacgactgataccgaaccgtaccggaccctggacccggtaacaaccgacgaccctaacgtaactttactttacgttacggtaccggtaccgtttaaccggggtttttaccttttccgttaactaaacgttaacgttacgaccgtaggtcccgttaccgggttaccggggtaaccgttaacggttttaccgtaccgtttccgggttacccgggtaaccgtaccgggttaaccccgttacggttaccgtaccccgttaccggttaaccctccgtaacccgtcccgttaacccgaaccggtaacccggtccccgtaccgttttcccggtacccctttccccggtacccgg

SEQ ID NO: 245524 - DNA, 641 bp, Homo sapiens
  misc_feature: GYAE6OF02GCMMK.18.63.F08.1.454.CMB.1.raw
  modified_base (424)..(424): a, c, t, g, unknown or other
  misc_feature (424)..(424): n is a, c, g, or t
  modified_base (475)..(475): a, c, t, g, unknown or other
  misc_feature (475)..(475): n is a, c, g, or t
tcagtacgagtatgcacgaccggtgctcgatttagcgatcgtataagggggactcctgtgccccaccatggacacactttgctacacactcctgctgctgaccaccccttcctggtcttgtcccaggtcaccttgaaggagtctggtcctgtgctggtgaaacccacagagaccctcacgctgacctgcttccgtctctggttctcactcagcagtactagatgggtgtgagctggctcgccacgccccgggagcctgagtgcttgcacactatttttcgattgaaacgtaaaagtcctacgaaaccacgtatccttcgtagtaacggaaccctagaacgtaccaaccgtactctaccgaaggaccaccgtaccaaagccgtaggtcgtcccttaacatcgactacacgtcgctcggcgacacngaccactacttcttctgtacgcgttaccggtttcttcgtactaactagtanacgagtcctcgtccgggtaccgtaagttccgtaccgttccgacgggtaccctaccgggtaacccttcggtccgacccgttccgtccgtaccgtaaccttcccgttacccgaacccggtaccggtaccccgtacgtttccccggttcccgtacccccgttacccggg

SEQ ID NO: 245525 - DNA, 683 bp, Homo sapiens
  misc_feature: GYAE6OF02IDS6G.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtcgaaacccacagacgaccctcacgctgacctgcctccgtctcgtgggttctcactcagcagtactagaagtgggtgtgagcgtcggcctccgccgaccggcccccggggaacggcccgtggagtggcttcgcactacgttatttttcgattagaaacgtaaaaatccctaacaaccactatcctacgtacgaacgaccgaagtacgtacaacctagtaccctaccgaaacggaccctaaccctaaccaaaaacgccgtaaggttccgtaccttaacctagtcgaactaccaaccgtaccggtaccctcgacgacacgacgaccaactattacttctaggtcgtcgttacggttttcttactactaacttagtacgctacgtcgtaccggtaccggtaccgttattcgacgtccggacgggtaccgaacgggtaccgtacggtcccgtaccgtccgtacctacgtaccgttacccgtaccgaccgtaaccggtcccttaccgtcccgttccccgtcccgtcccgg

SEQ ID NO: 245526 - DNA, 622 bp, Homo sapiens
  misc_feature: GYAE6OF02IFK95.18.63.F08.1.454.CMB.1.raw
  modified_base (478)..(478): a, c, t, g, unknown or other
  misc_feature (478)..(478): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcgcgctgacctgctccgtctctgggttctcactcagcagtactagaatgggtgtgagcgtggcctccgccacggcccccggggaaggcccgtggagtggcttcgcactactatttttcgattgaacgtaaaaatcctaacaacacatcctctaggaacgccagacgtcaccatctaccaagaccacctaccaaacgccgaggtcgtccttaaccatgactaccaaccgtcgaccctggaccgacactacgccacattacttctgtgccgttacgggttttctttctacaaattatacgacngtaccgtcgggtaccggtacgttaacttcgtaccgttcccggtacggggtccgacggggtacccgttcggtacctacccggtcctaccctcaccgtccttacccgaccgtacggccctaccgtccggttcccttcccccgtcgg

SEQ ID NO: 245527 - DNA, 673 bp, Homo sapiens
  misc_feature: GYAE6OF02GLDZR.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctcgtggttctcactcagcagtactagaagtgggtgtgagcgtggcctccgccgacggacccccgggggaaggccctggagtggctgcactactatttttcgattgaacgtaaaactctaacaacacatcctctagaacgaccagacgtacacctatcctacgaacggaacctaccaaccaaaacgccgtagggtccgtaccttacgatacgactacctaacgtccggacctcggccgtaacacaccgccaactagtttaacttcgtgtcgtacccggttacggtttaccttactaactaattacgtagacgtcgcgtccggtaccgggtaccgttaacgttcgaccgttacggtcgggaccgtaaccgggtacccgttagggaccgtacccgtcccgttacctaccgtacggtaccccttacccgggacgaacccgggtccctaccgtttccccgtcccgtttaccccccggtcggg

SEQ ID NO: 245528 - DNA, 661 bp, Homo sapiens
  misc_feature: GYAE6OF02JFMO9.18.63.F08.1.454.CMB.1.raw
  modified_base (280)..(280): a, c, t, g, unknown or other
  misc_feature (280)..(280): n is a, c, g, or t
  modified_base (319)..(319): a, c, t, g, unknown or other
  misc_feature (319)..(319): n is a, c, g, or t
tcagtacgagtatgcacgaccggtgctcgatttagcgatcgtataagggggactcctgtgcccaccatggacacactttgctacacactcctgctgctgaccaccccttcctgggtcttgtcccaggtcaccttgaaggagtctggtcctgtgctggtgaaacccacagagaccctcgcgctgacctgctccgtctctgggttctcactcagcagtactagaatgggtgtgagctggctccgccacgccccggggagccctggagtggcttgcacacgtnttttttcgattgaacgaaaactcctaacaacacatctcngaacaccagagtccaccatctaccaacggacaacctaccaaaacgccaaggtcgtaccttacatgactaccaaccgtcggacctcggacgactacagcccatacttatttcgtgtcgtacgttacggttttctttacctacgtaaacttagtacgctacgtcttccgggtaccggtaccgttaacgtttcggtacccgttccgggttcggggaccggttaaccggtaacccgttcgggtacccgtacccggttcccttccctaaccgtccggtaccctttaccccgaaccggaacccgggtccccctaccggttccccgtttccccgttcccccgtcccggg

SEQ ID NO: 245529 - DNA, 593 bp, Homo sapiens
  misc_feature: GYAE6OF02FXH80.18.63.F08.1.454.CMB.1.raw
  modified_base (327)..(327): a, c, t, g, unknown or other
  misc_feature (327)..(327): n is a, c, g, or t
  modified_base (444)..(444): a, c, t, g, unknown or other
  misc_feature (444)..(444): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggaaggcccctggagtggcttgcacactattttttcgattgaacgaaaaatcctacaacacatctctgaanaccagagtcacatcctacaaggacacctaccaaaacgccaggtcgtccttaccatcgatacaaccgtcgaccctgcggacacacgccatatatttctgtgacgttacgggtttcttntactaaatatacgacacgtcgtccggtacgggaccgtaatttcgaccgttccgtacggggccgtacggggtccgtcggtaccaccggttctcccgtcgacgttccgtaccgaccgacggtccctacgtcccgtccttcccccgtccggg

SEQ ID NO: 245530 - DNA, 688 bp, Homo sapiens
  misc_feature: GYAE6OF02F256Q.18.63.F08.1.454.CMB.1.raw
  modified_base (230)..(230): a, c, t, g, unknown or other
  misc_feature (230)..(230): n is a, c, g, or t
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtntgagctggcctccgccacggcccccggggaagcccgtggacgtggcttgcactacttatttttccgattagaacgtaaaaactcctaacaacacactcctctagaacgacccaagacgtccaccacgtacctaccgaaacggaccaaccctaccaaaacgccgtagggttacggtccctttaaccatacgaactccaacctcggaccctggaccggacacgacgacccacgtacttactttcgtcgtcgtaccgtttacgggtttctttaccgttaactaaattacgtacgaccgtacgtccgtaccgggttccggaccgttaacgtttcggtaccgttccggtacggggtacccgtaaccggggtacccgttcggtaccgtacccggttccttaccctcgtaccgtccctaccgtaccgaccggtcccctacgttccccgtccgttcccccgtccgg

SEQ ID NO: 245531 - DNA, 673 bp, Homo sapiens
  misc_feature: GYAE6OF02IROAC.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctcgtgggttctcactcagcagtactagaagtgggtgtgagcgtgggcctcccggccgacggacccccgggggacggccgtggaggtggcttgcactactattttttcgattacgaacgtaaaactccaacaacacatctcgtagaacgacagtacgctacactctacaacgaccacctaccaaacgccgtaggtcgttccttacagtcgactaccgtaacgtcggaccctcggacgaccaacgaccgacctaatactttactttcgtagtaccggtcgttaccggttttctttacgttactaaatcgtaacgcgtagtccgtaccggtaccggtacgttacgtttcgaccgttccggttacggggacccgtacgggttaccgtaccgttcccgaccgttccttaccctacgtaccgtacccgttacccgaccggtaacccgtccctaaccgttccccgttcccttccccggtccgg

SEQ ID NO: 245532 - DNA, 733 bp, Homo sapiens
  misc_feature: GYAE6OF02HXECW.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtccccaggtcaccttgaaggagtctggtcctgtgctggtgaaacccacagagaccctcacgctgacctgctccgtctcgtgggttctcactcagcagttactagaagtgggtgtgagctggctccgccacggccccgggagcctggagtgctgcactacttagtttttacgattcgaaacgtaaaaactcctaaccaactacacttcctactacgaacgaccagtacgacctaaccatacctaccgaaacggaccctacccgtaaaccgaaaacgtccgtagggttaccgttaccctttaaccagtacgaactaccgaaccgtccggaccctcggaccggacaccgacgaccgaacttagttactttacgtgtaccggtcgttaccggttttcttttacaacttaaatctacgtcacgtccgtccgggtaccggtaccgttaacgtttacggacccgttccgggacgggtacccggaacgggttacccggttgggtaccctacccggtccgtttaacccgtcggtaaccgttaccccgttacccgtaacccggtaccgggtacccccttaccggtttccccccggtttccccgttaccccccggttcccggg

SEQ ID NO: 245533 - DNA, 629 bp, Homo sapiens
  misc_feature: GYAE6OF02FRCHF.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagagtgggtgtgacgctggcctccgccgacgcccccggggaaggcccgtggagtggcttgcacactattttttcgattgaacgaaaatcctaacaacacatctctagaagaccagagtcaccatctccaaacggaccacctaccaaacgaccgacggtcggtacccttacacgtgactaccaacctcgacccgtgccgacacacgccactatactttctgtcgcgttacgggttttcctttacgtactaaatacgttagacgagtccgtcgggtacccgggtacgttaactttcgaccgttcccggtcggggacccgtacgggtaacccgttcggtccgacccgttcgtacctctacgtccttacccgaaccgaccggaccctaccgtcccgttcccgtccccgtccgg

SEQ ID NO: 245534 - DNA, 646 bp, Homo sapiens
  misc_feature: GYAE6OF02FLS0Y.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagcgtggcctccgccgacggcccccgggggaacggcccgtggagtggcttgcacactatttttcgattgaacaaaatcctaacaacacatctctgaagaccagagtccaccatctaccaaggacacctaccaaacgccaggtcgtccttaccatgactaccaaccgtcggaccctggaccgacaaccacgacccaactacttagtttacctggttacgtaccgttacgggttttctttaccgttactaaaattactagcacggtcctcgggtccgggtaccgtaacgtttcgaccgttcggtcgggtaccgacgggtaacccgtcggtaccgacccgttcctcccgtaccgacgttccctacccgaacccgtacggacccctacgtccccggtttacccttcccccgttcccgg

SEQ ID NO: 245535 - DNA, 827 bp, Homo sapiens
  misc_feature: GYAE6OF02FH8CP.18.63.F08.1.454.CMB.1.raw
  modified_base (133)..(133): a, c, t, g, unknown or other
  misc_feature (133)..(133): n is a, c, g, or t
  modified_base (138)..(138): a, c, t, g, unknown or other
  misc_feature (138)..(138): n is a, c, g, or t
tcagtacgagtatgcacgaccggtgctcgatttagcgatcgtataagggggactcctgtgcccaccatggacacactttgctacacactcctgctgctgaccaccccttctggtcttgtcccaggtcaccttnaaggngtctggtcctgtgctggtgaaacccacagacgaccctcacgctagacctgctccgtctctgggttctcactcagccagtactagaagtgggtcgtgacgctcggacctcccggcccgacggcccccgggggaagccctggactcggcttcgacctacgtactacgttttttcgaacttcgaaaccgtaaaaaccttccctaacaacctaacctacgttacctctacggaacgacccgagtactaccacctacttccgaccaacggaacccaccgtaccgaaaacgccgtacggtaccgttacctaacagtcgacctaccgacccgtacgacccgtgaccgacaccgtacgacccaactacttaactttcgtacggttaccgtaccggtttaccgggttttaccttaccgttaacctaaaactaccgtacgtacccgtacgttccgttacccgggtacccgggttaaccgttaaacgtttaccggtaacccgtccccgggttacgggggaacccgttaacccgggggttaaaccccgtttcgggaaccccctttacccgggtttaccccgttacccgggttaaccccgtacggtttacccccttaaccccgggtaaacccggaaacccccggggttccccaacccggttttccccccgttaccccggggtttaccccccgtccccggggg

SEQ ID NO: 245536 - DNA, 841 bp, Homo sapiens
  misc_feature: GYAE6OF02HC551.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgatctggctccgccacgccccggggaagccctggagtggtctgcacactatttttcgattgaacgtaaaaatcctaacaacacatctctagaagaccaagacgtaccaacctactcctaccgtaaacggaaccaaccctaaccaaaaacggcccgtaaagggttacggttaccctttaaccgtaacttacggaaaccttaccgtaaaacccgttcgggaacccccgttaggacccggaaccgaaccctaacggacccctaaactaacgtttaacttttacgttacggttaccggtaacccgttaaccgggggttttttaccctttttaccgttaaaccgttaaaaacgtttaaacgttaaacggtaccgtaacggttacccgttacccggggttaccccggggtaaaccgtttaaacgtttttaccggaaccctttccccgggtaccgggggtaacccggtaaaccgggggtaaacccccttcggggttaacccgtaccccgggttcccttacccgttacgtaaccggttaccccgttaacccgtaacccggtaaccggggaccccctaaccggttcccccgtttaccccgttccccccggttacccggg

SEQ ID NO: 245537 - DNA, 742 bp, Homo sapiens
  misc_feature: GYAE6OF02GX31T.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaagtgggtgtgagctggctccgccgacggcccccggggaaggccctgggagtggcttgcacactatttttcgattagaacgtaaaactcctaacaacacatctcgtagaagaccagacgtacaaccatacctaccgaagtaccacctaaccaaaacgccgaagggttcgttaccttaaccattacgactccgaacctcggaccctggaccgacacacgccaatacttatttcgtcgttacgacgttaccgggttttcttacgttactaaattacgtacacgtacgtacgtccgggttaccgggtaccgttaaacgtttccgtaaaccgttcccgggtccggggaacccgtaaccggggggttaaccccctcggggtttaccccgtaacccggtttccgttacccccggttacgttaaccccggttaccccttttaaccccgaaaccccgggggtaaccgggtcccccgttaacccggtttcccccggttttaccccccgttccccccggtttaccccggg

SEQ ID NO: 245538 - DNA, 760 bp, Homo sapiens
  misc_feature: GYAE6OF02IZ8FC.18.63.F08.1.454.CMB.1.raw
tcagtacgagtatgcacgaccggtgctcgatttagcgatcgtataaggggggactcctgtgccccaccatggacacactttgctacacactcctgctgctcgaccaccccttcctgggtcttgtcccaggtcaccttgaaggagtctggtcctgtgctggtacgaaacccacagacgaccctcacgctgacctgcgtccgtctcgtcgggttctcactcagcagtactagagtgggtgtagcgtcgtcggcctccgaccggaccgggacccccgggggaacgcccgtgggacgtggtcgtcgcactacttagtttttcgagttaacgaaacgtaaaactacctaacaaccactacttcctactaacgaacgaccgaagtaacgtaccaacctactccgtaaaccgaacgaacccgtaaaccctaaccgaaaaccggtaccgtaacgggttcccggttaacccttaccggtaataaccgtaaactacccgtaacccgtacggtacccgtacggaaccggacctaacgaccgacctaactacgtttactttcgtacgtgttaccggttcggtttactttaccgtaattaaagttactaacgcgtacgtcggttaccggtaccggtaacgtacgttacgtaccgttccgggtaccggaaccggtaccggtaccgttacgtcccgtaaccgttccgtaccgtctaccgttccttaacccgccgaacccggccgtaaccgttccccgtacccgttccccgtccgg

SEQ ID NO: 245539 - DNA, 736 bp, Homo sapiens
  misc_feature: GYAE6OF02IDGJ2.18.63.F08.1.454.CMB.1.raw
tcagtacgagtatgcacgaccggtgctcgatttagcgatcgtataagggggactcctgtgccccaccatggacacactttgctacaccactcctgctgctgaccaccccttcctgggtcttgtcccaggtcaccttgaaggagtctggtcctgtgctggtcgaaacccacagagaccctcacgctgacctgcctcgtctctggttctcactcagcagtactagaatgggtgtcgagctcggctcccgaccgaccggccccggggaacggccctagggacgttgggcttcgcgactaacttattttttacgatttacggaaacgtaaaaactccctaaaccaacgtaactactctctagacacagagtacacatcaccaagaccactaccaaagcctaaggtcgtaccttacacgtatactaccgtaaccgtcggaccctagaccggaacacacgtacccaactattaactttcgtacgttcgtaccgttaaccggtttttcgttttacaacgttaaattaacgtacggacctagtacccgttaccgggtaccgggtaccgttaagtttcgtaaccgttcccggtaggggacccgtaacggggaccccgttacggttacccgtaaccggttcccgttaccttaaccggaccgttacccggtttaaccccgaacccggtaaccggggtaccccgttacccggtttccccgtttacccccggtttccccccgcccgggg

SEQ ID NO: 245540 - DNA, 745 bp, Homo sapiens
  misc_feature: GYAE6OF02HB5JY.18.63.F08.1.454.CMB.1.raw
tcagtacgagtatgcacgaccggtgctcgatttagcgatcgtataagggggactcctgtgccccaccatggacacactttgctacacactcctgctgctgacccaccccttcctgggtcttgtcccaggtcaccttgaaggagtctggtcctgtgctggtgaaacccacagagaccctcacgctgacctgctccgtctctgggttctcactcagcagtactagaagtgggtgtgagctggctccgccacggccccgggaagccgtggagtggcttgcacactatttttcgattgaacgtaaaatccctaacaactacatcctctagaacgaccaagacgtaccaaccactaccgttaccaacggaaccacccgtaacccaaaaacgcccgtaagggttccggttacccttaaccgacttacgtactaaccctaacccgtaccggtaccccgtggacccggaactaaccgacgacccaactaattacgtttcgtcggtacgtaccgttaccgggttttcctttactaaccgtaaatttacgtaacgaccgtacgtccgtccggttaccggggtaaccgttaacgttttacgaacccgtttccggtacgggggtacccgtaacggggttaacccccttcggggttacctaccccgggttcccttcccgtaccgacgttcccgtttacccgaacccgtaacccgggtccccacccgtttccccggttaccccttcccccggtcccggg

SEQ ID NO: 245541 - DNA, 940 bp, Homo sapiens
  misc_feature: GYAE6OF02FYV07.18.63.F08.1.454.CMB.1.raw
tcagtacgagtatgcacgaccggtgctcgatttagcgatcgtataagggggactcctgtgccccaccatggacacactttgctacacactcctgctgctgaccacccccttccgtcgggttcttcgtcccgacggtcctacccgttaggaaaggagtcgtcggtccgttgtgtcgtggtacgaaacccacgagacgaccctcacgtctcgtaccgtcgtccgtccgtcttcggttcgggttcctcactcagcgtacgtaacgtaagaggtgggtagtcggacgcgtcgtccgccggacccgacccgggacccccggggacggtcccggtggtacggtcggtcgttcgaccgactacttttacgtttttacgtacgttacggaaaaccgtaaaactaccctaaacaaccgaactacttcgtacgtacggaaacgtaccgaaggtacctaccacctactaccaacggaaaccggaacctaacccgaaaccaaacggtaccggtacgggttacccgtttaaccttaaccgtaagttacgtaaccttaaccccggtaaaccgttacccgggtacccggtacggaacccgaaaccgtaaccgaacccggtaacctaaacgtttacttttacgttttaccgttcgggttaccggtacccgggtttttaaaccgggtttttacctttacccggtttaaaacttaaacgttaacggtaacgttccgtaaccgggttccggttacccggggttacccgggttaaaccgttttacgtttaaccgggacccggttaccgggttaccggggaacccgttacccggggttacccgtccggttacccgtcccggtttaccctaccgggttacctaccggttaccccgtaaccgaaccccgggttaccggaccccgttcccgtttacccccggttccccggtaccccggtcccgg

SEQ ID NO: 245542 - DNA, 748 bp, Homo sapiens
  misc_feature: GYAE6OF02FL0IQ.18.63.F08.1.454.CMB.1.raw
tcagtacgagtatgcacgaccggtgctcgatttagcgatcgtataagggggactcctgtgccccaccatggacacactttgctacacactcctgctgctgacccaccccttcctgggtcttgtcccaggtcaccttgaaggagtctggtcctgtgctggtacgaaacccacagacgacccctcacgctgacctgccttccgtctcgttcgggttctccactcagcagtactagaacgttggggtgtgagctggctcccgcccgaccggacccccgggggacggcccgtggagtcggcttgcaccacttattttttacgattagaaccgtaaaactaccctaaccaaaccaactactacctcttacgaacgtaccacgacgtaccaccactcctaccgaacggaccaaccctaaccgaaacgtaccgacgggtaccggttccttacccgattcgtaacctaccaacccgttaccgggacccgcggaccggtacgaccgaccgaccaactacttactttcgtgtacgccgttacggttttcttactaactaactacgtacgtcgtacgtccgtacggttcccgggtacgttaacgtttacgttacgtcccggttacggggaccggtaaccggttacccgttaccggtacccggtacccgttccgtacccgtaccgtcccggtacctaccccgtaccggtaacccgggttaccccacccggttccccgttacccgttcccccgtaccccgg

SEQ ID NO: 245543 - DNA, 813 bp, Homo sapiens
  misc_feature: GYAE6OF02JS9ZD.18.63.F08.1.454.CMB.1.raw
  modified_base (195)..(195): a, c, t, g, unknown or other
  misc_feature (195)..(195): n is a, c, g, or t
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
tcagtacgagtatgcacgaccggtgctcgatttagcgatcgtataagggggactcctgtgccccaccatggacacactttgctacacactcctgctgctcgaccacccttccgtgggtcttggtccaggtcaccttgaaggagtctggtcctgtgctggtagaaacccacgagacgaccctcacgcgtcgacctnacctccgtctcgtcggtctcactcagcagtactagaagtgggtntgacgcgtcggcnccggtacgaccggccccgggggtaaggcccgtagggacgttggtccgttacgccgtaactacgtttacgttttaccgtagtacgtaaacggtaaaaacctcctaacaacgtaacctattacctgtaacgaaccgaacgtacgtaacggttaccaaccgtacgtacctaccggaaaacggaacctaccctaaaccggaaaacgtccgggtacggtacccggttacctaaacctcgttaacgaaccgttaacccgaaccggttacccgggtaacccgtcgggtaacccggaaccgaacctaaccggttaacccaaacttacggttacttaaccggttcgtaacggtccgtttacggtttaacctttacgaacctaagtaactaggtacctacgtacccggtccggtagggtacctaaacggtttcgccgtttacccgggcggtaacccggtacgggtacccgttcggtaccgtaacccgttcgttacccgtaacccttggaaccccgttaccgaacccggtaccgtacccttaccggtcccgttacccggttccccgacccgg

SEQ ID NO: 245544 - DNA, 624 bp, Homo sapiens
  misc_feature: GYAE6OF02GSO5O.18.63.F08.1.454.CMB.1.raw
  modified_base (166)..(166): a, c, t, g, unknown or other
  misc_feature (166)..(166): n is a, c, g, or t
  modified_base (176)..(176): a, c, t, g, unknown or other
  misc_feature (176)..(176): n is a, c, g, or t
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (547)..(547): a, c, t, g, unknown or other
  misc_feature (547)..(547): n is a, c, g, or t
  modified_base (576)..(576): a, c, t, g, unknown or other
  misc_feature (576)..(576): n is a, c, g, or t
  modified_base (587)..(587): a, c, t, g, unknown or other
  misc_feature (587)..(587): n is a, c, g, or t
tcagtacgagtatgcacgaccggtgctcgatttagcgatcgtataagggggactcctgtgccccaccatggacacactttgctacacactcctgctgctgaccaccctctggtcttgtcccaggtcaccttgaaggagtcgtggtcctgtgctggtacgaaacccnagagaccctnacgctgacctgctccgtctctggtcctacgatcagcagtactaagtagtgggtntgacgcgtgccnccgaccggacggaccccggggagcccgtggcgtggtcttacggcacgtacctttagttttcgacgttacgtaaacgtaaaaactccgtaaacaaacaacgtacttacgtcgtaacggtaacgaacccgtaggactaccgaactactaccgtaccgaaggtaacccaccgtaaccgaaacgacgtacggtactccttaacatcgaactaccacgtcgactacgacgacacgtcacgtatattacgtcgttcgctacgttacggttactacgtataatacgctacgctacggtcgacgtcacgttcncgtcgcggccgtacgtactcgccacgtcnctacgtaccgntaccgcgacgtacctaccgtcccgtccctccggtccg

SEQ ID NO: 245545 - DNA, 926 bp, Homo sapiens
  misc_feature: GYAE6OF02IOXNP.18.63.F08.1.454.CMB.1.raw
tcagtacgagtatgcacgaccggtgctcgatttagcgatcgtataagggggacgtcctgtgccccaccatggacacactttgctacacactcctgctgctgaccaccccttcctgggtcttgtcccaggtcaccttgaaggagtctggtcctgtgctggtgaaacccacagacgaccctcacgctgacctgctccgtctcgttgggttctcactcagcgtagtactagaagtcgggtgtaggagtcgtgggcctccgccgaccgggcccccgggggaacggtccccgtagggaggtcggtaccgttggacctaactaccgttagttttttaccggaagttacggaaaaccgtaaaaacttccctaaactaaaaccacctactaccttacgtaggaaaccgacccgtaaggaagttacccaacctacttacccgtaaccgtaaacggtacctaaccccgtaaccgaaaacgcccggtaacgggttaccgttaccccgttaaccgaacgtacgtaaccttacccgtaaaccccgttcgggtacccccgttacgggacccggtaaccgaaccgtaacccggtaaccctaacttaacgtttaccgttttaccggttaggttccggttaacccggtttaccgggggttttttacccttttaccgttaaaccttaaaacggttaacgtaccgaacgttaccggtaccgttaccggggtaacccgggtaccgtttaacgttaccggttacccgttacccggggtacgggtacccggtaaccggggtttaccccggtccgggttaacccgtccccggttaccctttacccggtccgtaacccggttaccccgttaaccccggtaacccgggtaaccgggtacccccttacccggttccccggtttacccccccgttaccccggttcccccgggg

SEQ ID NO: 245546 - DNA, 661 bp, Homo sapiens
  misc_feature: GYAE6OF02GMKA8.18.63.F08.1.454.CMB.1.raw
  modified_base (176)..(176): a, c, t, g, unknown or other
  misc_feature (176)..(176): n is a, c, g, or t
  modified_base (249)..(249): a, c, t, g, unknown or other
  misc_feature (249)..(249): n is a, c, g, or t
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
  modified_base (519)..(519): a, c, t, g, unknown or other
  misc_feature (519)..(519): n is a, c, g, or t
  modified_base (595)..(595): a, c, t, g, unknown or other
  misc_feature (595)..(595): n is a, c, g, or t
  modified_base (605)..(605): a, c, t, g, unknown or other
  misc_feature (605)..(605): n is a, c, g, or t
tcagtacgagtatgcacgaccggtgctcgatttagcgatcgtataagggggactcctgtgccccaccatggacacactttgctacacactcctgctgctgaccctacccccttccgtgggtcctttgtcccaggtcaccttgaaggagtctggtcctgtgcgttggtgaaacccanagacgaccctcacgctgacctgcctccgtcttcgttggtttcctctactcagcagtactaagaaggtgggtgngtagcgtcggccgtcccgaccgaccggacccccggggacggtcccgtgggagtcgtcggtcncactacgtttagtttttacgtnttacgaaacgtaaaactaccaaactaacacgtaactccgatagaaccgacgaagactacaccgactccgtaaccaaccggaacctaaccgtaacccgaaaacgtccgtagggtttcctaccgttactataacgactacccgtaacgaccgtcccgtaggcgacacacactactattcttgtcgtancgttcggtttcttcgtatactagtctagcgtacgtccggtcgtacgttactcgtccgtcgcggtacgacggttccngtccacgtcnctaccgacttcgtaccacggtaccggtacctaccttcccgtcccgtccgtacccgg

SEQ ID NO: 245547 - DNA, 865 bp, Homo sapiens
  misc_feature: GYAE6OF02HHELW.18.63.F08.1.454.CMB.1.raw
  modified_base (170)..(170): a, c, t, g, unknown or other
  misc_feature (170)..(170): n is a, c, g, or t
tcagtacgagtatgcacgaccggtgctcgatttagcgatcgtataagggggacgtcctgtgccccaccatggacacactttgctacacactcctgctgctgaccaccccttcctgggtcttgtcccaggtcaccttgaaggagtctggtcctgtgctggtcgaaacccanagacgaccctcacgctgacctgcctccgtctcgtggttctcactcagcagtactaagagtggtgtgagtcgcggcctccgccgaccgggcccccggggaacggtcccgttgggacggttcggtaccgtttcgaccgtaacttccgttttaacgttttttacggactttaacgggaaaaaccggttaaaaaaccttacccctaaaccaaaacctacctaacttcccgttacgtaacggaaacgaacccggtaagtaccgtaccctaaccgactttacccgaaaccggaaacgaacccttaacccaaacccgaaaacgcccggtaagggttcccgtaccttaacctagtaaccgtactacccgtaaccggttccggacccgtcggaccgtaaccgaccaaccggtaccctaacttaactttacgtttactacgggtccggttaccgtttacgggttttacccttttacgtaaacttaaacgttacgacgtcctacggttaccggtcccgggttaccgggtaccttaacgtttccggaccgttacggggtaccgggtaccgaacccggttaacccggtcgtaacccggtcccgtacccgtttcccgacggttacccgtacccggtaaccccgtaacccgggtaccggttacccccgttaccggtttcccccgtaccccgtttccccgggtacccccgg

SEQ ID NO: 245548 - DNA, 790 bp, Homo sapiens
  misc_feature: GYAE6OF02I0TDN.18.63.F08.1.454.CMB.1.raw
  modified_base (135)..(135): a, c, t, g, unknown or other
  misc_feature (135)..(135): n is a, c, g, or t
  modified_base (175)..(175): a, c, t, g, unknown or other
  misc_feature (175)..(175): n is a, c, g, or t
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (612)..(612): a, c, t, g, unknown or other
  misc_feature (612)..(612): n is a, c, g, or t
tcagtacgagtatgcacgaccggtgctcgatttagcgatcgtataaggggactctgtgcccaccatggacacactttgctacacactcctgctgctgaccacccttctgggtcttgtccaggtcaccttgaaggngtactggtcctgtgctggtagaaacccacagacgaccctnaccgtcctagaccttcgccttcccggtcttcgttgggtttccncgaccttccagcctagtacctagaatgggtntggagcgtggacctccggccgacggcccccgggagaccgtggacgtcgtcgttagacaccgtactttagtttttcgacgtttacgaaacgtaaaaccgtttacccaactaacctaaccttacgtactaccttacggaaaaccgtacccgacgtacgtacccgtaccacgtacctaccgaaaccggtaccgtaaccctaaaccgaaaacgccgttaacggggttacttacccgtttaaccaagttacaacgccgttaaaccgccgggtaacctcgggaccgaaccacgaaccgacctaccgtaattacgtttcgtaggttaccggtccgtttacggtttactttacccgtaagttaaactacgngtaccgtaggccgttcggacgggtattaaccgttaggcccgtttacgggccggtaaacggtaacccgggtccgttaccgggtccttacccggttacgtaccccttggtaccctaaccccggttacctaccggacccggtaccgttaacccgccccttacccggttccccggttacccg

SEQ ID NO: 245549 - DNA, 832 bp, Homo sapiens
  misc_feature: GYAE6OF02H6PWX.18.63.F08.1.454.CMB.1.raw
tcagtacgagtatgcacgaccggtgctcgatttagcgatcgtataagggggactcctgtgccccaccatggacacactttgctacacactcctgctgctgaccacccttcctgggtcttgtcccaggtcaccttgaaggagtctggtcctgtgctggtagaaacccacagacgaccctcacgctgacctgctccgtctcgtgggttctcactcacgcagtactagaagtgggtagtgagtcgtcggcctcccggacccgaccgggaccccccggggggtaacggtccccgttagggggtacgggttcgggtccgtttcggggacccaacggtaacctttagttttttttacccggaagttttacggaaaacccggtaaaaaaattacccctaaacaaacccgtaaccgttaacttccgttacttaacggaaacggtaaccccgaagggtaaccttacccaaccgtaacttccctaaccgaaaccgggtaacctaaccccgtaaaccgaaaacggtacccgtacggggtaccggttaacccttaccgtacttaggaaccttccaaacccgtcgggtaacccctcgggaccggaaccgaccgtaacgacccgaacttacgttaactttcgttacggtcggtccgttaaccgggttttcctttacctaacgtaaagttacagtacgacgtccgtcggtaccgggtaccgttagttacgcgttacggtacggaccggtaaccggtaccgttggtacctaccggttcgtacccttagccgtacctttacccgaccggtaacggcccctacgttacccgtcccgttaccccggtccgg

SEQ ID NO: 245550 - DNA, 953 bp, Homo sapiens
  misc_feature: GYAE6OF02JCFX1.18.63.F08.1.454.CMB.1.raw
tcagtacgagtatgcacgaccggtgctcgatttagcgatcgtataagggggactcctgtcgccccaccatggacacactttgctacacactcctgctgctgaccaccccttcctggtcttcgtcccgacggtcaccttggaaggagtctggtcctgtgactggtacgaaacccacagacgaccctcgacgccgtgacctcgtccgtccgtctcgttcgggttcctcactccgagccaagtactaagtaaggttggtagtgacgcgtcggcctccgaccggaccgggaccccgggaggtccgtagggtacgtcggtctcggaccaccgtactttacgttttacgacgttacgaaaactaaaaccgttcctaaacaactacctattcctaaccgttaagaaaccgtacgtaacggactaaccaacctaccgtaccgtaaaccgtaaccgacctaaaccgtaaccgaaaaccggtaccgggttacgtacccggtttaacctacgtaacgttaactaaccggttacctaacccggtaccggtaaacccggtccggaaccggtaacctaacccggtacaaccccggttaaactaccgtttttaccgtaacggtttcgggtaacccgtttacccgggttttaaccgggttttaccgttaaacccttttaaacgtaaacgtttaaaaccggtccttaaccgggttaccctacccgggggtttacgggttaaccccgggggtttactttaaaacccgggtttccgttacccggggtaaacccggggtacccggggttaaccggaacccgggtttaaacccggttccggttaccccgtttacccggttccgtacccgggtttaacccgtaccgttcccccgtaacccggttaaaccccggttccccgggtccgttaaccccccggttcccggtttaaccccccgttacccccgggtccccgg

SEQ ID NO: 245551 - DNA, 754 bp, Homo sapiens
  misc_feature: GYAE6OF02JEE30.18.63.F08.1.454.CMB.1.raw
  modified_base (162)..(162): a, c, t, g, unknown or other
  misc_feature (162)..(162): n is a, c, g, or t
  modified_base (609)..(609): a, c, t, g, unknown or other
  misc_feature (609)..(609): n is a, c, g, or t
tcagtacgagtatgcacgaccggtgctcgatttagcgatcgtataagggggactcctgtgccccaccatggacacactttgctacacactcctgctgctgaccaccccttctgggtcttgtcccaggtctacctgaacggagtctggtcctgtgcttggtanaaacccacagacgaccctcacgctgactgctcgtctcgtggtctcactcagctatactaagtagtgggtcgtgagtcgtcggtccgtacccgccgaccggaccccccgggggtaagccccgttaggacggttcggtcgttacgccgaactactttacgtttttacgtaacgtttgaaaaccgtaaaaccttcccaagtaaaccaacctattacctagtaacgaaacgacccaaagtaacgtacctaaccgtaaccttaccgtaaccaaacggtaaccaaccccaaacccgtaaaaccggccgaacggggttccctttaaccgaaccttactactaacctaaccgaacccggttcggaacccgtacggacccggtaaccaacgaacgaccctaacttagttatttcggacgtacgtcgttacgtttcttactaataactagacgtacncgttcggacggttcccgaatttacggtgacccgtacggttccggaaccgacgggtacctgtaacctccggttacctaccgtcgtaaccgtccgtaacccaccggacgtaccccgtcttacccgggttcccctaccccggttccgg

SEQ ID NO: 245552 - DNA, 803 bp, Homo sapiens
  misc_feature: GYAE6OF02ISB7N.18.63.F08.1.454.CMB.1.raw
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
tcagtacgagtatgcacgaccggtgctcgatttagcgatcgtataagggggactcctgtgccccaccatggacacactttgctacacactcctgctgctgaccaccccttctggtcttgtccaggtcaccttgaaggagtctggtcctgtgccgtaggtacgaaaccccacgagacgtacccctcgacgctcgacctgcctccgtctcgttggttcctcacgtcagcacgttacagagtggtgagagcgngaccgtccgacgccggcccgggacgccgtggacgtcggtntcggacacgtactttacgttttcgagtacgtaacgtaaaacgtccctaacaacgacgtacttcgtacgtagaaccgtacgaagacgtacctactactaccgtaccgaacggtaaccacctaaaccgaaacggtccaacggggtttccgttacccttaacgaacgttaacgacccgttaaccaccccggtacggacccacgggtaccgaaccgtaacgacccgaaccctacgtaaccgtttatttacccgggtgtaccggttaccgtttaaccgggttttacctttacccggtaattaaacgttacgttaacgcgtaacggtttcccgtaaccgggtaacgggtttaccctttaaggttaccccggttaccggtccggtaaaccgggtcccgtaaaccgggttaacccgttcgggtacccttaccggtccgttaccgttacggaccgttacccgttaccggaacccgtaccgaccgttaccccggttccccgttaccgttcccccggtacccgg

SEQ ID NO: 245553 - DNA, 818 bp, Homo sapiens
  misc_feature: GYAE6OF02FO5US.18.63.F08.1.454.CMB.1.raw
  modified_base (658)..(658): a, c, t, g, unknown or other
  misc_feature (658)..(658): n is a, c, g, or t
tcagtacgagtatgcacgaccggtgctcgatttagcgatcgtataagggggacgtccgtgtgccccaccatggacacactttgctacacgactcctgctgctgaccaccccttcctggtcttgtcccaggtcaccttgaaggagtctggtcctgtgctggtgaaacccacagacgaccctcacgctgacctgtctccgtctcgtcgggttctcactcagcagtactaagaagtgggtgtagagcgtggtcctccgccgaccggacccccgggggaacggccccgtgggacggtggaccttcggccaacgactttacgttttttcgaagttacggaaaaccgtaaaaacttacccttaaaccaaactaacctaacttccttaccgttaaggaaaccggaacccgtaaggtaacgttaccctaaccctaacgttacccgttaaccccgaaacgggtaaccctaaccccttaaacccgaaaaacgggtccccgtaagggttacccgggtttaacccttaacccgtagttaaccgtaacttaacccgaaacccgttaccggtacccgtacggacccggaaccgaacctaccggaacccaactaagttactttcgtgtacgtccgttaccgggtttttacttccgttaacaacttagtaacgngtaacgtctacgggtccggtaacgttagttacggaccgttccggcggtaccgaaccgggtacctccgggtaccgtacccggttacgtaccctacgtaccgtaccctttacccgaaccgttaccgggacccctccgtcccgttacccttccccggtcccgg

SEQ ID NO: 245554 - DNA, 692 bp, Homo sapiens
  misc_feature: GYAE6OF02JPTKP.18.63.F08.1.454.CMB.1.raw
  modified_base (623)..(623): a, c, t, g, unknown or other
  misc_feature (623)..(623): n is a, c, g, or t
  modified_base (637)..(637): a, c, t, g, unknown or other
  misc_feature (637)..(637): n is a, c, g, or t
tcagtacgagtatgcacgaccggtgctcgatttagcgatcgtataagggggacgtcctgtgccccaccatggacacactttgctacacactcctgctgctgaccaccccttctggtcttgtcccaggtcaccttgaaggagtctggtcctgtgctggtcgaaacccacagacgaccctcacgctgacctgctccgtctcgtggttctcactcagcagtactagtaacgtgggtgtgacgcgtcggcctacccggccggaccgggacccccgggggtaacggtccccggtagggtacggtcggtaccgttgacctaactacgtttagtttttacgacgttacgtaaacgtaaaaacttcccgtaacaacgtactatcgtacgtaggtaacacgagtacgtacctaccgtaactccgtaacgaacggtaccacctaaaccgtaaactccggtaacgtccggttacctaccgtatacgtactaccgaacctcggaccgtggaccgaacctacgaccgacctactattacttcgtggtcctacgtttacggttcttacattaactagtctcgagtccgtacgggtccgttactagtttacgccgtttccgagggcctacggccgttntcgtccgtcttacncgtaccgtacgtaccgaaccggccgtcccgttactcccgttcccgtacccgcccg

SEQ ID NO: 245555 - DNA, 843 bp, Homo sapiens
  misc_feature: GYAE6OF02JLD12.18.63.F08.1.454.CMB.1.raw
tcagtacgagtatgcacgaccggtgctcgatttagcgatcgtataagggggactcctgtgccccaccatggacacactttgctacacactcctgctgctgaccaccccttcctgggtcttcgtcccaggtcaccttggaaggagtctggtcctgtgcgtaggtacgaaacccacaggacgaccctcaccgctgacctcgcctccgtctcgttcggttctctactacacgctaagtacgtaagtaaggtggggtgtaggtcggtccgtcggtcccgtcccggcccggacccggggtacccccgggggaaccggtcccggtggggacggttcggtccttacgaccgtaaccttagttttaccgtttttacgtagtttaacggaaaacgttaaaacctacctaaccaacctactactccgttacgaacgtaacgtaaccgtacgaacgtacctacctactacccgtaaccgtaaacggaaccctaaccgtaaacccgaaacggtaccggtacggttaccggttacctacggtactacgtaacctaccgtaccgtcggtacctcggaacacgtaccacgtaccctaagttaacttctttaggacgttccgttaccggtttaacggtttccttaacgttaaaacgaacgttaacgaccgttacggaccgttccgggtaccgggtttaccgggaaacgtttacttaccgtcccgggttaacggaccgggttaaccggtacccggttaccgttccggtacctacccggttcctaaccgtttccgccgtaacccgttaccgaaccgggttcgccccttaacccggttcccgtccccccggtacgtacccgg

SEQ ID NO: 245556 - DNA, 766 bp, Homo sapiens
  misc_feature: GYAE6OF02G4VYT.18.63.F08.1.454.CMB.1.raw
  modified_base (236)..(236): a, c, t, g, unknown or other
  misc_feature (236)..(236): n is a, c, g, or t
tcagtacgagtatgcacgaccggtgctcgatttagcgatcgtataagggggacgtccctgtgccccaccatggacacgactttgcgtacacactcctgctgctgaccaccccttcctgggtcttgtcccaggtcaccttgaaggagtctggtcctgtgctggtgaaacccacagacgaccctcacgctgacctgcctccgtctctgggttctcactcagcagtactagagtgggtntgacgcgtgcctccgccgacggcccccgggaagccgtggagtcgtctcgacctactacttacgttttacgtagttacgtaacgtaaactacctaacaacactactcgtacgtacgaaccgacgacgtaccgtacctacctactaccgtaccgaaccgacccaaccctaaccgaaaccgtaccggtacggttaccgttaccctaaccgtacgtacgtacctaccgtaaccgtaccgtacccgtacggaccgaccaccgaccgtacctaacttacttacgttacgtcggtacggtaccggttacggtttaccttacctaacttaacgtacgtacgtaccgtacggtccggtaccgggtaccggtaccgttaccgttaccgtaccgtaccgggtaccgggtacccgtaccgggttacccgtccgttacccgtacccgttcccgttaccgtacccgtacccgttacccgtacccgaacccggtacccggtaccccgttacccggttacccccgttaccccgttccccggtccgg

SEQ ID NO: 245557 - DNA, 542 bp, Homo sapiens
  misc_feature: GYAE6OF01ADH1A.19.75.G09.1.454.CMB.1.raw
  modified_base (389)..(389): a, c, t, g, unknown or other
  misc_feature (389)..(389): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccaaggggcagcttggctgcagcagcaccggggccaccctcccaagcctcctgtcctacaggaactacccaaccggccctcgacgggactctcagagagattctctgcatccgaggtcaggaaacacacgcctaccctagacctatttcncggacctccacgcctagacgacgaggctcgacttatactgttacagcggtaggacagcgacgcctcgctcgcgttgggtgttcgggcggacgggaccaagcgtcggacccgtcgtcgggtccacggacccgaacggtccgtccggtcccccgg

SEQ ID NO: 245558 - DNA, 581 bp, Homo sapiens
  misc_feature: GYAE6OF01D9VGT.19.75.G09.1.454.CMB.1.raw
  modified_base (234)..(234): a, c, t, g, unknown or other
  misc_feature (234)..(234): n is a, c, g, or t
  modified_base (402)..(402): a, c, t, g, unknown or other
  misc_feature (402)..(402): n is a, c, g, or t
tcagtactctcgtgcacgaccggtgctcgatttagtatagacatcaggggtccgaaacagaccttcgagcaagccatacgtgggaatctcgcacctatgccctgggctctgctcctcctgaccctctcactcactctgctagtgtcagtggtcctaggctagggctgtaactcagccaccctcggtgtccgagggcttgggacgaaccgcactcgtcacctgcacgtgggaacngcaacatgttggcaaccgaagggcagcttggctgctagcagtcacgggccacctcccaagctacctgtccgtacgaggaataccaaccgggccctcagggatactcagagagattctctgcatccaggtcaaggaaactacgagcccgtccctagaccctactttccncggtacctcccgaagccctagaaccgacgtaacgggcctggtaactattactgttacagacgtggacctagccaagcctcgactgcgttgggtcgttcggacgggtagggtaccaaggaccgtcggaaccccgtccgtaggggtccaacggacccgaagggtccctcggtaccccccgg

SEQ ID NO: 245559 - DNA, 719 bp, Homo sapiens
  misc_feature: GYAE6OF01A7BH7.19.75.G09.1.454.CMB.1.raw
  modified_base (225)..(225): a, c, t, g, unknown or other
  misc_feature (225)..(225): n is a, c, g, or t
tcagtactctcgtgcacgaccggtgctcgatttagtatagacatcaggggtccaaacagaccttcacgcaagcatagtggaatctgcaccatgccctgggctctgctcctcctgaccctcctcactcactctgcagtgttcagtggtccaggtcagggctgactcagccacctcggtgtccgagggcttgggacgaaccgccactctcacctggcactgggaacngcaacatgttggcaacgaagggcagcttggctgcagcagcgaccgggccacccgtcccaagcctccctgtacccgtaacgacggaactacccaaccggccctacgacgggatcgtacgaagacgaagtacttactactgactacgttaccgaggtacgaacggaaaccacgaacggtacccgtacccgtagaacccgttactttaccgtacgggtaacctcccgaagtacccgtacggtaacccgaacggaacggtaccgttacggtaacctttaacgttttaacctacggttacctacgggtccgggttacgggaaccgtacggacctaacggtcccgttacggcctacgggtcgttacggggttcggttaccgggtaccgggtaacggggtaaccgtaacgggtccgttaacgggtaccccgttccgggttacgggtacccggttaacggttacccggtaaacgggtcccggtaacccgggtaccccccggg

SEQ ID NO: 245560 - DNA, 666 bp, Homo sapiens
  misc_feature: GYAE6OF01ASHP5.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgatcctcctgaccctcctcactcactctgcagtgtcagtggtccaggcagggctgactcagccacctcggtgtccgagggcttgggacgaaccgccactctcacctgcactgggaacagcaacaatgttggcaaccgaggggcagcttggctgcagcagcaccggggccaccctcccaagcctcctcgtccctacacggaactacccgaaacccggccctacgacggggacttcctcgaagacgacgtattctctgctatcccgaggtacaacgggaaacacgacgccctaccctcgaaccctatttccgtcggacctcccacgtccgtacgaccgacggacggtctggtacttattactggttacagtccggttagggaaccgtagaccgtacgcccgttcggccgtacggtcggttcggggtacggtttccggggaccggggtacggggtaacccgtaacgggtccgttaaccggggaacccccgtttcccgggttacgggggttaccccacgggtaaccccccggaaggggttccccgtcccccggttacccccccggg

SEQ ID NO: 245561 - DNA, 551 bp, Homo sapiens
  misc_feature: GYAE6OF01A8S8O.19.75.G09.1.454.CMB.1.raw
  modified_base (375)..(375): a, c, t, g, unknown or other
  misc_feature (375)..(375): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccgaagggcagcttggctgcagcagcaccggggcaccctccaagctcctcgtcctacaggaataccaaccggccctcagggatctcagagagattctctgcatcaggtcaggaaacacagcctcctgaccatttcnggtactcagccgtgacgacgacggctgacttaactacttgtcaggtcgtacggacagcgtagcctcgcgtgcgttgggtacgttcgggacgggacgggaccgaaggccgttcggaaccccgttccgtcggggtacccgacggtaccccgaaacgggtcccgtcggtacccccccgg

SEQ ID NO: 245562 - DNA, 495 bp, Homo sapiens
  misc_feature: GYAE6OF01D1YXB.19.75.G09.1.454.CMB.1.raw
  modified_base (374)..(374): a, c, t, g, unknown or other
  misc_feature (374)..(374): n is a, c, g, or t
  modified_base (421)..(421): a, c, t, g, unknown or other
  misc_feature (421)..(421): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgtcactctcacctgcactgggaacagcaacatgtggcaaccgagggcagcttggctgcagcagcaccgggccaccctccaagctcctgtcctacaggaactaccaaccggccctcagggactctcagagagattctctgcatccaggtcaggaaacacagcctcctgacctattcngactccagcctagacgacgagctgactattactgttcagcgtggacngcacgcctcgctgcgttgggtcgtcggcggaggaccagctcgacctcgtcggtcacgccgacgcgtcgtccccg

SEQ ID NO: 245563 - DNA, 510 bp, Homo sapiens
  misc_feature: GYAE6OF01ELWN7.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccgaaggggcagcttggctgcagcagcaccggggccaccctcccaagctcctgtcctacaggaatacccaaccggccctacgagggatctcagagagacttctctgcatccaggtcaggaaacacacgcctccctgacctatttctggactccacgcctagacgacgaggctgactattactgttcagcgtgggacagcagcctcgctgcgttgggtgttcggcggaggacagcgtcgccctcgtcggtcacgcccgaaggctcgtccccg

SEQ ID NO: 245564 - DNA, 678 bp, Homo sapiens
  misc_feature: GYAE6OF01C1CH5.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacatgtggacaaccgaaggggcagcttggctgcagcagcaccggggccaccctcccaagcctcctgtcctacacggaactaccgaacccggcccctacgacgggactactcgagaagagtacttctactgcaactccaggtcaaggaaaccacgacgccctcccgtacgacctactttacgtacggtacctccgaacgtcccttacggaaccggtaccggacgggtactacggtaaccttactttaccgttcgtttacgacggtacggttacgggtacgaacggtcgtaacgtcccgttcggtccgttcggtccggtttcggggttcggttccggggaccgggtacggggtaaacccgaacgggtcccgtaccgggtacccccgttaccggtaccgggttaccgaacccgggtaccccgaaaccgggtcccgttaccccgggtcccccccgg

SEQ ID NO: 245565 - DNA, 539 bp, Homo sapiens
  misc_feature: GYAE6OF01BW84F.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccgaaggggcagcttggctgcagcagcaccggggccaccctccaagctcctgtcctacaggaactaccaaccggccctcgacgggactctcagagagtacttctctcgcactccgaggtcaaggaaacacacgcctaccctcgacctatttccgtcggtacctccgacgcctgacgacgacgctgactatactgttcagtcgtggacagcacgcctcgctcgtcgttgggtcgtcggcgggacgggacctaggcgtcgacccgtcgtcgggtcacggaccacggtccgtccggtcccccg

SEQ ID NO: 245566 - DNA, 515 bp, Homo sapiens
  misc_feature: GYAE6OF01BG3VT.19.75.G09.1.454.CMB.1.raw
  modified_base (223)..(223): a, c, t, g, unknown or other
  misc_feature (223)..(223): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacngcaacaatgttggcaaccagggcagcttggctgcagcagcaccggggccaccctcccaagctccctgtcctacaggaactaccaaccggccctcagggatcctcagagagattctctgcatccaggtcaggaacacagccctcctgacccatttcctggacctccagcctcgacgacgaggctgactacttactgttcagcgtgggacagcagcctcgctgctgggtagttcggcggagggaccagcctcggacccgtccgtgggtcacgcccaagggcctcggtccccccg

SEQ ID NO: 245567 - DNA, 552 bp, Homo sapiens
  misc_feature: GYAE6OF01AKYV0.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccagggcagctggctgcagcagcaccggggccacccctcccaacgcctcctcgtcctacacggaactacccgaaccggccctcgagggactctcagagagattctctgcactccgaggtacaggaaacacagccctccctagaccctattctcggacctccacgcctagaccgacgacggctgactattactgttcagtcgtgggacagcacgcctcgctcgcgttgggtgttccgggcggacgggccgaggtcgtcggacccgtccgttcgggtccgacggaccccggaacggtccgtcccggtccccccgg

SEQ ID NO: 245568 - DNA, 547 bp, Homo sapiens
  misc_feature: GYAE6OF01B0SMJ.19.75.G09.1.454.CMB.1.raw
  modified_base (432)..(432): a, c, t, g, unknown or other
  misc_feature (432)..(432): n is a, c, g, or t
  modified_base (446)..(446): a, c, t, g, unknown or other
  misc_feature (446)..(446): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaaccgaaggggcagcttggctgcagcagcaccggggccaccctcccaagctcctgtcctacaggaactaccaacccggccctacacgggatctcagagagattctctgcatccaggtcaggaaacacagccctcctgaccctattctggacctccagcccgtagacgagacgctactaacttacgtattcgtanacggtggacggaancgacgtaccgtccgtcgcgtcgtcggtggttcggtcgggacgggacggcgacgtcgccgtccctcggtcggtacgccgaccggcgtccgtcccgtccccgg

SEQ ID NO: 245569 - DNA, 643 bp, Homo sapiens
  misc_feature: GYAE6OF01A9UE4.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaccgccactctcactgcacgtgggaacagcaacatgtggcaaccgagggcagcttggctgcagcagcaccggggccaccctcccaagctcctgtcctacaggaactaccgaacccggccctcgacgggactccgtacaggtacgacgattcctcgtcgacactccgaaggtaccgaacggaaaccacgtacggccctacccgtagaaccctagtttccgtacgggtacctccgaacgtccgtacgaccggaacggacggtccgtacgaccttacgtttaccgtcgtttacgacgggtcggtacgggaaccgtacggacctacggtcccttacggcctcggtccggttgggttcggttccgggaccgggagggtacccgacggtcctaccgggacccttccggtcgggtaccgaccgtacccggaagggtcccgtccgggtaccccccgg

SEQ ID NO: 245570 - DNA, 660 bp, Homo sapiens
  misc_feature: GYAE6OF01BNY74.19.75.G09.1.454.CMB.1.raw
  modified_base (359)..(359): a, c, t, g, unknown or other
  misc_feature (359)..(359): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcacgcccacccgtcgggtcgtccggaggggtccttggggaccgaaccgccactctcacctgccagtagggaacagacaacaatggttggacaacggaagggcagcttggctgcagcagccgaccgggccaccgtccaagctccgtctaccacaggtaacaccgaaccggcctagacggactcgacagagacgattcncgtagctacgtcgtacggacaaacggaacctacaacggtccctacccgtacgtaaccttacgtttccgacggttaccaccgtacgaccctacggaaccgacggacgtcgtacggtaacttacgttacgtcgttacgacgggtcggtacgggactacggaccgtaccggtacctcgtccgttaggtcggttttccggggtcggttccggggacgggttaacgggaaccgtacggtacgtccggtaacccgtcgggttcggtaccgaacggcccgtaaacggtcccgtcccggtaacccccgg

SEQ ID NO: 245571 - DNA, 538 bp, Homo sapiens
  misc_feature: GYAE6OF01D8NDA.19.75.G09.1.454.CMB.1.raw
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
tcagtactctcgtgcacgaccggtgctcgatttagtatagacatcaggggtccaaacagaccttcagcaagcatagtgggaatctgcaccatgccctgggctctgatcctcctgaccctcctcactcactctgcagtgtcagtggtccaggcagggctgactcagccaccctcggtgtccgagggcttgggacgaaccgccactctcacctgcactgggaacagcaacaatgtggcaaccgagggcagcttggctgcagcagcaccggggccacccctcccaagcctcctgtcctacgaggaactaccaaccggccctcagggatctcagagagattctctgcatccaggtcaggaaacncacgccctccctcgacctatttccgnggacctccacgcctgacgacgagctgactattactgttcagcgtgggacagcagtcctcgctcgtcgttgggtcgttcgggcggacgggaccagtccgtcgaccccgtcgtcgggtaccacggcccgaacgggtcccgtccggtacccccgg

SEQ ID NO: 245572 - DNA, 578 bp, Homo sapiens
  misc_feature: GYAE6OF01A6LYR.19.75.G09.1.454.CMB.1.raw
  modified_base (344)..(344): a, c, t, g, unknown or other
  misc_feature (344)..(344): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccgaaggggcagcttggctgcagcagcaccgggccaccctccaagcctcctgtcctacacggaactaccgaaccggccctcgacgggactctcagagacgattcnctgcactccgaggtacaaggaaaccacgacgtccctaccctcgaaccctatttccgagacctaccacgcctagacgacgagctgactattacgtcgttacacgtcggtagggaacacggccacgtcctcgcgttcgcgttgggttcgtccgggcgggtacgggaccgtaaggtccgtccggtaccccgtcggtacgggtccacggacccgaacgggtcccgtcccggtcccccg

SEQ ID NO: 245573 - DNA, 550 bp, Homo sapiens
  misc_feature: GYAE6OF01EU1JT.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttgcaaccgaagggcagcttggctgcagcagcgaccggggccacccctcccaagcctcctgtcctacacggaactacccgaaccggccctcgacgggactctcacgagagacttctctgcacgtccaggtcaaggaaacacacgcctaccctcgacctactttctcggtactccagcctcggacgacgaggctgactattactgtcagcgtcgggacagcgtacgccttcgctcgtcgttcgggtgttcgggtcggacgggaccgaaggcgtcgacccgtcggtcggtacgaccgaccgacggccgtcccgtccccgg

SEQ ID NO: 245574 - DNA, 908 bp, Homo sapiens
  misc_feature: GYAE6OF01E18FT.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcacgtgggaacagacaacaatggttacggacaaccgaagggcaagtcgttcggactcgcacggcacggccgacccggggcccacccctcccaagccgtccctcgtacctacgacggaactacccgaacccggccctaccgaagggactccgtacgaaggacgtaacgtaacgttctcgttacgctaacgtaccgaacggtacgaaacgggaaaaccgtaaccgacgtaccccgtaccccgttacgtaaccccgttaacgtttttacccgtacgggtaaccccttacccggtaaccgtaccccgttacgggaaacccggtaacgggtacgggtaacccgtttaacggtaacccgtttaaaccgtttttaaccggttacggttttaacccgacggggttaccgggtaaccgggggtaccgtaaccgggtacgtaacccgggtaccccgttaccgggtcccggttacgggtttacccgggtttacggggggtttaccggggtttaaccccgggggacccgggggggttaaacccgggtaaccccggttaaaacccgggggtcccgtttaaccccgggggttaccccccggtttacccgggttaacccgggggggtttaaccccaacccggggtttaaacccccccgggttaaacgggttaccccccccgggttcccccggtttaacccccccccggggg

SEQ ID NO: 245575 - DNA, 660 bp, Homo sapiens
  misc_feature: GYAE6OF01EPO9I.19.75.G09.1.454.CMB.1.raw
tcagtactctcgtgcacgaccggtgctcgatttagtatagacatcaggggtccgaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacatgttggacaaccgaagggcagcttggctgcagcagcaccggggccacccctcccaagcctcctgtcctacaggaactacccgaaacccggccctcgagggactcgtacagagagattctctgcagtccgaggtcaacggaaacacgacgccctccctgaccctatttccgtggaccttccgagtcctaggacgtacgaggtctgaactttacttacgtcgtttacgaggtacggtggggaccacggccgtaacggtccccttcggaccgttcggttccggtttgggggttaccggtttccggggaccggggtaacggggtaacccgtaaacgggtcccgttcccgggtaacccccgttcccgggttacggggtacccgaaccgggtacccccggtaaacgggtccccgtaccccgggttccccccccggg

SEQ ID NO: 245576 - DNA, 737 bp, Homo sapiens
  misc_feature: GYAE6OF01B9GOH.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagcccaccctcggtgtccgagggcttgggacgaccgccactctcacctgcacgtgggaacagacaacgaatgttggacaaccgaaggggcagcttggctgcagcagcgaccgggtccaccctacccagcctcctcgcctacgacggaactacccgaacccggccctacgacgggtactctaccgaggagagtacttctctacgcctagtccgaggtacgaacggtaaacactacgacccgtacccgtacgaaccttactttccgtacggaccttcccgtaacgtcccgtaggtaaccggaaccgggacggtaccgttacgtaaccgttttaacgtttacgtttacggtttaccggaaccgggttcgggttaggggaacccgacggtaccgtaaccgggttcccgttcggttaccgttcgggtttccgggtttagggggttccggttaccgggggaccggggtaaccgggaccgtaaccgggtcccgttacccgggaccccccggtttcggtaccgggggtacccgtaaccccgggacccggtaccgggtccccgtcccccgggtaccccccggg

SEQ ID NO: 245577 - DNA, 763 bp, Homo sapiens
  misc_feature: GYAE6OF01DL5AF.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgcctcctcctgacccctcctcactcactctgcagtgtcagtggtccaggcgagggctgactcacgcccaccctggtcgtccggagggtcttcgggaccgaaccgccactcctccacctgcacgtgggaacagacaactatggtacgacaaccggtagggcagtcgttggactgacagcgacggacccgacccgggccctaccccgtaccgaacgtcctccgtcgtacctaacgacggtaacctacccgtaacccggccctagacggtactcgacaagtagtacgtacttctcgacgtactacgtacgaacggtacaaacgtaaaccaccgtaaccgtccccgtacccgtacgtaaccctttacgttaccggtaccggtaacccgttccccgggtagtacccggaacggaccggtaggccgttaacgttaaccctttacgttaccggttagtaccgacgggtaccggttaacgggacacggtaccgtaccgggttcctccggtcgtttcggtcgggttggggttaccggttaccggggaccgggttaaccggaaaccggtccgtaccggtttaacccgggtcccccggttaccggggtacgtcccggaacccgtccgggaacccggttccgtaacccccgggtcccccggtttacccggg

SEQ ID NO: 245578 - DNA, 631 bp, Homo sapiens
  misc_feature: GYAE6OF01DMVTH.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcgagggctgactcagccacctcggtgtccgagggcttgggacgaaccgccactctcacctgcacgtggaacagcaacatgtggacaacgagggcagcttggctgcagcacgccgaccgggcccacccctcccgaacgcctccgtcgtacctacgacggaactaacccgacccggaccctcgaagggactcctacgagagtacgtattctctcgctactaccgagtacgacggaaacacacgcctaccgtcaccttacgttccgtacggacctccacgtcctacggacgccggacgtctacgtaactatttaccgttgttacgacgtcgggtacggacacggactacgccgttcggaccgttgggtcgttcgggttcggtccgggacgggaccgggaaccgtacgggccgttacccggtacccgttcgggaccgggtaccgaaccgtacccggaaccggtcccgtcccggtaccccccggg

SEQ ID NO: 245579 - DNA, 805 bp, Homo sapiens
  misc_feature: GYAE6OF01CAIY6.19.75.G09.1.454.CMB.1.raw
tcagtactctcgtgcacgaccggtgctcgatttagtatagacatcaggggtccgaaacagaccttcgagcaagccatacgtgggaatctcgcacctatgccctgggctctgctcctcctgaccctctcactcactctgctagtgtcagtggtccgtaggtcagggctagtaactcgacgccacccgtggtagtccggagggtcttgggacgaaccgcctacgtcgtcaccgtggccacgtcgggaacgacgacaacgtacttggttacggacaaccggagggcagtcgttggctagacgtagcgtacgtccgaccgggccctaccccgtaccgaacgtcctccgtcgtaccgtaacgacggaacgttaccgacccggtcctacgtaggtacttcgtaccgaaggtacgtacgtacttcctactacgtcctagtccgaacggtacaacggtaaacacgtacgacccgtacctacgtaaccttacgtttaccgtcggaaccttacccgaccgtaccgtaacggaaacccgtaacggtaccgttacccgtaggtaacctttacggtttaacgtaggttaaccgacgggtaccggtaacggggactacggtacccgtaacggttcccgtaacgggtccgttcgggttacccgggttttacggggtaccggttaccggggtaaccggggaacggttaacccggaaacgggttacccgggtaccggtaaccccgggttcccgggttaaaggggtccccgaaacgggttacccccggtacggggttccccgtccccggggttaacccccggg

SEQ ID NO: 245580 - DNA, 753 bp, Homo sapiens
  misc_feature: GYAE6OF01EW49O.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcacgtgggaacagacaacaatgtggacaaccgagggcagcttggctgcagcacgccgacccgggccacccctacccgaagcctccgtcgtacctacgacggaactaccccgaacccggccctacggacgggtactaccgtacgtaacggaggtacgtacttccgtcgtgacacgtaccgaaggtacgaaacgggaaaccacgaccgcccttacccgtacgtacttacgttttaccgacggtacctcccgtacgtcccgtacggaacccgggtaacggtacggtccgttaacgtaacgtttaacgtttaccgtttacggtttaacccggacggggttaccggttaacggggaacctacggaccggtaccggtcccgtttacggccggtttcggggtccggttttacgggggttccgggtttaccggggaccggggtaaccggggaaccctaagggtcccgttaacccgggtaccccgttccgggtacgggttcccgaaccggtaccccggtaacggtccccggtccccggttaccccccggg

SEQ ID NO: 245581 - DNA, 659 bp, Homo sapiens
  misc_feature: GYAE6OF01C7SSF.19.75.G09.1.454.CMB.1.raw
  modified_base (323)..(323): a, c, t, g, unknown or other
  misc_feature (323)..(323): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactggaacagcaacaatgttggcaaccgaaggggcagcttggctgcagcagcgaccggggccacccctccaagcctcctcgtcctacaggaactaccaccgcctcgaggntctcagagagtattctctgcatccaggtacacggaaacacgacgtccctcccgtacgtacctactttccgtacgggtaccttcccgacgtcctaggaaccggacgtacgggactacgtaacttaacgtttaccttacggttacgacggtcggttacgggaacgacggccgtacgtcccgttacggtcgttcgggtacggttttcggggttcggtttaccggggcggggtaaccgggacccgtaaagggtcccgttaccgggtaacccccgttccggttacggggtaccctaaccggtaccccggtaaacgggtcccgttcccgggtacccccccgg

SEQ ID NO: 245582 - DNA, 716 bp, Homo sapiens
  misc_feature: GYAE6OF01CISK3.19.75.G09.1.454.CMB.1.raw
  modified_base (219)..(219): a, c, t, g, unknown or other
  misc_feature (219)..(219): n is a, c, g, or t
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
tcagtactctcgtgcacgaccggtgctcgatttagtatagacatcaggggtccaaacagaccttcagcaagcatagtgggaatctgcaccatgccctgggctctgctcctcctcgaccctctcactcactctgcagtgtcagtggtccaggcagggctgactcacgtccacccgtggtacgtccggagggtcttacggggaaccaccgtcctacttccncaccgtgcaaccgtagggaacaggacctaaagagttcggtacgacgaaaccggtagggctagtcgttgcgtgcagacgacgaccgacccgggtccaaccgtaccaacgtcctacgtcgtaccacgaggtaaccaccggaaccncccgtagacggtacacgacgacgacggactntccttcggacgctaaccgtacggtacgtaaccggaaacgaacaacggtccgacccttacccggtactaaaccgttcgtttaccggttacgacccttaccggtaacctacggtaccgaaacggtacggacgtacgtacgtaacttacgttaccgtagttcggaacgcgggtacgaagccgacgcctttccgaacgtcgttcccggtaagttggggtccgttacggggaccggttaccggacgtaacccggcgttaaaccccggtcccggttacggaccggttaccacgggtaacccgtcggtccccgtcccggttccccccggg

SEQ ID NO: 245583 - DNA, 695 bp, Homo sapiens
  misc_feature: GYAE6OF01BW8N2.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctctcactcactctgcagtgtcagtggtccaggcagggctgactcacgcccacccgtcggtcgtccggagggtcgttggggaccgaaccgccactcctcacctgcactggaacagacaacatgtagacaacgaggcagcgtaggctgacagcacgccgaccggggcccaccccgtacccgaacgcccttccgtcgtaccctaacgaaggtaacctaacccgaacccggtcccgtacggacgggtactcctacgagaacgacgtacttcgtctcgactacgtccgtaagtaccgaaggaaaccgacaccgcccttacccgtacgtaccttcgtttaccgagtaccctcgacgtcctaggaacggcgaacgtcgtacgtactttaacgtcgttacgtcgtacggtcggtacggaaccgacgaccgtacgtaccgttacgtcgttacggttcggttcggggtacggttcccggggaacgggtaacgggacccggtacgtacccggtccggtaccccggttcggttaccgggtaccgtaacccggaccgggttaaccgtcccggtccccgttaccccccggg

SEQ ID NO: 245584 - DNA, 692 bp, Homo sapiens
  misc_feature: GYAE6OF01EAU2S.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcacgccacccgtcggtgtccggagggtcgttcgggaccgaaccgccactctccacctgccacgtgggaacagacaacatgtcggacaacgagggcagcttggctgcagcacgcgacccgggcccaccccgtaccgaacgtcctccgtcgtacctaacgaacggaacctacccgaacccggccctacgaacgggcttacacgaacgacgacgtacttcgtctcgctacgtaccgaggtacgaacgaaacacacgtccctacctacgacctagtttccgagtaccgtaccgacgccgtacggaacgacggacgtccgtagttaaccttagtttaccgttgtttaccggacggttacggtacgggaccgaacgaccgtaccgtcccgttccgtcggttacggttccgggtttggggttccggttaccggggtaccgggtaaccgggtaacccgtacggccggttaacccgtccccggttccggtaccgggtacacccggacccggtacggttcccggcccggttaccccccgg

SEQ ID NO: 245585 - DNA, 610 bp, Homo sapiens
  misc_feature: GYAE6OF01AHJY5.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcacgtgggaacagcaacaatggttggacaaccgaaggggcaggcttggctgcagcagccgacccggggccacccctcccaacgcctcctcgtcctacacggaactacccaaccggccctcgacgggactctcgagagacgtacttctctcgcacgtccgaaggtaccgaacggaaaaccacaacgtcccctacccgtacgacccttactttccgtacggacctccgacgtcctaggaccgtacgagggtccttgtaccttattaccgtgttcgagtcgggtcggacagcgtacgcccgtcgtcgtcggtcgttgggtcggttcgggcgggacggtaccgaggtcgtccggacccgttcgtcggggtccaccgcccggaacggtccgtcccgtccccgg

SEQ ID NO: 245586 - DNA, 791 bp, Homo sapiens
  misc_feature: GYAE6OF01DJPQQ.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgctagtgtcagtggtccaggcgagggctgactcacgcccacccgtcggtcggtccggaggggtcgttacggggaccgaacccgccactctcacctgcacgtagggaacagacaaacagttgtacggacaaccgaagggcagtcgttgctgacagcgacggccgacccgggaccccaccccgtaccgaacgtcctaccgtccgtaccgtaacgacgtaacctacccgacccggtacccgtacggaacgggtacctaccgtacgaagtacgtacgtaacttccgtacgtccgactaccgttaccggacggtaacgaaccggtaaacacgtacccgtccccttacccgtacgtaacccgtttagttccgtaacgtaccctaccggacgtccggtaacggaaccgaccgggtacgacgttaccgtaatttaccgttacgttcgtacgtacgggtaccggaacgggtactaccggtaccgtaccggttcctaccgggttcttcgggtttaccgggttacggggtttccgggtaccgggggtacgggtaaccggggtaacccgtacgggttacccggtacccggttaccccggtccgggttaacccgggtaccggaaccccggtaccccggtaccggtcccccggttccccggttaccccccggg

SEQ ID NO: 245587 - DNA, 727 bp, Homo sapiens
  misc_feature: GYAE6OF01AZGWY.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgatcctcctgaccctcctcactcactctgcagtgtcagtggtccaggcagggctgactcacgccacccgtcggtcggtccggagggcgttacggggaccgaacccgccactctcaccgtgccacgtagggaacacgacaacgaatgttacggacaaccgagggcacgcgttggctagcagcacggccgacccggggccctaccccgtcccaacgtcctaccgtcgtccgtaacgaacggtaacctaacccggaacccggtcccgtacggacgggtactaccgtacggaaggacgaacgttcttaccgtcgttgacctacgtaccgtacggtacgaaacgtaacaaccgacgtccctaccgtactacgttacctttacgtaccggtacctacccgtacgtccgtacggaaccgacggacggtctacgtaactttacgttccgtacgttcgtacggtcggtacggactcggacgtaccgtaccgtacgggtccgttcggtaccgggtttcgggttccgggttaacgggcggggtaacccgggtacgtaccggtacccgtccggtacccggttcgggtaccgggtaccgacccggtacccgacggtccccgtacccggtccccggg

SEQ ID NO: 245588 - DNA, 690 bp, Homo sapiens
  misc_feature: GYAE6OF01CKFLZ.19.75.G09.1.454.CMB.1.raw
tcagtactctcgtgcacgaccggtgctcgatttagtatagacatcaggggtccaaacagaccttcagcaagcatagtgggaatctgcaccatcgccctgggctctgctcctcctcgaccctcctcactcactctgcagtgtcagtcggtccgaggcagggctgactcacgcccacccgtcggtcgtccggagggtccgttcgggaaccgaaccgccactcctccaccgtcgacacgtacggaacacgaacaactagtcggtacgacgaaccgagggctagtcgttgctcgcagcacggaccgaccgggcccacccgtccaacgtcctccgtacgtaccgaacgacgtaacctaacccgacccggtacccgtgaacggtctaccgacgaacgacgtacttacgttcgtcgtcgccgtacgtaccgtacggtaacgaaacgtaaccacgtaccgtccctacgacgtaccttagttcgtacgacctccgagccgtacgacgacggtcacttacgacttacgttaccgtgacgtacggtaggtacgaccgtacgactcgtccgtcgtaccggttcggtcgggttacggggttccggtaaccgggacgggtaaccggtccgtaacggtccgtcccggtacccgtcggtaccggtaccgaccgtaacccggccggtaacccggtcccgtaccccgg

SEQ ID NO: 245589 - DNA, 801 bp, Homo sapiens
  misc_feature: GYAE6OF01B6BA1.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagcccacccgtcggtcgtccggagggtcgttacggggaccgaacccgccgactcctcacctgccacgtagggaacacgaccaaacgtagttggttacggaccaaaccggaggggcaacgtcggttcggactcggaccgacggaccgacggccccggtaaccccgggggaccccctaccccccgtaccccgaacggtcccgttacccgttcgtaccccttaacgaacggtaaacctacccgaacccggtcccgtacgacgggtactcgtacgagacgacgtacttcctcgtcgactacgtaccgtaggtacgtaaacgaaacctaccgtaccgtccccttaccgtaccgtaccttacgtttaccgtaccggtaaccctcccgtaccgtaccgtacggaacccggtacgggtaccggtacttaccggtaacctttacgttacggtttaccgtacgtacgggtacggtacggtaaccgtacggaccgtaccgtccgttaccggtcggttcgggttcggttacggggttccggttaccgggggaccgggtaaccggtacgtaacgggtcccggtcccggtacccgttcgggtaccggttaccggacccggtaccgaccgggtccccgtcccggtacccccgg

SEQ ID NO: 245590 - DNA, 877 bp, Homo sapiens
  misc_feature: GYAE6OF01BPLGV.19.75.G09.1.454.CMB.1.raw
  modified_base (233)..(233): a, c, t, g, unknown or other
  misc_feature (233)..(233): n is a, c, g, or t
tcagtactctcgtgcacgaccggtgctcgatttagtatagacatcaggggtccaaacagaccttcagcaagcatagtgggaatctgcaccatgccctgggctctgatcctcctgaccctcctcactcactctgcagtgtcagtggtccaggcagggctgactcagcccacccgtcggtcgtccggagggtcgtacgggaccgaaccgccactcctcacctgcacgtaggaacngaccaactagtcggtaggaccaacggagggcagtcttggctgcagcgacggaccgaccccggggtacccacccccgtacccgaacgccttcccgtaccggtaccccttaaccggaaccggtaaacccgtaaccccggtaaccccggtccccgttaacggaaccgggtaccttaccgacggaacggtaaccggtaacggttacctttcctccggtacgaaccctacgttacccgggtaaggtaacccgtaaaccgggaaaacccaccggtaacccggttacccccttaccccgttaacgttaaccccgtttaaccgttttacccggaccggttaccctacccggtaacggacccggttaaccggaaccgggaaccggtacggtacctttacgttaacccgtttagtttacccggtacgttacggtacgggtaccggtaccggaccgttggacccgttaccgtcccgttcggtaaccgttcgggtcccggtttaagggggttccccggtttaccgggggaacccggggtaaaccgggtcccggtaccggtccggttaccccgggtaccccggttacccgggtacgggtaccccggaccggtacccccggtacggttccccccggtaccccgtttcccccccggggg

SEQ ID NO: 245591 - DNA, 725 bp, Homo sapiens
  misc_feature: GYAE6OF01DRD0X.19.75.G09.1.454.CMB.1.raw
  modified_base (542)..(542): a, c, t, g, unknown or other
  misc_feature (542)..(542): n is a, c, g, or t
tcagtactctcgtgcacgaccggtgctcgatttagtatagacatcaggggtccaaacagaccttcagcaagcatagtgggaatctgcaccatgccctgggctctgctcctcctcgaccctcctcactcactctgcagtgtcagttggccaggcagggctgactcacggcccaccgtggtcgtccggagggtccgttgggaaccgaaccgccactctcaccgtgcacggtaggaacacgacaaactagttggtacggaccaaaccgggaagggctacggtacgttggcctaggaccaggccgacggtaccggaacccccggggtcctaacccccgtaccggaaacgttccctacccgtttaccgtaacccgtaacggaacggtaaacccgtaacccgaaacccggtcccaacggtaagggacttccggacaacggaagtacgttacgtctacgtgacctacgtaccgaaggtacgaaacgaactaccgaccgtctacccgtatacctcgttacgagtacctaccgtagcgtacgacggtacgngtacgtatacttagttacgtgttacgaggtacggtacggaaccacggccgtaaccgtccgtacggtcgtcgggttacgggtttcgggtaccggggtccgggacggggtaaaccggacgtaacggtctaccccggcgttccggacggtacgacggacccggttacgcccgtcccggtaccccgg

SEQ ID NO: 245592 - DNA, 831 bp, Homo sapiens
  misc_feature: GYAE6OF01DRGFX.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgctagtgtcagttggtccgaggcgagggtctggactcgacgccctacccgtcgggtcgtccggagggtcgtacggggaaccgaacccgccaccgtcctaccaccgtgacctacggtacggaacagtaccaaactagtggtacggactaaccggagggcacggtcgttcggctcgacacggcgacggaccccggacccgggacccctaccccgtaccgaaccgtccgttccgtaccggtaccctaacgggaaaccggtaacccgtaacccggtaaccccggtacccgtacggtaaccgggtaccttccggaccgaacggtaaggtacgtttaccttccgtacgtacgtaccgtaaccgtcggaacggttaacggacggaaaaccaccggttaccccgtcccgttaaccgtacgttaacccgtttaccgtttcccggtaccgttacccgtaacccgtacccggtccggtaacgggaccggtaaccggtccggtaacttcccgttaacttaacgtttccggttacgtaccggttacgggtcggttaaaccggcgaccgtccgttacgcccgttacgttcggtacggttcggttaccgggttgggaccgggcgggtaaccgtccggacgttcccggttaccgtccccgggtggtaccggtaacccggtaccgcccgtaacgggtccccgttcccggtaccccg

SEQ ID NO: 245593 - DNA, 818 bp, Homo sapiens
  misc_feature: GYAE6OF01CNWDD.19.75.G09.1.454.CMB.1.raw
  modified_base (488)..(488): a, c, t, g, unknown or other
  misc_feature (488)..(488): n is a, c, g, or t
tcagtactctcgtgcacgaccggtgctcgatttagtatagacatcagggggtccaaacagaccttcagcaagcatagtgggaatctgcaccatgccctgggctctgctcctcctgaccctcctcactcactctgcagtgtcagtcggccgaggcagggctgactcgacgtcccacccgttcgggtcgtaccggagggtccgttaggggaccaaccgccactctaccaccgtgcacgtagggaacacgacaacgagttggtacggacaaccggaagggcgagtcgttggacgcgacgtacggccgacggaccggaaccccggggtccccaaccccgtacccgtaaccggtccttccgtacggtacccgtaacgaacgaaccgtaacccgacccggcccttaacgacgggtactaccgtaacggaagtaccgagttaacttcgtacgtcaccgtaacgccgtaacgaccgtaaacgaaccacgtaacccncccgtaccgtaccgtacctttacggttacctacgggtacctaccggacccgtaccgttaacggaaccggtacggacggtttacgtaccggttaatttaccggttacgttaccgttaggaaccgggtgggtaacggtacgaaaccggtccgaccggtacccgtttgacccgggttcgtacggggtttcgggtaaccggggttccggggacggggaaccggttacccgggtaaccggttcccgttacccggggtaccccggtttaccggtaccgggtcccggtaacccggaccggtaccccgggtaccgtttcccccgggttaccccccggg

SEQ ID NO: 245594 - DNA, 803 bp, Homo sapiens
  misc_feature: GYAE6OF01DCZ82.19.75.G09.1.454.CMB.1.raw
  modified_base (138)..(138): a, c, t, g, unknown or other
  misc_feature (138)..(138): n is a, c, g, or t
tcagtactctcgtgcacgaccggtgctcgatttagtatagacatcaggggtccaaacagaccttcagcaagcatagtgggaatctgcaccatgccctgggctctgcctcctcctcgaccctcctcactcactctgacngtgtcgagtcggtccgaggcgagggctgacctcgacgcccgtcccgtcggtcgtaccggacgggtccgttacggggaaccgaccgcctacctcctccaccgtgacctacggacggaacacgacaactagttggtacggacgaacggagggcacgtcgtcggctcgactacggcgaccggaccggacccgggccacccgtacccgtacgccgttccgtacggtaccgtaacgaaccggtaaccgtacccgacccgtccgtacgggacgtacctacgtcggaagtacggtaactttaccgtacgttaccgacgtacctacgtacccggtaacgggtaacaaaccgggacttaacccggaccttacccgttaccgtaaccgtaccgttacgtttaccgtaccggtacctaccgtacccggttaccggaaccggtaaccggtaaccggtacgttacgtaccgttaaccggtttaacttaccggttcgggtacggtacgggtacgggtaaccgtacggttacacccggtaccgtccggtccgttaggttccgggttgggttaccgggtcggggtaccggtacggtaccgggtacccgtacggtaccggtcccggtacccggtacggacgtacccgacggtacccgaccggttccgtccccggttacccgg

SEQ ID NO: 245595 - DNA, 724 bp, Homo sapiens
  misc_feature: GYAE6OF01DTPZ0.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccggaggtcttgggacgaaccgccacgtctcacctgcactgggaacagcaacatgtaggacaaccgaagggcagtcttggctcgcagcacgcgaccggggcccaccctcccaagtcctctcgtccacacggaactaccgaccggccctacgacggctctacgagacgtacgtacttctccgtacgctactaccgtacggtaccgaacggaaaccacgaccggcccttacccgtcgtaacccgttagtttcccgtaccgggtaaccctttcccggacggttacccgtacgggaaacccggtaacgggtaccgggtaccttaccgggttaaacctttacgtttaaccgtttcggttaccgaccgggtacgggttacgggaaccgtaggtaccggaccgttcccgtccggttgttaccgggttcggttcggggttacgggttccgggtaacgggacgggtaacccgagggtcccgttccggaaccccgtttccgggacgggttcccgaaccggtaccccggaacggtcccgttccccgtaccccccggg

SEQ ID NO: 245596 - DNA, 657 bp, Homo sapiens
  misc_feature: GYAE6OF01ALA3I.19.75.G09.1.454.CMB.1.raw
tcagtactctcgtgcacgaccggtgctcgatttagtatagacatcaggggtccgaaacagaccttcagcaagcatagtgggaatctgcaccatgccctgggctctgcctcctcctgaccctcctcactcactctgcagtgtcagtggtccaggcagggctgactcacgcccacccgtcggtcgtccggagggtcttacgggaccgaaccgccactcctcacctgccacgtcggaacagacaactagtcggttacggaccaaaccggaggggcagcttggctgcgagcacggccgacccggggcccaccccgtcccgaagtcctccgtacgtaccaacgacggaacctacccgaaccgtcccgcgacgggactccgacgagagacgtacttctcgtgactactaccgaggtacgaacggaacacgacctccctacccgtacgtacctacgtttccgacgtacctacgaccgtacgacgacgacgcgtcgtacgtacttacgttcgtcgtacgacggtcggtacgaccgtcgacgtaccgtccgtcgtcgtcggtcggttcgggtcggttccgggacggtacgggacctaacgggccgttaccgggcccgtacggtacggacccgaccggtaccgaccggtcccggtcccgtaccccgg

SEQ ID NO: 245597 - DNA, 692 bp, Homo sapiens
  misc_feature: GYAE6OF01BQHRR.19.75.G09.1.454.CMB.1.raw
  modified_base (397)..(397): a, c, t, g, unknown or other
  misc_feature (397)..(397): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccacccgtcggtgtccggagggtcttcggggaccgaaccgccactctcacctgcacgtgggaacagacaacaatggttggacaacgagggcagcttggctgcagcagcgacccgggccacccctccaagcctcctgtaccctacgacggaactacccaaccggccctacgagggtactcgtacacggagacgtcttctcgtcgtacacgtcgaacggtacgaacggaaaccnccacggtccctacccgtacgacccttacgtttccgtacgacctccgaaccgtccgtacggaaccgaacggtaggcctttaaggacctttaacgtttaccgtacggtttacgacgggttacggtaagggtaccgacgccgtaaccggtcccgttcgtaccgttgggttaccggttgggggttaccggttccggggacccgggttacggggaaacctacgggtccggtccggttaccccgtccgggtaccgggaccgacccggaaccccgacgggtccccgtcccggtcccccccgg

SEQ ID NO: 245598 - DNA, 734 bp, Homo sapiens
  misc_feature: GYAE6OF01EUHWA.19.75.G09.1.454.CMB.1.raw
  modified_base (266)..(266): a, c, t, g, unknown or other
  misc_feature (266)..(266): n is a, c, g, or t
tcagtactctcgtgcacgaccggtgctcgatttagtatagacatcagggtccaaacaaggacccttacagccaagcgatagtcgggaatctgcaccatcgccctgggctcgtggcctccctcctcgacccttccttctacgtcactctgcagtgtcgagtcggtccacggcgagggctgactcacgcccacccgtcggtcgtccggagggtccgttcggggaccgaaacccgccacctccgtccaccgtgaccacgtcgggaaccngaccaactaagtggttcgaccaaaccggtaaggggctacgtcgttcggcgtgcagtcgacgccgacccgggccctaccccgtaccgagtcctccgtcgtccgtaacgacggaactacccgacccgtccgtacgacggtactacgtacgagtagtacgtacttcgcgtcgactacgtaccgaggtacgaacgaacaccgaccgtccctaccgtacgtacctaacgtttccgacgtacctaccgtacgaccgtacggaacgtaacggcgtactacggacctttacgttcgttgttaccgaggtacggacggaccacggcgtaaccgtccgtcgtcgttcgggtaggttcgggtacggttaccgggacggttaacggaccgtaacggttcccgttaccgggtaccccgttccggggtaacggtaccctacgggtaaccccgtacgggttcccgacccccggttaccccggg

SEQ ID NO: 245599 - DNA, 854 bp, Homo sapiens
  misc_feature: GYAE6OF01D8ZU3.19.75.G09.1.454.CMB.1.raw
tcagtactctcgtgcacgaccggtgctcgatttagtatagacatcaggggtccaaacagaccgttcagcaagcatagtgggaatctgcaccatgccctgggctctgctcctcctcgaccctctcactcactctgcagtgtcagtggtccaggcagggctgactcacgccctacccgtggtcggtaccggagggtccttaggggaaccgaaccgcctaacctctacaccctgacctacgtagggaacacgaaccaaataacgttggttacggaactaaacccgggtaaggggtactacggtcgttcgggtcgtacgtccgacgaccgaaccggaccccggaaccccgggggtacccctaacccccgtacccggaaaccggtccttcccgtaccgttaccgtaaccggtaacggtaaacctacccggaaacccggtcccgtaaccggacgggttaccgtacgtacgtacggtaacggtacgtactttacgtcgtaccggtactacggtaccgtaacggtacgaaacggaaacctaccgaaccgtccccgttaacccctaacgtaccgttaccgtttccgacgttaaccgtaccgtaacgtacggtaaccggacggtaacgacgttacgtacgtacgttacttacgttaggtaccgtagggaccggtacgtaacgaccgtcgttaaccggtcgtacggtccgtacgggtccggtttacgggtccgggtaaccgggtaccggtacggtaacccgggtaacgtccccggtaccggtaccccgttaccggggttacccgggtaaaccggtaccccggttaaaccccggaccgggttccccgttcccccgggtacccccgg

SEQ ID NO: 245600 - DNA, 717 bp, Homo sapiens
  misc_feature: GYAE6OF01C7XDQ.19.75.G09.1.454.CMB.1.raw
  modified_base (157)..(157): a, c, t, g, unknown or other
  misc_feature (157)..(157): n is a, c, g, or t
  modified_base (594)..(594): a, c, t, g, unknown or other
  misc_feature (594)..(594): n is a, c, g, or t
tcagtactctcgtgcacgaccggtgctcgatttagtatagacatcaggggtccaaacagaccttcagcaagcatagtgggaatctgcaccatgcctgggctctgcctcctcctgaccctcctcactcactctgcagtgtcaggttcggccgaggcgnggctgactcgacgccctaccgtggtcgtccggagggtcttacggggacaaccgccacttctcaccgtgcacgtcgggaacacgaccaagtagtggtacgactaacggaggcagtctggctggacaggcgaccgtacggacccggcctaaccctaccgaacgccttccgtacgttaccgaaccgaacggtaacctaacccgtaaccgtccgtacggacgggtactaccgtacgaagtacgtacgtacttcgttacgacggtacctacgttaaccggaaggtaacgtaaccgaaaaccgcgtaaaccgtcccgtacctaccgtaacgtttaccgtcgtaccggtaccctaccgacggtaccgtacgaaccgtcggtaccgtacgtacggttaccttatttaccggttacgtacgtaccgtaggtacggtacgccgggtntaaccggtccttcgtacgttcggtaccgggttagggtccggttacgggaacggtacgggtacccgtagtcggtacccgtcgtacggttacgccgaaccgccggtacgcccgttccgaccccgg

SEQ ID NO: 245601 - DNA, 692 bp, Homo sapiens
  misc_feature: GYAE6OF01CEBYZ.19.75.G09.1.454.CMB.1.raw
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (558)..(558): a, c, t, g, unknown or other
  misc_feature (558)..(558): n is a, c, g, or t
  modified_base (566)..(566): a, c, t, g, unknown or other
  misc_feature (566)..(566): n is a, c, g, or t
  modified_base (584)..(584): a, c, t, g, unknown or other
  misc_feature (584)..(584): n is a, c, g, or t
  modified_base (622)..(622): a, c, t, g, unknown or other
  misc_feature (622)..(622): n is a, c, g, or t
tcagtactctcgtgcacgaccggtgctcgatttagtatagacatcaggggtccaaacagaccttcagcaagcatagtgggaatctgcaccatcgccctgggctctgctcctctcgaccctctcactcactctgcagtgtcaggtggccaggcgagggtactcgactcacgcccaccgttcgggtcgtccggagggtcgttaggggaccgaaaccgccctaactcctacacccgtaggacctacgtaggggaaaccaaggtaccaaacaattcgggttacggaccaaaccggaggggcaacgcggttagcncganacggaccaggaccgacccggggaccacccgaccctaacgcctacgtctacctaacgacgaactaccgaaccggactacgacgtgtacctagacgaagtacgtacgttactactggactacgtacgaacggtaccgaaacgggaaacacgtccgtacccgtaccgtaacgtaacctcggttactaccggtacctaccaacggtccgtaggaaccgaggtaccgtaggactaactcgtttaaccgngttaccgngacggtacgagtacccgntaaccgcgcgtactcggacgttcgggttggtaaccggnggtaaccgggaactacgggcctagtcccgtacggacggacctaacgggcctaacggcctccccggtaccg

SEQ ID NO: 245602 - DNA, 511 bp, Homo sapiens
  misc_feature: GYAE6OF02HYXKH.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgatcctcctgaccctcctcactcactctgcagtgtcagtggtccaggcagggctgactcagccaccctcggtgtccgagggcttgggacgaaccgccactctcacctgcactgggaacagcaacatgtggcaacaagggcagcttggctgcagcagcaccggggcaccctccaagctcctgtcctacaggaataccaaccggccctcagggatctcagagagattctctgcatccaggtcaggaaacacagcctccctgaccatttctggactccagcctgacgacgaggctgactattactgttcagcgtgggacagcagcctcgctgcttgggtgttcggcggtagggaccaaggcgtacgacccgtccgtcgggtccacggtccccgaaggcctcgtcccccgg

SEQ ID NO: 245603 - DNA, 680 bp, Homo sapiens
  misc_feature: GYAE6OF02HD8MB.19.75.G09.1.454.CMB.1.raw
  modified_base (268)..(268): a, c, t, g, unknown or other
  misc_feature (268)..(268): n is a, c, g, or t
tcagtactctcgtgcacgaccggtgctcgatttagtatagacatcagggggtccaaacagaccttcaggcaagcatacgtgggaatctgtcaccatgccctgggctctgctcctcctgacccgtcctcactcactcgtcgcagtgtcagtcggtccaggcagggctggactcaggccaccctggtgtccgagggcttaggggaccaaccgccactctctacctgcactgggaacagacaacaatgttgcaaccgaagggcagctggcngccagcagctaccgggccaccctccaacgcctccgtcggtccctacgacggaactacccgaaccgggcccgtacgagggtactcgtcgagagagtctctctgccatcccaaggtaccaagggaaaccacgacgtacccgtaccgtagtaccgtacgttttctacgggttaccttacccgtacggtcctacggaaccgtaacggtacggtacttacggtaccttacgtttaccttcgttaccgacgggtccggtaggggaaccctaagggccgtaacggtccttacgaccgttcggtacgtttggggtcggtttaccgggaccggtaacgggaccctaacggtcgttcccggtacccgttccggttccgggtacccacggtacccgtaacggtccgttaccggtaccccccgg

SEQ ID NO: 245604 - DNA, 522 bp, Homo sapiens
  misc_feature: GYAE6OF02GRSF5.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccaaggggcagcttggctgcagcagcaccggggccaccctcccaagctcctgtcctacaggaataccaaccggccctcagggactctcagagagattctctgcatccaggtcaggaaacacagcctccctgaccatttctggactccagcctgacgacgaggctgactattactgttcagcgtggacagcagcctcgctgcttgggtcgttcgggcggagggacccaaggcctcggaccccttccgtgggtccaggtccccgaaggtcctacggtccccccgg

SEQ ID NO: 245605 - DNA, 513 bp, Homo sapiens
  misc_feature: GYAE6OF02F9RE2.19.75.G09.1.454.CMB.1.raw
  modified_base (376)..(376): a, c, t, g, unknown or other
  misc_feature (376)..(376): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccaggggcagcttggctgcagcagcaccggggccaccctcccaagctcctgtcctacaggaataccaaccggccctcagggatctcagagagattctctgcatccaggtcaggaaacacagcctcctgaccatttcnggactccagcctgacgacgaggctgactattactgtcagcgtggacagcagcctcgctgcttgggtgttcggcggagggccaaggcgtcgacccgttccgtgggtccgacggccccgaagggcctcggtccccccgg

SEQ ID NO: 245606 - DNA, 764 bp, Homo sapiens
  misc_feature: GYAE6OF02IMZA9.19.75.G09.1.454.CMB.1.raw
tcagtactctcgtgcacgaccggtgctcgatttagtatagacatctagggggttccggaaacgagaccttcagctaaggccataggtacgggaatcgtagccaccatgccctgggtctcttcgcctctcctgccctcgtcacctcactcctgcgagtagtcagtggtccaggcagggtctcgactccacgcacctggtgtccgaggcggttagggacgaaccgcccactcctcgacctggccaacgtgggaacaagtcgtaacgaatggttcggacctaaccgaacggggtcgacgacgttcggcgtaacgcgacgcgacgccaaccgggggcctaccccttcccaagtctccgtcgtccgtactaccggaactaccggaaccccggtcccgtccgaccgggactccgtacgtacggtacggacggtacggttcctcggtcgacgtaacgttcccgacggttccaacgggtaaaccacgtacgaccgtccccgtcgtaacccgtacttttccgtacggaaccgttaccgttacggtcccttacggttaaccgttaccgtacgggtccttaacgtaacccgtttagttaaccgttggttaccgtacggtccggtttacgggtaccgttacgtacggtaccgtaccgggttaccgtaaccggttggaccgtttacgggtacgttacgggaccggtacgggtaccgaacgtcgtaccgacccgttacgtcggtccgtacgttccccgaaggtcccgtccgtaccccg

SEQ ID NO: 245607 - DNA, 499 bp, Homo sapiens
  misc_feature: GYAE6OF02JEX4G.19.75.G09.1.454.CMB.1.raw
  modified_base (377)..(377): a, c, t, g, unknown or other
  misc_feature (377)..(377): n is a, c, g, or t
  modified_base (425)..(425): a, c, t, g, unknown or other
  misc_feature (425)..(425): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgtggcaaccaggggcagcttggctgcagcagcaccggggccaccctcccaagctcctgtcctacaggaataccaaccggccctcagggatctcagagagattctctgcatccaggtcaggaaacacacgcctcctgacctatttcnggacctccagcctgacgacgagctgactattactgttcagcgtggacngcagcctcgctgcgttggtgtcgcggacggcagctgacccgtcgtcgggtcacggtcccaggtcctcgtccccg

SEQ ID NO: 245608 - DNA, 548 bp, Homo sapiens
  misc_feature: GYAE6OF02IV5PA.19.75.G09.1.454.CMB.1.raw
  modified_base (386)..(386): a, c, t, g, unknown or other
  misc_feature (386)..(386): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttggggacgaaccgccactctcacctgcactgggaacagcaacaatgttggcaaccgaaggggcagcttggctgcagcagcaccggggccaccctccaagctcctgtcctacaggaactaccaaccggccctcgagggactctcagagagattctctgcatcaggtacgaagaaacacacgccctccgtgacctatttcncggacctccgacgtcctggaccgacggaggctagacttacttactcgttcagtcgtgggacagcagcctcgctgtcgttgggtcggttcgggcgggtacgggacctaacggccgtcggtacccgtcgtcgggtccacggcccgaacggccgtcggtcccccg

SEQ ID NO: 245609 - DNA, 566 bp, Homo sapiens
  misc_feature: GYAE6OF02GGWCJ.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacaaccgccactctcacctgcactgggaacagcaacaatgttggcaaccaggggcagcttggctgcagcagcaccggggccaccctcccaagctcctgtcctacaggaataccaaccggccctcagggatctcagacgagacttctctgcatccgagtcaggaaacacacgcctccctacgacctaactttctaggaccttccagcctagacgacgagctgacttattactgttcagtcgtcggacagtcacggtcctacgtctcggtacgtttgggttacggttcgggcgggacgggtaaccgaacggccgttacggaccccgttccggtacgggtccgtacggaccccgtaacgggccgtccggtccccccgg

SEQ ID NO: 245610 - DNA, 737 bp, Homo sapiens
  misc_feature: GYAE6OF02JSBV3.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccgaagggcagcttggctgcagcagcaccggggccaccctccaagctcctgtcctacacggaactaccgaacccggccctcgacgggactccgtcgacgagacgtacttctctcgactactaccgaggtacaaggaaaccacacgccctcccgtagaccctaacgtttccgtacggtaccttacccgacggtacccgttacggtaaaccggtacgttacgggaaccggtaccgtttacggtaaaccctttaacgtttaaccgtttacggtttaccggtaacgggtccgggtttacgggggaaccgtacgggaccgtaaccggtcccgttacggtcccgttacgggttccggtttacggggttccgggtttaccggggaccggggtaaccggggtaacccgtaacgggtacccggtttaccggtacccccggttaccgggttaccggggttacccgaacccggtaccccggtaaccggggtccccgttaacccccgggg

SEQ ID NO: 245611 - DNA, 526 bp, Homo sapiens
  misc_feature: GYAE6OF02IEENI.19.75.G09.1.454.CMB.1.raw
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
tcagtactctcgtgcacgaccggtgctcgatttagtatagacatcagggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgtggcaacaaggggcagcttggctgcagcagcaccgggggccacccctcccaagcctccgtcgtcctacaggaactaccaacccggccctcagggatcctcagagagattctctgcatcaggtcaagaaacncagcctccctgaccatttcncggactccagcctgacgacgnggctgactattactgttcagcgtggacngcagcctcgctgcgttggggtgttcgggcggagggaccaagccgtacgacccgtcgtcgggtccacggacccgaaggtccctcggtccccccg

SEQ ID NO: 245612 - DNA, 528 bp, Homo sapiens
  misc_feature: GYAE6OF02IGIAB.19.75.G09.1.454.CMB.1.raw
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (378)..(378): a, c, t, g, unknown or other
  misc_feature (378)..(378): n is a, c, g, or t
tcagtactctcgtgcacgaccggtgctcgatttagtatagacatcaggggtccaaacagaccttcagcaagcatagtcgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgtggcaacaagggcagcttggctgcagcagcaccggggccaccctcccaagctcctgtcctacnggaactaccaaccggccctcagggatctcagagagattcnctgcatcaggtcaaggaaacacacgcctccctgaccatttcnggacctccagcctgacgacgaggctgactattactgttcagtcgtcgggactagcgaagccctcgctggccgtttggggtgttcgggcggagggacccaaggcctgacccctcggtcgggtcacggcccgaaggtccctcggtcccccgg

SEQ ID NO: 245613 - DNA, 512 bp, Homo sapiens
  misc_feature: GYAE6OF02GRSDJ.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacatgttggcaaccgaggggcagcttggctgcagcagcaccggggccaccctcccaagctcctgtcctacaggaactaccaaccggccctacagggactctcagagagattctctgcatccaggtcaaggaaacacagcctccctgacctatttcacggacctccacgcctgacgacgaggctagaccttattactgttcaggtcgtagggacagcgagcctcgctgcgttgggtgtcggcggaggcagcgtcgccctcgtcggtcacgccgagccgtcgtccccg

SEQ ID NO: 245614 - DNA, 640 bp, Homo sapiens
  misc_feature: GYAE6OF02HAKLY.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccaggggcagctggctgcagcagcaccggggccaccctcccaacgctcctgtcctacgacggaactaaccaaccggccctcgacgggtactctaccgagacgagtacttctctcgcacgtccgacgggtacaaggaaacacgacgccctaccctcgaaccctatttccgtacggaccctacccgtacgtcccgtaggaacccgtaaccggacggaccttacgaccttaacgtttacgttcgtttacaggtcggtacgggtaccaggccacgcccgtcgtcgtggtcgttcggggtggttccgggcgggtacgggaaccgtaacggtccgttacggtaccccgttcgggttccggggtaccgaccggaccccggtaacgggtccgtcccggtaccccccggg

SEQ ID NO: 245615 - DNA, 550 bp, Homo sapiens
  misc_feature: GYAE6OF02GD6F0.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggacaaccgaaggggcagcttggctgcagcagcgaccggggcccaccccgtcccaacgcctcctcgtcctacgaggaactaccgaaccggccctacagggactctcagagagattctctgcatccaggtacaggaaacacgacgccctccctgacctactttcaggacctccagcctagacgacgaggctgacttattactgttcagcgtgggacagcacggcctcgctggtcgttggggtgttcgggcggagggaccgaagtccgtacgacccgttcggtcgggccacggcccgaaggtccgtccggtcccccgg

SEQ ID NO: 245616 - DNA, 586 bp, Homo sapiens
  misc_feature: GYAE6OF02IT4XZ.19.75.G09.1.454.CMB.1.raw
  modified_base (445)..(445): a, c, t, g, unknown or other
  misc_feature (445)..(445): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccgaaggggcagcttggctgcagcagcaccggggccaccctcccaagctcctgtcctacaggaactaccaaccggccctaccagggactctcagacgagattctctcgcactccaggtcaggaaacacacgccctacccgtgaccctatttccgacgacctccacgccgtacgacgaccgaggcctagacttacttactgtcaggngtacgggacagcgacgtcctcgtctcgtcgttcggggtcggttcgggacgggtacgggacccgaacggccgttaccggacccgttcccggtagggttacccgacccggacccggtaacgggtccgtcccggtaccccccgg

SEQ ID NO: 245617 - DNA, 734 bp, Homo sapiens
  misc_feature: GYAE6OF02H6E80.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcacgtggaacagcaacaatgttggacaaccgaaggggcagtcttggctgcagcaggccgacccggggcccaacccctccaacgtcctccgtcgtacctaacgacggaactacccgaacccggccctacgagggtactccgtacgagaagacgtacttacctcgttgcctaacgtccgtaacgggtacgaaacggaaaaccaccgtacgtacccctaccccgttacgaacccttactttttaccgacgggtaccctacccgaacgtccgtacggaaccgaccgggaggtaccgttacgtaaccgtttaacgtttaccgttcggtttaccgaacgggtccgggttacgggtaaccaacggccgtaaccggtcccgtaccgtcgttcggttacggtttcggggttacggtttccgggacggggtacgggtaacccgtacgggtacgtacccggtaccccgttccggttaccgggtaccgaaccggtaccccgaacggggttccccgtacccgggttcccccccgg

SEQ ID NO: 245618 - DNA, 616 bp, Homo sapiens
  misc_feature: GYAE6OF02GQWRT.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacatgtgcaaccgaggggcagcttggctgcagcagcgaccggggccaccccgtccaacgcctcctcgtcctacgacggaactacccgaaacccggccctacgagggactccgtacgagagacgtacttcgtactcgactactccgtaggtacaacggaaacacgacgccctaccctagaccctatttcgtacggtacctccacgtcctacgacgacgacggctacgacttattaccgtcgttcaggtcggtagggacgacgcgacgccgtcgtcgtcgtacgttcgggtcggttccgggcgggacgggtacctaacggccgtaccggtaccccgttcggttacgggtaccgaccggtaccccggaacggtcccgtacccggtaccccccg

SEQ ID NO: 245619 - DNA, 738 bp, Homo sapiens
  misc_feature: GYAE6OF02IJ542.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccacctcggtgtccgagggcttgggacgaaccgcactctcacctgcactgggaacagcaacatgtggcaaccgaagggcagctgctgcagcagcaccgggccacccgtccaagctcctgtcctacacggaactaccaaaccggccctacgaacgggactactccgaacgaagaacgtaacgtttcctcgttcggaccaacgtcccgtaagggttaccgaaagggtaaaaacccaccgacggtaccccttaccccgttacggtaaccctaactttttacccgtacgggtaacccttaccccgaacggttcccgttacgggtaaacccggacgggtaaaccggtccgttaacgtaaccgttaaactttaccgttacgttaccgtacggtacggttacggggaaccacggacctacggacccgtttacggccgttcggtaccgtttggggttccggtttacggggaccgggaacggggtaccccgaaaggtcccgtaccgggtacccccgttaccggtcggggttaacccgaccggttaccccggaaacggttcccgtaccggttacccccccggg

SEQ ID NO: 245620 - DNA, 601 bp, Homo sapiens
  misc_feature: GYAE6OF02GCULY.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccggagggcttgggacgaaccgccactctcacctgcactgggaacagcaacaatgtggcaacgagggcagctgctgcagcagcgaccggggccacccgtcccaacgctccgtgtcctacgaggaactaccgaaccggtccctacgacggtactcgtcgagagagtattactctgacagtacgaggtacaagaaacacacgtccctaccgtacgacctattcgtacggtacctccgacgtccgtacggacgacgacggaccgtacgtaacttacgttactcgttacgacggtcggtacgggaccacggtacacggtcctcgccgtgtcggtttcgggtcggttcgggacgggacggtaaccgaggttcccgtacgtacccgtcggtacggtccgacggtacccggagtcccgtcgtacccccgg

SEQ ID NO: 245621 - DNA, 741 bp, Homo sapiens
  misc_feature: GYAE6OF02ILPHN.19.75.G09.1.454.CMB.1.raw
tcagtactctcgtgcacgaccggtgctcgatttagtatagacatcagggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgcactctcactgcacgtgggaacagcaacaatgtgcacgaagggcagctggctgcagcagcaccggggccaccctacccgaagcctcctgtccctacgaggaactacccgaaccggccctacgagggactcctcgagacgagtacttctctgctactccgaggtacgaaggtaaacaaccgacggtcccctacccgtagaacccttacgttttaccgtacgggtacctaccgaacggtacccgttacggaaccggtaaccggacgggtaccgttacggtaaaccgttaacgtttaaccgttcggtttaccgacggttaccgggtacggggtaactaccgggtaccgtacgggtacccgttaccggtccgttaaacgggttccggtttcgggggttacgggtttccgggggaaccgggggtaccggggtaaacccggtaacggtacccggttacccgggtaaccccgttcccggggttaccggggtaccctaaccggggtaccccggaaaccgggtcccgttaccccgggtaccccccccggg

SEQ ID NO: 245622 - DNA, 883 bp, Homo sapiens
  misc_feature: GYAE6OF02HYQNC.19.75.G09.1.454.CMB.1.raw
  modified_base (545)..(545): a, c, t, g, unknown or other
  misc_feature (545)..(545): n is a, c, g, or t
tcagtactctcgtgcacgaccggtgctcgatttagtatagacatcgaagggggtcaaacagaccttcagcaagcatagtggaatctgcacagtcgcctggctctgcgtcctcctgaccctctcacgtcacgtcgtgcagtgtcgagtcgccaggcagggtcctagactcacgccctaccctcgggtgtccggagggtccttaggggaccgtaaccgccgtacttaccgccgtaccgtcgaccgtaacgttggggaacctaggacccgaaaataacgttcgggttaacggacctaaaaccgggtaaagggggacctaacggttaacgttttcgggtacgttacggtacgacgacgaaccgggacccggaaccccggggtcccctaaccccgtacccgtaacggtcccttaccgtttaccggtacctaaccggtaacggaaccgttaccccgtaacccggtaccccttaaggaacgggttacctaccgtacaggtacgtacgtacgttccgtacgcgtcctaggaccgtaggtaacgtaacgtaacnccgtaccgtcccgtactacgtaaccgtttacgttaccgtacgtaccctacggtaccgtaaccggtcggtaaaccggtacggttaccgtaaggttaccttaaccgtttaacttaccggttacgttacgaacgggtcggtttaaccgaacggtacctaacggccgttaccgggtaccgtaagggtccggtttacgggtttacgggggtaccgttaccgggggtaaacggtaaccgggttaacgtaccgggacccgtttaacccggtccgggttaccgtttacggaaccccgggttacggtaacccggttcgggtaccccggttacccgtttacccccggg

SEQ ID NO: 245623 - DNA, 533 bp, Homo sapiens
  misc_feature: GYAE6OF02H1OI2.19.75.G09.1.454.CMB.1.raw
  modified_base (384)..(384): a, c, t, g, unknown or other
  misc_feature (384)..(384): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgtggcaaccgaaggggcagcttaggctgcagcagcaccggggccaccctcccaagctcctgtcctacaggaactacccaaccggccctcgagggatccgtcagagagattctctgcatccaggtcaaggaacacagcctccctgaccatttcncggactccagcctgacgacgaggctagactattactgttcagcgtaggacagcagcctacgctgcgttgggtgttcggcgggacgggaccaacggtcgtacgaccccgtcggtcggttaccgacgtcccgaaggtccctcgtcccccgg

SEQ ID NO: 245624 - DNA, 692 bp, Homo sapiens
  misc_feature: GYAE6OF02H34D5.19.75.G09.1.454.CMB.1.raw
  modified_base (228)..(228): a, c, t, g, unknown or other
  misc_feature (228)..(228): n is a, c, g, or t
tcagtactctcgtgcacgaccggtgctcgatttagtatagacatcagggtccaaacagaccttcagcaagcatagtgggaatctgcaccatgccctgggctctgctcctcctgaccctctcactcactctgcagtgtcagtggtccaggcagggctgactcagccaccgtcggtgtccgagggtcttgggacgaaccgccactctcacctgcacgtggaacagacaanatggttgacaaccgaaggggcagtcgttggctgcagcgagccgaccgggccacccgtccaacgtcctccgtcgtccgtaacacggtaacctaacccgaacccggtcccctacgacgggtactaccgtacgaaggaggtacgtacttacgtctacggcctacgtaccggtaggtaccgaaacgtaaccaacgcggtccctacctacgtaaccttagtttccgacgtacctaccgtacgacccgtacggaacgtacgggtacgtaccgttacgttaaaccgttaagtttacccgtgttaccgacgggtaccggttagggaacctacggacgaccggtccgtcgtcgtcgtccgggtttacggggtcgttaccgggggaccgggtacgggaccggtaacggtcccgtaacgtaccccggtggttccggaccgaccggtaccccgaggttccccgtacccggtccccg

SEQ ID NO: 245625 - DNA, 841 bp, Homo sapiens
  misc_feature: GYAE6OF02HG5YD.19.75.G09.1.454.CMB.1.raw
  modified_base (161)..(161): a, c, t, g, unknown or other
  misc_feature (161)..(161): n is a, c, g, or t
  modified_base (166)..(166): a, c, t, g, unknown or other
  misc_feature (166)..(166): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgcncgacncctaccgtggtcgtcggaggtcgtcggaaccgaccgctactcctaccgaccgtcgctacggtacggaacgacgaacaaactagttgggttacgaaccgaaaccgggacgggcgacgtacggtcggtacgtcggacacggacgacggacccggaccccggggacccctaccccgtaaccgtaacgtcccttaccggttacctaacccgtaacggaacgtaaccctaaccccgggacccggtaccctaacgggacgtacgtaccgtaacgaacgtaggaacttcgttaccgtcgtcgtaccgtacgtaccggtacgtacggaaaaccgaaaccacgacccgttacccgtacccgtacgtaacctttacgtttcggacgtacccctaccgtaccgtacggtacccgggaacggtaccggtacgttaccgtacgttaaccgtttaccgtttacgttacgttacggtacggttacgggtaacggacccgtacggtaacccgtccggtacccgttccggtacggtttacggttcgggttacgggggtttccgggtaccgggtacggggtaacccgggtaacgtacccggtccggttaaccccgttcccggttaccggggttacggtacccggacccgggtaaccccggtacgggttccccgtaccccccgggttaccccgg

SEQ ID NO: 245626 - DNA, 720 bp, Homo sapiens
  misc_feature: GYAE6OF02JV52S.19.75.G09.1.454.CMB.1.raw
  modified_base (213)..(213): a, c, t, g, unknown or other
  misc_feature (213)..(213): n is a, c, g, or t
  modified_base (360)..(360): a, c, t, g, unknown or other
  misc_feature (360)..(360): n is a, c, g, or t
tcagtactctcgtgcacgaccggtgctcgatttagtatagacatcaggggtcaaacagaccttcagcaagcatagtgggaatctgcaccatgccctgggctctgctcctcctgaccctcctcactcactctgcagtgtcagtggtccaggcgagggctgactcagccaccctcggtgtccgagggcgttgggacgaaccgccactctcaccgngctacgcgggaacacgacaactaatggttcggacaaccggaacggggcaggcgtttcggcctggctacgcacgccgacccgggggtacccaccccgtcccaacggcctccgtacgttccaacgacggaactacccgacccggtaccnccgaacgggactccgtacaaggacacgttacttcgtcgtacgctactcgagtaccgaaggaaaccgacgtaccgtaccaccccgtgtaaccctgtttaccggtacgtaccgttaccgaccggtaccgtaccgggtacggaccggtacggtacgttaaccgtaaccgtttacttaaccgtttcgttaccgtaaccgggttcggacgggtaaccgcgtacgtaaaccgccgtacgtccggtacggtttcggttcgggttacgggtccggtacggggcgggtaaaccggtacgtcgtaccggttacccggtaccggttcggaccggtaccggtacccgacggtaccgtacccggttcccccgg

SEQ ID NO: 245627 - DNA, 739 bp, Homo sapiens
  misc_feature: GYAE6OF02JCXRI.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccggagggcttgggaccgaaccgccactctcacctgcacgtgggacagacaacaatgtagcaaccgaaggggcagcttggctgcagcacggcgacccgggcccaccctcccagcctccgtcgtcctacgacggtaactacccgaacccggccctacgacgggtactaccgtacgaacggacgtcgtaacttctaccgtcgacctaacgtcccgtaaggtaccgaaacggtaaaccgaaccgacccggtacccttacccgtacgtacccttaacgttttaccgccgggtaccctacccgacggttacccgtaccggaaccgggtaccggtacggtccgttacggttaaccttttaacgtttaccggttacgttaccgtacgggtccggtaacgggaccgtacggtcgtaaccgggtccctaccggtcgttaccgggtcgggtttacggggttcgggttaccggggacgggtaccgggtaacccgtaacgggtccgtacccggtacccgttcggtacggtaccggaccggaccccggtacggtcccgtaccccggtaccccgg

SEQ ID NO: 245628 - DNA, 679 bp, Homo sapiens
  misc_feature: GYAE6OF02G758Z.19.75.G09.1.454.CMB.1.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcacgcccacccgtcggtcggtccggagggtcgttcggggaccgaacccgccactctccacctgcacgtggaacagcaacatgtggacaaccgagggcagcgttggctgcagcacgcgacccgggccacccnccagccncctcgtccacgacgaactacccgaccggtcctacgaggctacacgagagacgtacttcctcgtcgactacgtaccgtacgggtaccaacggaaaccaccgaccgtacccctacccgtaccggaacctttacgtttccggtacgtacctacccgacgtccgtacggaaccggtacggtacgaccgttacgtaactttacgttaccgttacgttacgacggtccggacgggtacctacggacccgaggtcccgtacggttcgtcggtcgggtttacgggtcgggtaccgggcgggtaacggaccgaacggttccgtaccggtacccggtcgaccgggtacgtaacccggccggtaaccggtcccggtacccgtcccccggg

SEQ ID NO: 245629 - DNA, 653 bp, Homo sapiens
  misc_feature: GYAE6OF02F3OM9.19.75.G09.1.454.CMB.1.raw
  modified_base (228)..(228): a, c, t, g, unknown or other
  misc_feature (228)..(228): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccacctcggtgtccgagggcttgggacgaaccgccactctcacctgcacgtgggaacagcaanagtgtgacaacgaggggcagcgttgctgcagcagccgaccgggcccaccctccgaacgtcctccgtcgtacctacgacggaactacccgaacccggccctacgacgggtactcgtacacggagtacggtacttacgtctacggactacttaccgaggtaccgaaacggaaaccaaccgacggtacccctacccgtacgtaacccgttactttccgtacggaccttccgaacgtccgtacgtaccgacgtacggtccgtacgtactttaacgtttcacgtttccagggtacggtggaaccgtcgactaccggccgttaccggtcttcggtacgttggggtccgttcgggacggtacggaacgtacgtccgtaccgtcccgtcggtacggtccgaccggacccgtacgtcccgtacccggtccccgg

SEQ ID NO: 245630 - DNA, 678 bp, Homo sapiens
  misc_feature: GYAE6OF02JAG4P.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccacccgtggtgtccgagggcttgggacgaaccgccactctcacctgcactgggaacagcaacatgttcggacaaccgaaggggcagcttggctgcagcagccgaccggggcccaccctccgaagcctccgtcgtcctacgaggtaaactacccgaacccggtccctacgacgggactccgtacgtagaacgacgtactttcctacgtcgctacgtaccgaggtacgaacggaaacgacctaacgccccttacccgtacgtacccttactttccgtacggtacccctccgaacgtcccgttaggaacccggacggtacggtcctacggtacttacgtttacgtcgtttacgacggtacggtagggaaccacggaccgtcggcccgttacgccgttcggtcggtttcgggggttcggttcggggacgggtacgggccgtaaccggcggtacccgtccccggttaccggtcgggtaccgtaccgaccccggacggttcccgtcccggtcccccgg

SEQ ID NO: 245631 - DNA, 745 bp, Homo sapiens
  misc_feature: GYAE6OF02I2370.19.75.G09.1.454.CMB.1.raw
  modified_base (225)..(225): a, c, t, g, unknown or other
  misc_feature (225)..(225): n is a, c, g, or t
  modified_base (262)..(262): a, c, t, g, unknown or other
  misc_feature (262)..(262): n is a, c, g, or t
tcagtactctcgtgcacgaccggtgctcgatttagtatagacatcagggtccaaacagaccttcagcaagcatagtgggaatctgcaccatgccctgggctctgctcctcctgaccctcctcactcactctgcagtgtctagtggtccaggcaggctgactcacgcctacctggtcgtccgagggtcttacgggacaaccgccactcgtcactgcacgtggaacngacacatgtcggacaaccgaggcagctggctgcagcncgcgcccgggcctacccgtccaagcctccgtgtaccctaacgacggtaactaccgacccggcctcgtacggtactcgtacgagacgagtactccgtctcgactacgtacgtaggtaccgaacggtaaacaccgtaccgtaccctttacccgacggaccctttacttaccgtacggtacccgttaccgaaccggtaccgttaacggaaccggtaccggtaacgtacgttacgtacttttaaccgttacgttacgtacccgacgggttaccggttaacggggaacccacgggtacccgtaacgttaccccggtacgttaaccgttcggtaaccgggttttgggggttacccggttacggggtaaccgggtaccgggtaacccaaaccgggttcggttcccggtaaccccgttccgggggtttaacgtcccgtaaacccgggtacccggtaaccccgggttcccggtaacccccggttcccccggg

SEQ ID NO: 245632 - DNA, 880 bp, Homo sapiens
  misc_feature: GYAE6OF02F72CL.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctcgaccctcctcactccactctgcagtgtcagtcggtccaggcgagggctgactcgacgcccacccgtcggtcggtccggtacggggtcgttacggggaccgaacccgccctacctccgtccgacccgtcggaccaacggtacgggaaaccacgaaccgtaaacgtaacgttcgggtaccggaaccgaaaccggaacggggggtaccgtaacggtcggttacgggcgttacggaccgtacggaccgaccggacccgggaacccccggggaccccctacccccgtacccgtaaccgtcccgttacccgtaccgttacccgaaccggtaaccggtaacccgtaaccccggaaccccggtacccgtacggtaaccggtaccgtaccgtaacgacgggtaacgtacgttaccgttacgtaccgttacgaccgttaccgtaccggtaaacggtaccggtaaaaccgaaaccgacccgtacccggttaccccgtacccggtacgttaacccgtttacgttttaccgacccggtaacccctttccggaccgggttacccgtaacgggaaccgggtaccgacgttccgttaaccgttaactttacgttaccgttcgtaaccggtgggtaccggttaaccgcgtaacggccttaccgtccgttcgttcgttcggttaccgggtttgggaccggttcgggaacggtaccggctaccggtcccgttaccgccggttcgacggtccgaccgaccgtccggttcccggtcccgtaccccgg

SEQ ID NO: 245633 - DNA, 768 bp, Homo sapiens
  misc_feature: GYAE6OF02JOK7B.19.75.G09.1.454.CMB.1.raw
  modified_base (552)..(552): a, c, t, g, unknown or other
  misc_feature (552)..(552): n is a, c, g, or t
  modified_base (642)..(642): a, c, t, g, unknown or other
  misc_feature (642)..(642): n is a, c, g, or t
  modified_base (655)..(655): a, c, t, g, unknown or other
  misc_feature (655)..(655): n is a, c, g, or t
tcagtactctcgtgcacgaccggtgctcgatttagtatagacatcagggtccaaacagaccttcagcaagcatagtgggaatctgcaccatgccctgggctctgctcctcctcgaccctcctcactcactctgcagtgtcagtggtccaggcagggctgactcacggccaccctcggtcgtccgacgggtccgtttgggaccgaaacccggcccaacgttccttaccacctcgactacgtacgggaaccgagaccaaacctaagttggttacggactaaacccggaaaggggcgaaacggtcgtttgggccgttcggacaacggccgaaacggccccgggtaaccccggggggtacccccaaccccccggttaccccgaaaccgggtcccttccccggttaccggttacccccgttaacgaaccggggtaaaaccgttaaacccccgaaccccggggtacccccttaacggacggggtacctaccgttacgaacgtacgtacgtaacgtttcctacgtctacgtactacccgtagacgtaacgaaaccgacncggaccctcccgacgtacctacgtttacgcgacctccgtacgtccaggtaccgaaccggagtcaacggtactaacgtttaccgtgtacgngcggttcgggacncgcgaccgtcgctcgtagtccgttggtcgtacgggtggaccggacgtaacgtccggttccgaccggtaccggttcggaccgaccgtcggaaccggtcctcccggttaccccgg

SEQ ID NO: 245634 - DNA, 689 bp, Homo sapiens
  misc_feature: GYAE6OF02GH9F1.19.75.G09.1.454.CMB.1.raw
  modified_base (263)..(263): a, c, t, g, unknown or other
  misc_feature (263)..(263): n is a, c, g, or t
  modified_base (548)..(548): a, c, t, g, unknown or other
  misc_feature (548)..(548): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcacgccaccctcggtgtcgagggcttgggacgaacccgcactctcacctgcacgtagggaacagacaacaagtgtggacaaccgaaggggcagtcttggcngcagcgacgcgacccgggcccaccctccaagtcctccgtcgtacctacgaacggaactaacccgacccggtcctacgacggtactctacgacggaagagtacttcgtacgtacgccgtactacgtacggtacgaaacgaaccgaaccgaccgtccccgtacccgtacggtacctttaacgtttccgtacggtaaccttcccgaccgtaccgtacggtaaccggaacggtacggtacgtacgtacgtttaacttaccggtacgttcgacgggtacgtcgggaaccncggacgtaccggtcctcggtcttacggtggtttcggggtacgggttccggggacgggtacggtaccggaacgttccggaccgtacccggttccggtacggaccgtacccggaccggtacggtccgtaccccggtaccccgg

SEQ ID NO: 245635 - DNA, 927 bp, Homo sapiens
  misc_feature: GYAE6OF02HEPJL.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgcctcctcctgaccctcctcactcactatgcagtgtcagtggtccaggcaggctgactcacgccctacccgtcggtcgtccggagggtcttacggggaacccgaacccgccaaccgttcctaccacccgtcgaccgtaaccggttacgggaaaccagaaccaaaaccgtaagttgggttaaccggaaccgaaacccggaaagggggcctaacggttcgtttacgggaccttacggaccgacggacccgaacggacccccggggaaccccccgggggtacccccctaaacccccggttaccccccgtaaacggttcccccgttcccccgttaacccggttccccgttaaaacggtaacccggggtaaaacccccgtttaacccccccggaacccgggttccccccgggtaaccggtaaaccggtaccgtttacccggaaccggtaaacggtacggtaacgtttacttcccggtaacgttccgaccgtaaaccgttccggtaaccggtaaccgaaaacgaactaaccccgaccgttacccgtacccgttcgtaacccgttcgttaccgtaccgttaacctcccgtaccggtaccgaacggtaccgaggttacgaaccgttcgttaaaccttcgtttaaacggccgtttaacggacgggttaccgggagtacccgacggtccctaggtacccgtcggttccgttacggttcggggttcgttacccgggtagggaacccggtacggtaccgaccgttacccgtccggtacccggttcggtaacgcccggtacccgtacgggtacccttaccgtccccggttaccccg

SEQ ID NO: 245636 - DNA, 623 bp, Homo sapiens
  misc_feature: GYAE6OF02H31FL.19.75.G09.1.454.CMB.1.raw
  modified_base (172)..(172): a, c, t, g, unknown or other
  misc_feature (172)..(172): n is a, c, g, or t
  modified_base (194)..(194): a, c, t, g, unknown or other
  misc_feature (194)..(194): n is a, c, g, or t
  modified_base (325)..(325): a, c, t, g, unknown or other
  misc_feature (325)..(325): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
  modified_base (419)..(419): a, c, t, g, unknown or other
  misc_feature (419)..(419): n is a, c, g, or t
tcagtactctcgtgcacgaccggtgctcgatttagtatagacatcaggggtccaaacagaccttcagcaagcatagtgggaatctgcaccatgccctgggctctgactcctacctcgaccctcctcactcactctgcagtgtcaggtcggtccaggcagggctgacctcacncccacccgtcggacgtaccggngggtcgttagggaccgaaccgccacctctaccactgcgtagtacgggaacagtaccaataagttggtcggaccgaaaccggaaggggcacgtcgttggctcggcagcgacggcccgacccgggcccacccncacgtcctcctcgtacaacgtacgaacctacccgaccgcgtacgacgtctcacganacgatactcncgagctaacgtcgagtacgaacgacacnctcctacctgtacctactcgtaccgctccgacgtacgacgcggtaacgtcgactcttactacttcgtcgtacgtacgcggtacgacgacgtaccgacgtccgtcgtccgtggttacgtcggggtacgtcgggacggacgtaacgcggtccgtaacgtccccgtggttacgccggaccgcccgtcgacccggtccccgtaaccgg

SEQ ID NO: 245637 - DNA, 961 bp, Homo sapiens
  misc_feature: GYAE6OF02HG36I.19.75.G09.1.454.CMB.1.raw
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcaggtggtccaggcgagggtctgactcacgcccacccgtcggtcgtccggagggtccgttcggggaaccgaacccggccaccttcctccacctgacctacgtagggaaccagaccaaacgtaattcggttacggaccgaaaccggaagggggcaacggcgtttcgggctacggccaggccgacggacccggacccgggggaccccctaacccccgtacccgaaaccggtccttccccgttacggtaccccgtaaccggtaaacggggtaaaccctaacccccggtaaaccccggaccccgttacggaacggggtaccttccgttaccgaaggaacgacggttaacctttcgtccgttcggaccttacgtacccgtaacgggttaccgaaacgggtaaaccaccgtacccggtacccttacccgtaccgtaacccttacggtttttacccgtaccggtaaccccgttacccgtaacggtcccgtaacggtaacccgggaccggttaccgggtaaccgttaccggttaaaccgttttaccgtttaccgggtttacggtttacccgtaacgggttacccgggttaacggggtaacccgtaccgggtaacccgtacggtcccccggttccgttacccggttcgggttccgggtttacggggtttaccgggttaccggggggaaccggtaccgggggttaaacccgaacggggtttacccggttaccccggtaccccgggtttaccgggttacccggggtaacccgaaccccggggttaccccggtaacgggttccccccgggtaccccgtttaccccccccggggg

SEQ ID NO: 245638 - DNA, 737 bp, Homo sapiens
  misc_feature: GYAE6OF02GLAWD.19.75.G09.1.454.CMB.1.raw
  modified_base (655)..(655): a, c, t, g, unknown or other
  misc_feature (655)..(655): n is a, c, g, or t
tcagtactctcgtgcacgaccggtgctcgatttagtatagacatcgaggggtccaaacagacctttcagcaagcataagtgggaatctgcaccatgccctgggctctgactcctcctgaccctcctcactcactctgcagtgtcagtggtcaggcagggcttgactcgagccctacccgtggtggtccgagggcctttggggaccgtaaccgccactctcacctgcacgtggaacacgacaaactagtcgttacggacaaccgaggggccaagccttggcgtgcgacgacacgtcggacccggggaccccgaccccgtaccccgaacgccgtccgttacgtacccgtaaaccgacgggtaaaccttaacccgaaccccggggcccccttacggaacggggtaccttaccggttaccacggaaaccggttaaggtaacctttccgttacccggtcgtaccttaccgtaacccgtaacggttaacgtaacgggaaaaccgtaccgtacggtaccccgtttcccgtaacgtacccgttaactttccggtaccgggtccctaaccgtacgcccgtacgaaccgggaccgaacggtcgttaggtacccttagttacctgtacgtacggcgttagggactagcctacggccgtcgtaccgngtacgttgtcggttacgggcggtacggtaaccgagtccgtcgtacccgtcggacgtcgccgtaccgaggccctcgtacccgg

SEQ ID NO: 245639 - DNA, 670 bp, Homo sapiens
  misc_feature: GYAE6OF02F63VM.19.75.G09.1.454.CMB.1.raw
  modified_base (377)..(377): a, c, t, g, unknown or other
  misc_feature (377)..(377): n is a, c, g, or t
  modified_base (592)..(592): a, c, t, g, unknown or other
  misc_feature (592)..(592): n is a, c, g, or t
tcagtactctcgtgcacgaccggtgctcgatttagtatagacatcaggggtccaaacagaccttcagcaagcatagtgggaatctgcaccatgccctgggctctgatcctctgaccctcctcactcactctgcagtgtcagtggtccgaggcagggtctgactcagcctacccgtggtgtccgaggtcttgggacgaccgcactctcgcctgctacggtaggaacacgacaagacgttggtacgacaaccgtagggctagcgttgctgactatcgacgtccgaccggtccaccctacgactcctccgtcgtaccgacgtacggaaccgtaccgaacccggcctacgacggtactacgagtagtaagtactacgttcngtacgctaacgttccggaagttaaccgaagaaaccgtacgaccgtcccgtactacgtactacgttcgacgttcaaccgtcgtactacggactacggacgtctaacgttacgttaattccgttctacgggcgtaacgggtgtaacgccgacgtaacctccggcgtcgttcgggttccggttggggtaccgtcgggggtaacccgacgggttaaacnccgggttaccgtcccgttaccgggttacgaccgggtctaaacccggaccggtttacgcccggtaccccggttcccggg

SEQ ID NO: 245640 - DNA, 758 bp, Homo sapiens
  misc_feature: GYAE6OF02FQ129.19.75.G09.1.454.CMB.1.raw
  modified_base (494)..(494): a, c, t, g, unknown or other
  misc_feature (494)..(494): n is a, c, g, or t
tcagtactctcgtgcacgaccggtgctcgatttagtatagacatcagggggtccaaacagaccttcagcaagcatagtgggaatctgcaccatgccctgggctctgctcctcctgaccctcctcactcactctgcagtgtcagtggtccaggcagggctgacctcgagcccacccgtggtcgtccggagggtcgttggggaaccgaacccggccacgtcctaccgacctggccaacgtacgggaaacacgtacaaactaagttcggttacgggaaccaaaaccggtaacggggggcaacggtccgttagggctaggaccgagacgacggaccggaacccggggacccctaccccgtacccgaacggtccctaccgtcgtacccgtaacgaacggtaaacctacccggaacccgcccgttagacgggtactcgtacgaacggagtaacgtacgttcgtacttacgactacgtaccgacggtaacgtaacgaaacncgtaaccgtccctccgtacgtaaccctagtttcgacgtacctaccgcgtaccgtacggaaccggacgtaacggtccttaacgtactttaacgttcgttaacgttcgaacgggttcggacgggtacgacgtaccggtaccgtccgtacggttcgtacggttcggtacggggttcgttacggggaccgggtacggtaacccgtacggtccgtaccgtacccggttcggttacgccgtacgacccggtcgtaccgtccgtaccccgg

SEQ ID NO: 245641 - DNA, 699 bp, Homo sapiens
  misc_feature: GYAE6OF02JT4GO.19.75.G09.1.454.CMB.1.raw
  modified_base (122)..(122): a, c, t, g, unknown or other
  misc_feature (122)..(122): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctccncactcactctgcagtgtcagtggtccaggcagggctgactcacgccacccgtggtcgtccggagggtcgttagggaccgaaccgccacgtcctcacctgcacgtagggaacagacaactaagtcggttcgaccaacggaggggcacgtcgttaggctacgcgacggactacggaccgaccggggcccacccgtaccgacgtccgtcctcgttaccacgtaacggtaaccaacccggtaccgtacctacggacgggtactacgacgtaggtaacggacttaccgttactacgtaccgaactaccgtaccggtacggtaaacgaaccggaaactaaccggaccgtacccgtccctaaccgtacgtttaacgtccgttcggaacccttcgaccgtacgtaccggaacgtacggaccgtacggttactacgttacgtacgttcgtacgcggttacggacgacgacgccgtcggtactcgtacgtggtacggtggtccggtcgggacggacggtacgagtaccggttcgacccgttacggtaccgtaccggacgtaccggtacgtcccggtaccgtccccgg

SEQ ID NO: 245642 - DNA, 625 bp, Homo sapiens
  misc_feature: GYAE6OF02GMXK1.19.75.G09.1.454.CMB.1.raw
  modified_base (346)..(346): a, c, t, g, unknown or other
  misc_feature (346)..(346): n is a, c, g, or t
tcagtactctcgtgcacgaccggtgctcgatttagtatagacatcaggggtccaaacagaccttcagcaagcatagtgggaatctgcaccatgccctgggctctgctcctcctgaccctcctcactcactctgcagtgtcagtggtccaggcagggctgactcagccaccctcggtgtccgagggcttcgggacgaaccgccactctcgacctgcactgggaacagacaacaatggttgacaacgaaggggcagcttggactgcagacagaccgaccggggccaccctcccgaagcctccgtcgtacctacgaggaactacccaccggccacgagggaactcgtanaacgacgaagtacttcgactggtactacgtcgacgtacgaaggaaaccacgtaagcccttaccacgtaacctagtttccgacgtaacctcgaccgtctacggaccgtaacgtacggcgtacgtaactttaatacttcgtttacaacgggtcggtaggtacgagtccaacgtcctgtctagttccgtagggttacttgggacggttaacggaccgtaagtcccgccgtaacgttccgtacggtccgtaaccgacctaccgggaccgttaccggtccccgg

SEQ ID NO: 245643 - DNA, 850 bp, Homo sapiens
  misc_feature: GYAE6OF02F4FIP.19.75.G09.1.454.CMB.1.raw
  modified_base (530)..(530): a, c, t, g, unknown or other
  misc_feature (530)..(530): n is a, c, g, or t
tcagtactctcgtgcacgaccggtgctcgatttagtatagacatcagggggtccaaacagaccttcagcaagcatagtgggaatctgcaccatgccctgggctctgctcctcctgaccctcctcactcactctgctagtggtacaggtcggtaccaggccgaggggtcctaggacctacgacgcccgaccttcgggtcgtccggagggtccttacggggacaaacccgccgtaacttctccgtaaccgtcgaccgtaacgtgggaaacacgtacaaactaattcggttacggacaaaccggaagggggcaagtccgttggccgttgaccgaggtcaacggcccgaaccgggggtcccctaaccccgtaccgaacggtcccttaccgtaccgttacccgtaaacggaacggtaaaccgttaaccccgaacccggggtcccttaacgacggggtactaccgtaggacgtaacgtacgtactttccgtaacgtcgtacctacgttaccggaagggtaccgaaagggtaaaccnccgtaacccgtacccggtttactacccgtaccgtttaacttttaccgggacggtacccctacgtacccgggttacctaacggggtaccgtaaccgggtacgtaccggttaacgtaacgtttaccgtttacggtaggtttacccgtggttaaccgggtacgggaactcggaccgtttacggccgtaacggttcgtcgggttacgttcgggggttacggtaccgggacggggttaaccgaaccgttacggaccgttccggtccccggtttaacgggtcggaccgttaccgaccggtaaccggttccgtacccggttcccccg

SEQ ID NO: 245644 - DNA, 179 bp, Homo sapiens
  misc_feature: GYAE6OF01CSFWR.1.23.C01.1.454.CMB.1.raw
  modified_base (179)..(179): a, c, t, g, unknown or other
  misc_feature (179)..(179): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgcccctcggtcactctgttcccaccctcctctctctcgactctgagcgggctggcaaggcgcatagn

SEQ ID NO: 245645 - DNA, 176 bp, Homo sapiens
  misc_feature: GYAE6OF01DAMYR.1.23.C01.1.454.CMB.1.raw
  modified_base (176)..(176): a, c, t, g, unknown or other
  misc_feature (176)..(176): n is a, c, g, or t
tcagacgagtgcgtcacgaccggtgctcgatttagtacacgtgattcgcgggcccagtgttgggtgttcggcggaggaccaagctgaccgtcctaggtcagcccaaggctgcccctcggtcactctgttcccacctcctctctctcgactctgagcgggctggcaaggcgcatagn

SEQ ID NO: 245646 - DNA, 154 bp, Homo sapiens
  misc_feature: GYAE6OF01DH1UD.1.23.C01.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacacgtgattcgcgggggaccaagctgaccgtcctaggtcagcccaaggctgcccctcggtcactctgttcccaccctcctcacgtctactgctgagcgggctggcaaggcgcatagn

SEQ ID NO: 245647 - DNA, 179 bp, Homo sapiens; identical to SEQ ID NO: 245644
  misc_feature: GYAE6OF01CJK0U.1.23.C01.1.454.CMB.1.raw
  modified_base (179)..(179): a, c, t, g, unknown or other
  misc_feature (179)..(179): n is a, c, g, or t

SEQ ID NO: 245648 - DNA, 180 bp, Homo sapiens
  misc_feature: GYAE6OF01EA6WP.1.23.C01.1.454.CMB.1.raw
  modified_base (180)..(180): a, c, t, g, unknown or other
  misc_feature (180)..(180): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgccccctcggtcactctgttcccgccctcctctctctcgactctgagcgggctggcaaggcgcatagn

SEQ ID NO: 245649 - DNA, 170 bp, Homo sapiens
  misc_feature: GYAE6OF01D9CSH.1.23.C01.1.454.CMB.1.raw
  modified_base (154)..(170): a, c, t, g, unknown or other
  misc_feature (154)..(170): n is a, c, g, or t
tcagacgagtgcgtcacgaccggtgctcgatttagtacacgtgattcgcgggggaccgaagctgaccgtcctaggtcagcccaaggctgcccctcggtcactctgttcccaccctcctcacgtctactgctgagcggctggcaaggcgcatagnnnnnnnnnnnnnnnnn

SEQ ID NO: 245650 - DNA, 189 bp, Homo sapiens
  misc_feature: GYAE6OF01DAI0E.1.23.C01.1.454.CMB.1.raw
  modified_base (179)..(189): a, c, t, g, unknown or other
  misc_feature (179)..(189): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgcccctcggtcactctgttcccaccctcctctctctcgactctgagcgggctggcaaggcgcatagnnnnnnnnnnn

SEQ ID NO: 245651 - DNA, 156 bp, Homo sapiens
  misc_feature: GYAE6OF01A3TNQ.1.23.C01.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacacgtgattcgcgggggaccaagctgaccgtcctaggtcagcccaaggctgcccctcggtcactctgttcccgccctcctcacgtctactgctgagcgggctggcaaggcgcatagnnn

SEQ ID NO: 245652 - DNA, 177 bp, Homo sapiens
  misc_feature: GYAE6OF01B40NU.1.23.C01.1.454.CMB.1.raw
  modified_base (177)..(177): a, c, t, g, unknown or other
  misc_feature (177)..(177): n is a, c, g, or t
tcagacgagtgcgtcacgaccggtgctcgatttagtacacgtgattcgcgggcccagtgttgggtgttcggcggaggaccaagctgaccgtcctaggtcagcccaaggctgcccctcggtcactctgttcccaccctcctctctctcgactctgagcgggctggcaaggcgcatagn

SEQ ID NO: 245653 - DNA, 180 bp, Homo sapiens
  misc_feature: GYAE6OF01CERA4.1.23.C01.1.454.CMB.1.raw
  modified_base (178)..(180): a, c, t, g, unknown or other
  misc_feature (178)..(180): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgcccctcggtcactctgttcccacctcctctctctcgactctgagcgggctggcaaggcgcatagnnn

SEQ ID NO: 245654 - DNA, 187 bp, Homo sapiens
  misc_feature: GYAE6OF01BLX5Z.1.23.C01.1.454.CMB.1.raw
  modified_base (180)..(187): a, c, t, g, unknown or other
  misc_feature (180)..(187): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgccccctcggtcactctgttcccaccctcctctctctcgactctgagcgggctggcaaggcgcatagnnnnnnnn

SEQ ID NO: 245655 - DNA, 180 bp, Homo sapiens
  misc_feature: GYAE6OF01C6SBT.1.23.C01.1.454.CMB.1.raw
  modified_base (180)..(180): a, c, t, g, unknown or other
  misc_feature (180)..(180): n is a, c, g, or t
tcagacgagtgcgtcacgaccggtgctcgatttagtacacgtgattcgcggggcccagtgttgggtgttcggcggagggaccaagctgaccgtcctaggttagcccaaggctgccccctcggtcactctgttcccaccctcctctctctcgactctgagcgggctggcaaggcgcatagn

SEQ ID NO: 245656 - DNA, 177 bp, Homo sapiens
  misc_feature: GYAE6OF01AS9MJ.1.23.C01.1.454.CMB.1.raw
  modified_base (175)..(177): a, c, t, g, unknown or other
  misc_feature (175)..(177): n is a, c, g, or t
tcagacgagtgcgtcacgaccggtgctcgatttagtacacgtgattcgcgggcccgagtgttggtgttcggcggaggaccgaagctgaccgtcctaggtcagcccaaggctgcccctcggtcactctgttccacctcctctctctcgactctgagcggctggcaaggcgcatagnnn

SEQ ID NO: 245657 - DNA, 177 bp, Homo sapiens
  misc_feature: GYAE6OF01AK5LB.1.23.C01.1.454.CMB.1.raw
  modified_base (177)..(177): a, c, t, g, unknown or other
  misc_feature (177)..(177): n is a, c, g, or t
tcagacgagtgcgtcacgaccggtgctcgatttagtacacgtgattcgcgggcccagtgttggtgttcggcggagggaccaagctgaccgtcctaggtcagcccaaggctgcccctcggtcactctgttcccaccctcctctctctcgactctgagcgggctggcaaggcgcatagn

SEQ ID NO: 245658 - DNA, 181 bp, Homo sapiens
  misc_feature: GYAE6OF01AZ4FW.1.23.C01.1.454.CMB.1.raw
  modified_base (179)..(181): a, c, t, g, unknown or other
  misc_feature (179)..(181): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgcccctcggtcactctgttcccgccctcctctctctcgactctgagcgggctggcaaggcgcatagnnn

SEQ ID NO: 245659 - DNA, 204 bp, Homo sapiens
  misc_feature: GYAE6OF01CNAGF.1.23.C01.1.454.CMB.1.raw
  modified_base (184)..(204): a, c, t, g, unknown or other
  misc_feature (184)..(204): n is a, c, g, or t
tcagacgagtgcgtcacgaccggtgctcgatttagtacacgtgattcgcgggggtcccgagtgttgggtgttcggcggagggaccaagctgaccgtcctaggtcagcccaaggctgccccctcggtcacgtctgttcccaccctcctctctctcgactctgagcgggctggcaaggcgcatagnnnnnnnnnnnnnnnnnnnnn

SEQ ID NO: 245660 - DNA, 181 bp, Homo sapiens
  misc_feature: GYAE6OF01DRLDU.1.23.C01.1.454.CMB.1.raw
  modified_base (181)..(181): a, c, t, g, unknown or other
  misc_feature (181)..(181): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccgccctcctctctctcgactctgagcgggctggcaaggcgcatagn

SEQ ID NO: 245661 - DNA, 179 bp, Homo sapiens
  misc_feature: GYAE6OF01DKAGF.1.23.C01.1.454.CMB.1.raw
  modified_base (179)..(179): a, c, t, g, unknown or other
  misc_feature (179)..(179): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgcccctcggtcactctgttcccgccctcctctctctcgactctgagcgggctggcaaggcgcatagn

SEQ ID NO: 245662 - DNA, 179 bp, Homo sapiens; identical to SEQ ID NO: 245661
  misc_feature: GYAE6OF01EOYZZ.1.23.C01.1.454.CMB.1.raw
  modified_base (179)..(179): a, c, t, g, unknown or other
  misc_feature (179)..(179): n is a, c, g, or t

SEQ ID NO: 245663 - DNA, 154 bp, Homo sapiens
  misc_feature: GYAE6OF01AUJ4X.1.23.C01.1.454.CMB.1.raw
  modified_base (154)..(154): a, c, t, g, unknown or other
  misc_feature (154)..(154): n is a, c, g, or t
tcagacgagtgcgtcacgaccggtgctcgatttagtacacgtgattcgcgggggaccaagctgaccgtcctaggtcagcccaaggctgcccctcggtcactctgttcccgccctcctcacgtctactgctgagcgggctggcaaggcgcatagn

SEQ ID NO: 245664 - DNA, 180 bp, Homo sapiens; identical to SEQ ID NO: 245648
  misc_feature: GYAE6OF01D7K7F.1.23.C01.1.454.CMB.1.raw
  modified_base (180)..(180): a, c, t, g, unknown or other
  misc_feature (180)..(180): n is a, c, g, or t

SEQ ID NO: 245665 - DNA, 162 bp, Homo sapiens
  misc_feature: GYAE6OF01DC4HC.1.23.C01.1.454.CMB.1.raw
  modified_base (154)..(162): a, c, t, g, unknown or other
  misc_feature (154)..(162): n is a, c, g, or t
tcagacgagtgcgtcacgaccggtgctcgatttagtacacgtgattcgcgggggaccaagctgaccgtcctaggtcagcccaaggctgcccctcggtcactctgttcccaccctcctcacgtctactgctgagcgggctggcaaggcgcatagnnnnnnnnn

SEQ ID NO: 245666 - DNA, 181 bp, Homo sapiens
  misc_feature: GYAE6OF01CV1WM.1.23.C01.1.454.CMB.1.raw
  modified_base (181)..(181): a, c, t, g, unknown or other
  misc_feature (181)..(181): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccaccctcctctctctcgactctgagcgggctggcaaggcgcatagn

SEQ ID NO: 245667 - DNA, 169 bp, Homo sapiens
  misc_feature: GYAE6OF01A0EQ8.1.23.C01.1.454.CMB.1.raw
  modified_base (157)..(169): a, c, t, g, unknown or other
  misc_feature (157)..(169): n is a, c, g, or t
tcagacgagtgcgtcacgaccggtgctcgatttagtacacgtgattcgcgggggtaccgaagctgaccgtcctaggtcagcccaaggctgccccctggtcactctgttcccaccctcctcaccgtctactgctgagcgggctggcaaggcgcatagnnnnnnnnnnnnn

SEQ ID NO: 245668 - DNA, 189 bp, Homo sapiens
  misc_feature: GYAE6OF01B159F.1.23.C01.1.454.CMB.1.raw
  modified_base (181)..(189): a, c, t, g, unknown or other
  misc_feature (181)..(189): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccgccctcctctctctcgactctgagcgggctggcaaggcgcatagnnnnnnnnn

SEQ ID NO: 245669 - DNA, 181 bp, Homo sapiens
  misc_feature: GYAE6OF01BGIOA.1.23.C01.1.454.CMB.1.raw
  modified_base (179)..(181): a, c, t, g, unknown or other
  misc_feature (179)..(181): n is a, c, g, or t
tcagacgagtgcgtcacgaccggtgctcgatttagtacacgtgattcgcggggcccagtgttgggtgttcggcggaggaccaagctgaccgtcctaggtcagcccaaggctgccccctcggtcactctgttcccaccctcctctctctcgactctgagcgggctggcaaggcgcatagnnn

SEQ ID NO: 245670 - DNA, 247 bp, Homo sapiens
  misc_feature: GYAE6OF01BOKE0.1.23.C01.1.454.CMB.1.raw
  modified_base (153)..(247): a, c, t, g, unknown or other
  misc_feature (153)..(247): n is a, c, g, or t
tcagacgagtgcgtcacgaccggtgctcgatttagtacacgtgattcgcgggggaccaagctgaccgtcctaggtcagcccaaggctgccccctggtcactctgttcccgccctcctcacgtctactgctgagcggctggcaaggcgcatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 245671 - DNA, 183 bp, Homo sapiens
  misc_feature: GYAE6OF01EXAEJ.1.23.C01.1.454.CMB.1.raw
  modified_base (181)..(183): a, c, t, g, unknown or other
  misc_feature (181)..(183): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccgccctcctctctctcgactctgagcgggctggcaaggcgcatagnnn

SEQ ID NO: 245672 - DNA, 190 bp, Homo sapiens
  misc_feature: GYAE6OF01D95GS.1.23.C01.1.454.CMB.1.raw
  modified_base (181)..(190): a, c, t, g, unknown or other
  misc_feature (181)..(190): n is a, c, g, or t
tcagacgagtgcgtcacgaccggtgctcgatttagtacacgtgattcgcgggggcccagtgttgggtgttcggcggaggcaccaaactgaccgtcctacgtcagcccaaggctgccccctcggtcactctgttcccgccctcctctctctcgactctgagcgggctggcaaggcgcatagnnnnnnnnnn

SEQ ID NO: 245673 - DNA, 181 bp, Homo sapiens
  misc_feature: GYAE6OF01ARD8I.1.23.C01.1.454.CMB.1.raw
  modified_base (180)..(181): a, c, t, g, unknown or other
  misc_feature (180)..(181): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgccccctcggtcactctgttcccaccctcctctctctcgactctgagcgggctggcaaggcgcatagnn

SEQ ID NO: 245674 - DNA, 155 bp, Homo sapiens
  misc_feature: GYAE6OF01B4KS8.1.23.C01.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtacacgtgattcgcgggggaccaagctgaccgtcctaggtcagcccaaggctgccccctcggtcactctgttcccaccctcctcacgtctactgctgagcgggctggcaaggcgcatagn

SEQ ID NO: 245675 - DNA, 179 bp, Homo sapiens
  misc_feature: GYAE6OF01E3JSC.1.23.C01.1.454.CMB.1.raw
tcagacgagtgcgtcacgaccggtgctcgatttagtacacgtgattcgcggggcccagtgttgggtgttcggcggagggaccaagctgaccgtcctaggtcagcccaaggctgccccctcggtcactctgttcccaccctcctctctctcgactctgagcgggctggcaaggcgcatag

SEQ ID NO: 245676 - DNA, 183 bp, Homo sapiens; identical to SEQ ID NO: 245671
  misc_feature: GYAE6OF01EABNJ.1.23.C01.1.454.CMB.1.raw
  modified_base (181)..(183): a, c, t, g, unknown or other
  misc_feature (181)..(183): n is a, c, g, or t

SEQ ID NO: 245677 - DNA, 181 bp, Homo sapiens
  misc_feature: GYAE6OF01BKSSB.1.23.C01.1.454.CMB.1.raw
  modified_base (180)..(181): a, c, t, g, unknown or other
  misc_feature (180)..(181): n is a, c, g, or t
tcagacgagtgcgtcacgaccggtgctcgatttagtacacgtgattcgcggggcccagtgttgggtgttcggcggagggaccaagctgaccgtcctagttcagcccaaggccaaccccactgtcactctgttcccaccctcctctctctcgactctgagcgggctggcaaggcgcatagnn

SEQ ID NO: 245678 - DNA, 156 bp, Homo sapiens
  misc_feature: GYAE6OF01BV18J.1.23.C01.1.454.CMB.1.raw
  modified_base (155)..(156): a, c, t, g, unknown or other
  misc_feature (155)..(156): n is a, c, g, or t
tcagacgagtgcgtcacgaccggtgctcgatttagtacacgtgattcgcgggggaccaagctgaccgtcctaggtcagcccaaggctgccccctcggtcactctgttcccgccctcctcacgtctactgctgagcgggctggcaaggcgcatagnn

SEQ ID NO: 245679 - DNA, 173 bp, Homo sapiens
  misc_feature: GYAE6OF01BJIDQ.1.23.C01.1.454.CMB.1.raw
  modified_base (157)..(173): a, c, t, g, unknown or other
  misc_feature (157)..(173): n is a, c, g, or t
tcagacgagtgcgtcacgaccggtgctcgatttagtacacgtgattcgcgggggaccaaggctgaccgtcctaggtcagcccaaggctgccccctggtcacctctgttcccgcctccctcgcgtctactgctgagcgggctggcaaggcgcgatagnnnnnnnnnnnnnnnnn

SEQ ID NO: 245680 - DNA, 181 bp, Homo sapiens
  misc_feature: GYAE6OF01CQ6YM.1.23.C01.1.454.CMB.1.raw
  modified_base (181)..(181): a, c, t, g, unknown or other
  misc_feature (181)..(181): n is a, c, g, or t
tcagacgagtgcgtcacgaccggtgctcgatttagtacacgtgattcgcgggggcccagttttgggtgttcggcggagggaccaagctgaccgtcctaggtcagcccaaggctgccccctcggtcactctgttcccaccctcctctctctcgactctgagcgggctggcaaggcgcatagn

SEQ ID NO: 245681 - DNA, 198 bp, Homo sapiens
  misc_feature: GYAE6OF01BFI7V.1.23.C01.1.454.CMB.1.raw
  modified_base (158)..(162): a, c, t, g, unknown or other
  misc_feature (158)..(162): n is a, c, g, or t
  modified_base (164)..(198): a, c, t, g, unknown or other
  misc_feature (164)..(198): n is a, c, g, or t
tcagacgagtgcgtcacgaccggtgctcgattttagtacacgtgattcgcggggggaccaagctgaccgtcctaggtcagcccaaggctgccccctggtcactctgttcccaccctcctcaccgtctactgctgagcgggctggcaaggcgcattagnnnnncnnnnnnnnnnnnnnnnnnnnnnnnnnnnnnnnnnn

SEQ ID NO: 245682 - DNA, 181 bp, Homo sapiens
  misc_feature: GYAE6OF01C3LUL.1.23.C01.1.454.CMB.1.raw
  modified_base (180)..(181): a, c, t, g, unknown or other
  misc_feature (180)..(181): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgccccctcggtcactctgttcccgccctcctctctctcgactctgagcgggctggcaaggcgcatagnn

SEQ ID NO: 245683 - DNA, 190 bp, Homo sapiens
  misc_feature: GYAE6OF01CBQQ7.1.23.C01.1.454.CMB.1.raw
  modified_base (181)..(190): a, c, t, g, unknown or other
  misc_feature (181)..(190): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccaccctcctctctctcgactctgagcgggctggcaaggcgcatagnnnnnnnnnn

SEQ ID NO: 245684 - DNA, 182 bp, Homo sapiens
  misc_feature: GYAE6OF01AKVMQ.1.23.C01.1.454.CMB.1.raw
  modified_base (181)..(182): a, c, t, g, unknown or other
  misc_feature (181)..(182): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccaccctcctctctctcgactctgagcgggctggcaaggcgcatagnn

SEQ ID NO: 245685 - DNA, 186 bp, Homo sapiens
  misc_feature: GYAE6OF01CNGU7.1.23.C01.1.454.CMB.1.raw
  modified_base (181)..(186): a, c, t, g, unknown or other
  misc_feature (181)..(186): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccaccctcctctctctcgactctgagcgggctggcaaggcgcatagnnnnnn

SEQ ID NO: 245686 - DNA, 181 bp, Homo sapiens; identical to SEQ ID NO: 245660
  misc_feature: GYAE6OF01E12CD.1.23.C01.1.454.CMB.1.raw
  modified_base (181)..(181): a, c, t, g, unknown or other
  misc_feature (181)..(181): n is a, c, g, or t

SEQ ID NO: 245687 - DNA, 153 bp, Homo sapiens
  misc_feature: GYAE6OF01BJ0S1.1.23.C01.1.454.CMB.1.raw
  modified_base (153)..(153): a, c, t, g, unknown or other
  misc_feature (153)..(153): n is a, c, g, or t
tcagacgagtgcgtcacgaccggtgctcgatttagtacacgtgattcgcggggaccaagctgaccgtcctaggtcagcccaaggctgcccctcggtcactctgttcccgccctcctcacgtctactgctgagcgggctggcaaggcgcatagn

SEQ ID NO: 245688 - DNA, 566 bp, Homo sapiens
  misc_feature: GYAE6OF01A4D10.1.23.C01.1.454.CMB.1.raw
  modified_base (211)..(211): a, c, t, g, unknown or other
  misc_feature (211)..(211): n is a, c, g, or t
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
tcagacgagtgcgtcacgaccggtgctcgattagtacacgtgattagggattgggggaggaactggctcagtttaggacccagaggggaaccatcggaagccccagctcagcttctcttcctcctgctactctcggctcccagataccaccggagaaattgtgttgacacagtctccagtccacccgtgtctttgtctccaagggggaaanagcccacctctcctgcagggccagtcagactgttaccagctccttagcctggtaccaacaaaacctggccaggctcccaggctcctcgtctatgatgtatccaatagggccgctggcatcccagccaggttcagtggcagtgggtctggggacagacttcactctcaccatcagcagcctggacgcctagaacgtattttggactagttttactactgtccaaccgtaacgtanacaactcggcccctnacgtttcggaccgggagggacccaagggtcggaagtacgtacgaaggccgaagtggtcggctcggcacctatccgtgtcttcactccttccccacccttcctaccg

SEQ ID NO: 245689 - DNA, 157 bp, Homo sapiens
  misc_feature: GYAE6OF01DEPMU.1.23.C01.1.454.CMB.1.raw
  modified_base (155)..(157): a, c, t, g, unknown or other
  misc_feature (155)..(157): n is a, c, g, or t
tcagacgagtgcgtcacgaccggtgctcgatttagtacacgtgattcgcgggggaccaagctgaccgtcctaggtcagcccaaggctgccccctcggtcactctgttcccaccctcctcacgtctactgctgagcgggctggcaaggcgcatagnnn

SEQ ID NO: 245690 - DNA, 194 bp, Homo sapiens
  misc_feature: GYAE6OF01C3UHF.1.23.C01.1.454.CMB.1.raw
  modified_base (180)..(194): a, c, t, g, unknown or other
  misc_feature (180)..(194): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgccccctggtcactctgttcccaccctcctctctctcgactctgagcgggctggtcaaggcgcatagnnnnnnnnnnnnnnn

SEQ ID NO: 245691 - DNA, 196 bp, Homo sapiens
  misc_feature: GYAE6OF01D8QEZ.1.23.C01.1.454.CMB.1.raw
  modified_base (181)..(196): a, c, t, g, unknown or other
  misc_feature (181)..(196): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccaccctcctctctctcgactctgagcgggctggcaaggcgcatagnnnnnnnnnnnnnnnn

SEQ ID NO: 245692 - DNA, 181 bp, Homo sapiens; identical to SEQ ID NO: 245682
  misc_feature: GYAE6OF01A01IO.1.23.C01.1.454.CMB.1.raw
  modified_base (180)..(181): a, c, t, g, unknown or other
  misc_feature (180)..(181): n is a, c, g, or t

SEQ ID NO: 245693 - DNA, 181 bp, Homo sapiens; identical to SEQ ID NO: 245666
  misc_feature: GYAE6OF01AZTNC.1.23.C01.1.454.CMB.1.raw
  modified_base (181)..(181): a, c, t, g, unknown or other
  misc_feature (181)..(181): n is a, c, g, or t

SEQ ID NO: 245694 - DNA, 155 bp, Homo sapiens; identical to SEQ ID NO: 245674
  misc_feature: GYAE6OF01BYDL2.1.23.C01.1.454.CMB.1.raw
  modified_base (155)..(155): a, c, t, g, unknown or other
  misc_feature (155)..(155): n is a, c, g, or t

SEQ ID NO: 245695 - DNA, 224 bp, Homo sapiens
  misc_feature: GYAE6OF01DIDTD.1.23.C01.1.454.CMB.1.raw
  modified_base (189)..(224): a, c, t, g, unknown or other
  misc_feature (189)..(224): n is a, c, g, or t
tcagacgagtgcgtcacgaccggtgctcgatttagtacacgtgatttcgcgggggtcccgagtgttgggtgttcggccggagggaccaagctcgaccgtcctaggtcagcccaaggcctgccccctcggtcactctgttcccgccctccttctctctcgactctgagcgggctggcaacggcgcatagnnnnnnnnnnnnnnnnnnnnnnnnnnnnnnnnnnnn

SEQ ID NO: 245696 - DNA, 181 bp, Homo sapiens
  misc_feature: GYAE6OF01CN9FR.1.23.C01.1.454.CMB.1.raw
  modified_base (180)..(181): a, c, t, g, unknown or other
  misc_feature (180)..(181): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctggtcactctgttcccaccctcctctctctcgactctgagcgggctggcaaggcgcatagnn

SEQ ID NO: 245697 - DNA, 184 bp, Homo sapiens
  misc_feature: GYAE6OF01APYW7.1.23.C01.1.454.CMB.1.raw
  modified_base (158)..(184): a, c, t, g, unknown or other
  misc_feature (158)..(184): n is a, c, g, or t
tcagacgagtgcgtcacgaccggtgctcgatttagtacacgtgattcggcggggggaccaagctgaccgtcctaggtcagcccaaggctgccccctcggtcactctgttcccaccctcctcacgtctactgctgagcgggctggcaaggccgcatagnnnnnnnnnnnnnnnnnnnnnnnnnnn

SEQ ID NO: 245698 - DNA, 183 bp, Homo sapiens
  misc_feature: GYAE6OF01ACUO7.1.23.C01.1.454.CMB.1.raw
  modified_base (180)..(183): a, c, t, g, unknown or other
  misc_feature (180)..(183): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctggtcactctgttcccaccctcctctctctcgactctgagcgggctggcaaggcgcatagnnnn

SEQ ID NO: 245699 - DNA, 203 bp, Homo sapiens
  misc_feature: GYAE6OF01AO6VU.1.23.C01.1.454.CMB.1.raw
  modified_base (182)..(203): a, c, t, g, unknown or other
  misc_feature (182)..(203): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgcccccctcggtcactctgttcccgccctcctctctctcgactctgagcgggctggcaaggcgcatagnnnnnnnnnnnnnnnnnnnnnn

SEQ ID NO: 245700 - DNA, 184 bp, Homo sapiens
  misc_feature: GYAE6OF01E0NDK.1.23.C01.1.454.CMB.1.raw
  modified_base (179)..(184): a, c, t, g, unknown or other
  misc_feature (179)..(184): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctggtcactctgttcccacctcctctctctcgactctgagcgggctggcaaggcgcatagnnnnnn

SEQ ID NO: 245701 - DNA, 183 bp, Homo sapiens
  misc_feature: GYAE6OF01ET9JE.1.23.C01.1.454.CMB.1.raw
  modified_base (181)..(183): a, c, t, g, unknown or other
  misc_feature (181)..(183): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctggtcactctgttccccgccctcctctctctcgactctgagcgggctggcaaggcgcatagnnn

SEQ ID NO: 245702 - DNA, 585 bp, Homo sapiens
  misc_feature: GYAE6OF01BDQT7.1.23.C01.1.454.CMB.1.raw
  modified_base (278)..(278): a, c, t, g, unknown or other
  misc_feature (278)..(278): n is a, c, g, or t
  modified_base (580)..(580): a, c, t, g, unknown or other
  misc_feature (580)..(580): n is a, c, g, or t
tcagacgagtgcgtcacgaccggtgctcgatttagtacacgtgattagggattgggggagtcagacccactcaggacacagcatggacatgagggtccccgctcagctcctggggctcctgctgctctggctcccaggtgccagatgtgccatccaaatgacccagtctcatcctccctgtctgcatctgtaggagacagagtcaccatcacttgccgggcaagtcgagggcagttaggaaatgatttaggctggtatcagcagaaaccgagggaacncccctaagcctcctgtatttatgctgctatcctaagtttacgaaaggtcgggtacccagtacgaaggttcaggtcggactaggtgctagtcgtagggactaagtacttaccgacttcctaccaacttactacgacgctaacgcccgtggaccacgtaccgtagaacgttattttcggactttaagttttacttactgttaccaacgtagttaacttacgtacgtaacccgtagtcggtacgttcggaccgaggggaccaagggtaggaacgtacgaacgagtggtagccgtagacctacgtnttccg

SEQ ID NO: 245703 - DNA, 128 bp, Homo sapiens
  misc_feature: GYAE6OF01AN68G.1.23.C01.1.454.CMB.1.raw
tcagacgagtgcgtcacgaccggtgctcgatttagtacacgtgattagggattgggcacagcggccctgggctgcctggtcaaggactattccacgcactcgtctgagcgggctggcaaggcgcatag

SEQ ID NO: 245704 - DNA, 290 bp, Homo sapiens
  misc_feature: GYAE6OF01AVBSG.1.23.C01.1.454.CMB.1.raw
  modified_base (275)..(275): a, c, t, g, unknown or other
  misc_feature (275)..(275): n is a, c, g, or t
  modified_base (277)..(277): a, c, t, g, unknown or other
  misc_feature (277)..(277): n is a, c, g, or t
  modified_base (279)..(290): a, c, t, g, unknown or other
  misc_feature (279)..(290): n is a, c, g, or t
tcagacgagtgcgtcacgaccggtgctcgatttagtacacgtgattagggagttggggtcccatcaaggttcagcggcagtggatcgtgggacagaattcactctcaccatcagcagcctgcaccctgatgatttgcaacttactactgccaacagtagtaatagttactcccggagttcggccaagggccaaggtgaaatcaaacgactgtggctgcaccatctgtcttcatcttcccgcatctgaacgcacgtctgagcggctggcaaggcgnangnnnnnnnnnnnn

SEQ ID NO: 245705 - DNA, 181 bp, Homo sapiens; identical to SEQ ID NO: 245660
  misc_feature: GYAE6OF01CU5WG.1.23.C01.1.454.CMB.1.raw
  modified_base (181)..(181): a, c, t, g, unknown or other
  misc_feature (181)..(181): n is a, c, g, or t

SEQ ID NO: 245706 - DNA, 268 bp, Homo sapiens
  misc_feature: GYAE6OF01EJU3B.1.23.C01.1.454.CMB.1.raw
  modified_base (160)..(163): a, c, t, g, unknown or other
  misc_feature (160)..(163): n is a, c, g, or t
  modified_base (168)..(168): a, c, t, g, unknown or other
  misc_feature (168)..(168): n is a, c, g, or t
  modified_base (172)..(268): a, c, t, g, unknown or other
  misc_feature (172)..(268): n is a, c, g, or t
tcagacgagtgcgtcacgaccggtgctcgattttagtacacgtgattcggcgggggggaccaagctgaccgtcctaggcagcccaaggctgcccccctggtcactctgttccccaccctcctcacgtctactgctgagcgggctggcaaggtcacagtgnnnntcagnctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 245707 - DNA, 183 bp, Homo sapiens; identical to SEQ ID NO: 245671
  misc_feature: GYAE6OF01AGNCD.1.23.C01.1.454.CMB.1.raw
  modified_base (181)..(183): a, c, t, g, unknown or other
  misc_feature (181)..(183): n is a, c, g, or t

SEQ ID NO: 245708 - DNA, 174 bp, Homo sapiens
  misc_feature: GYAE6OF01DD9IE.1.23.C01.1.454.CMB.1.raw
  modified_base (174)..(174): a, c, t, g, unknown or other
  misc_feature (174)..(174): n is a, c, g, or t
tcagacgagtgcgtcacgaccggtgctcgatttagtacacgtgattcgcggggcccagtgttggtgttcggcgaggaccaagctgaccgtcctaggtcagcccaaggctgccccctggtcactctgtcccaccctctctctctcgactctgagcggctggcaaggcgcaatagn

SEQ ID NO: 245709 - DNA, 183 bp, Homo sapiens
  misc_feature: GYAE6OF01CC1ZB.1.23.C01.1.454.CMB.1.raw
  modified_base (180)..(183): a, c, t, g, unknown or other
  misc_feature (180)..(183): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctggtcactctgttcccgccctcctctctctcgactctgagcgggctggcaaggcgcatagnnnn

SEQ ID NO: 245710 - DNA, 681 bp, Homo sapiens
  misc_feature: GYAE6OF01EWJLA.1.23.C01.1.454.CMB.1.raw
  modified_base (203)..(203): a, c, t, g, unknown or other
  misc_feature (203)..(203): n is a, c, g, or t
  modified_base (272)..(272): a, c, t, g, unknown or other
  misc_feature (272)..(272): n is a, c, g, or t
  modified_base (622)..(622): a, c, t, g, unknown or other
  misc_feature (622)..(622): n is a, c, g, or t
tcagacgagtgcgtcacgaccggtgctcgatttagtacacgtgattagggattgggggaggaactgctcagttaggacccagagggaaccatggaagccccagctcagcttctcttcctcctgctactctggctcccaggcaccaccggagaaattgtgttgacacagtctccaggccacctgtctttgctccgaggggaaancgcccaccctctcctgcagggccagtcagagtgttagcatccacttaggctggtatacaacagaaaccnggaccagacctccaggtcctcctctatttatgatgcataccgaaaaggccacgtggactacgtcccgagtccgtagttcagttggacctagggttacgggacgaacgggtactaacggtacctttccgaactttaccgaccaacctacgtaccacgtaccgtaacgtacccgttaacgacgtaccgtaggtaaacgttagttttacgacgtttaagttttacgttacgttacggttacgtacgtagtcgttaacgtccggtcgtccgggtaccggtcggtacggttaccggaccggttaacggacctaacggtacgtaaactacgtaaaacgtacgttacggtcggtacncgtaacccgtaacctacgttcgttacgttacttaccgtacctttcccgtcccccgtaac

SEQ ID NO: 245711 - DNA, 246 bp, Homo sapiens
  misc_feature: GYAE6OF01DN784.1.23.C01.1.454.CMB.1.raw
  modified_base (98)..(98): a, c, t, g, unknown or other
  misc_feature (98)..(98): n is a, c, g, or t
  modified_base (157)..(157): a, c, t, g, unknown or other
  misc_feature (157)..(157): n is a, c, g, or t
  modified_base (160)..(162): a, c, t, g, unknown or other
  misc_feature (160)..(162): n is a, c, g, or t
  modified_base (164)..(164): a, c, t, g, unknown or other
  misc_feature (164)..(164): n is a, c, g, or t
  modified_base (168)..(168): a, c, t, g, unknown or other
  misc_feature (168)..(168): n is a, c, g, or t
  modified_base (173)..(246): a, c, t, g, unknown or other
  misc_feature (173)..(246): n is a, c, g, or t
tcagacgagtgcgtcacgaccggtgctcgatttagtacacgtgattcgcggggggaccaagctgaccgtccaggtcagcccaaggctgccccctggtnactctgttcccaccctctcacgtctactgcctggagccgggctggcaaggcgcaatagngtnnnanctgntgctnnnnnnnnnnnnnnnnnnnnnnnnnnnnnnnnnnnnnnnnnnnnnnnnnnnnnnnnnnnnnnnnnnnnnnnnnn

SEQ ID NO: 245712 - DNA, 181 bp, Homo sapiens
  misc_feature: GYAE6OF01CZLR4.1.23.C01.1.454.CMB.1.raw
  modified_base (174)..(174): a, c, t, g, unknown or other
  misc_feature (174)..(174): n is a, c, g, or t
  modified_base (180)..(181): a, c, t, g, unknown or other
  misc_feature (180)..(181): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctcgttcccacctcctctctctcgactctgagcggctggcaaggcncatagnn

SEQ ID NO: 245713 - DNA, 194 bp, Homo sapiens
  misc_feature: GYAE6OF01EMFH7.1.23.C01.1.454.CMB.1.raw
  modified_base (183)..(194): a, c, t, g, unknown or other
  misc_feature (183)..(194): n is a, c, g, or t
tcagacgagtgcgtcacgaccggtgctcgatttagtacacgtgattcgcggggcccagtgttgggtgttcggcggagggaccaagctgaccgtcctaggtcagcccaaggctcgcccctcggtcactccttgttccccaccctcctctctctcgactctgagcgggctggcaaggcgcatagnnnnnnnnnnnn

SEQ ID NO: 245714 - DNA, 172 bp, Homo sapiens
  misc_feature: GYAE6OF01EMPO8.1.23.C01.1.454.CMB.1.raw
  modified_base (157)..(172): a, c, t, g, unknown or other
  misc_feature (157)..(172): n is a, c, g, or t
tcagacgagtgcgtcacgaccggtgctcgatttagtacacgtgattcgcggggggaccaagctgaccgtcctaggtcagcccaaggctgccccctggtcactctgttcccgccctcctcacgtctactgctggagcgggctggcaaggcgacatagnnnnnnnnnnnnnnnn

SEQ ID NO: 245715 - DNA, 183 bp, Homo sapiens; identical to SEQ ID NO: 245709
  misc_feature: GYAE6OF01ESN5N.1.23.C01.1.454.CMB.1.raw
  modified_base (180)..(183): a, c, t, g, unknown or other
  misc_feature (180)..(183): n is a, c, g, or t

SEQ ID NO: 245716 - DNA, 177 bp, Homo sapiens
  misc_feature: GYAE6OF02F9WQM.1.23.C01.1.454.CMB.1.raw
  modified_base (176)..(177): a, c, t, g, unknown or other
  misc_feature (176)..(177): n is a, c, g, or t
tcagacgagtgcgtcacgaccggtgctcgatttagtacacgtgattcgcgggcccgagtgttggtgttcggcggaggaccaagctgaccgtcctaggtcagcccaaggctgcccctcggtcactctgttcccgcctcctctctctcgactctgagcgggctggcaaggcgcatagnn

SEQ ID NO: 245717 - DNA, 200 bp, Homo sapiens
  misc_feature: GYAE6OF02IC0Y7.1.23.C01.1.454.CMB.1.raw
  modified_base (179)..(200): a, c, t, g, unknown or other
  misc_feature (179)..(200): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgcccctcggtcactctgttcccaccctcctctctctcgactctgagcgggctggcaaggcgcatagnnnnnnnnnnnnnnnnnnnnnn

SEQ ID NO: 245718 - DNA, 163 bp, Homo sapiens
  misc_feature: GYAE6OF02G43Z5.1.23.C01.1.454.CMB.1.raw
  modified_base (155)..(163): a, c, t, g, unknown or other
  misc_feature (155)..(163): n is a, c, g, or t
tcagacgagtgcgtcacgaccggtgctcgatttagtacacgtgattcgcgggggaccaagactgaccgtcctaggtcagcccaaggctgcccctcggtcactctgttcccaccctcctcacgtctactgctgagcgggctggcaaggcgcatagnnnnnnnnn

SEQ ID NO: 245719 - DNA, 181 bp, Homo sapiens; identical to SEQ ID NO: 245660
  misc_feature: GYAE6OF02H3LJJ.1.23.C01.1.454.CMB.1.raw
  modified_base (181)..(181): a, c, t, g, unknown or other
  misc_feature (181)..(181): n is a, c, g, or t

SEQ ID NO: 245720 - DNA, 154 bp, Homo sapiens; identical to SEQ ID NO: 245663
  misc_feature: GYAE6OF02G4TSL.1.23.C01.1.454.CMB.1.raw
  modified_base (154)..(154): a, c, t, g, unknown or other
  misc_feature (154)..(154): n is a, c, g, or t

SEQ ID NO: 245721 - DNA, 181 bp, Homo sapiens
  misc_feature: GYAE6OF02FU7VN.1.23.C01.1.454.CMB.1.raw
  modified_base (157)..(181): a, c, t, g, unknown or other
  misc_feature (157)..(181): n is a, c, g, or t
tcagacgagtgcgtcacgaccggtgctcgatttagtacacgtgattcgcgggggtaccgaagctgaccgtcctaggtcagcccaaggctgcccctcggtcactctgttcccgccctcctcacgtctactggctgagcgggctggcaaggcgcatagnnnnnnnnnnnnnnnnnnnnnnnnn

SEQ ID NO: 245722 - DNA, 180 bp, Homo sapiens
  misc_feature: GYAE6OF02HIFJG.1.23.C01.1.454.CMB.1.raw
  modified_base (179)..(180): a, c, t, g, unknown or other
  misc_feature (179)..(180): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgcccctcggtcactctgttcccgccctcctctctctcgactctgagcgggctggcaaggcgcatagnn

SEQ ID NO: 245723 - DNA, 290 bp, Homo sapiens
  misc_feature: GYAE6OF02HGALY.1.23.C01.1.454.CMB.1.raw
  modified_base (284)..(290): a, c, t, g, unknown or other
  misc_feature (284)..(290): n is a, c, g, or t
tcagacgagtgcgtcacgaccggtgctcgatttagtacacgtgattagggattgggtcccatcaaggttcagcggcagtggatctgggacagaattcactctcaccatcagcagcctgcaccctgatgattttgcaacttactactgccaacagtataatagttatccccggacgttcggccaagggaccaaggtggaaatcaaacgaactgtggctgcaccatctgtcttcatcttcccgcctcctcacgcactcgtctgagcgggctggcaaggcgcatagnnnnnnn

SEQ ID NO: 245724 - DNA, 184 bp, Homo sapiens
  misc_feature: GYAE6OF02HGSBC.1.23.C01.1.454.CMB.1.raw
  modified_base (179)..(184): a, c, t, g, unknown or other
  misc_feature (179)..(184): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgcccctcggtcactctgttcccgccctcctctctctcgactctgagcgggctggcaaggcgcatagnnnnnn

SEQ ID NO: 245725 - DNA, 180 bp, Homo sapiens
  misc_feature: GYAE6OF02F5DA1.1.23.C01.1.454.CMB.1.raw
  modified_base (179)..(180): a, c, t, g, unknown or other
  misc_feature (179)..(180): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgcccctcggtcactctgttcccaccctcctctctctcgactctgagcgggctggcaaggcgcatagnn

SEQ ID NO: 245726 - DNA, 154 bp, Homo sapiens; identical to SEQ ID NO: 245646
  misc_feature: GYAE6OF02GDVD8.1.23.C01.1.454.CMB.1.raw
  modified_base (154)..(154): a, c, t, g, unknown or other
  misc_feature (154)..(154): n is a, c, g, or t

SEQ ID NO: 245727 - DNA, 182 bp, Homo sapiens
  misc_feature: GYAE6OF02GKE4X.1.23.C01.1.454.CMB.1.raw
  modified_base (180)..(182): a, c, t, g, unknown or other
  misc_feature (180)..(182): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgccccctcggtcactctgttcccgccctcctctctctcgactctgagcgggctggcaaggcgcatagnnn

SEQ ID NO: 245728 - DNA, 598 bp, Homo sapiens
  misc_feature: GYAE6OF02FL7NL.1.23.C01.1.454.CMB.1.raw
  modified_base (211)..(211): a, c, t, g, unknown or other
  misc_feature (211)..(211): n is a, c, g, or t
  modified_base (268)..(268): a, c, t, g, unknown or other
  misc_feature (268)..(268): n is a, c, g, or t
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (337)..(337): a, c, t, g, unknown or other
  misc_feature (337)..(337): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (417)..(417): a, c, t, g, unknown or other
  misc_feature (417)..(417): n is a, c, g, or t
tcagacgagtgcgtcacgaccggtgctcgatttagtacacgtgattcgcgggggaccaagcctggaccgtcctagggtcccggttaggccctaaggctcgccccctagggttccaacctcgtggttacccacccgtccttcgaacgttcgtaacctaggcctacggacgtcgggtctagggcccaaagggccgacccaattacggcactcngtccgcctctcgacgcgacgacgtcgacgcggcgtcggacgacggcgcacgtacgcncgacgcgcgcgacgtcgcncgtcgcgacgacgcgcgcgtcgcgacgcngcgtacgcgtcgcgncgngcncgctacgcgcgcgtcgcgtcgcgacgtacgacgacgtccngttaccgngtaccgtcgtcacggccagtcctaggctacgngtcgacttcggacgtcgtccgacgtcgtacgtcccggcgtcgtcgtacgtacgcgtacgacgtcgtcgacgtcgcgtcgcgtacgcgtacgtcgcgtacgtcgcgtacgcgtacgtcgacgtcgacgtcgcgtacgacgcgtacgtacgtacgtacgacgacgtcgtcgcgcgtcgcgtcg

SEQ ID NO: 245729 - DNA, 189 bp, Homo sapiens
  misc_feature: GYAE6OF02FE3RL.1.23.C01.1.454.CMB.1.raw
  modified_base (156)..(189): a, c, t, g, unknown or other
  misc_feature (156)..(189): n is a, c, g, or t
tcagacgagtgcgtcacgaccggtgctcgatttagtacacgtgattcggcgggggaccaagctgaccgtcctaggtcagcccaaggctgccccctcggtcactctgttcccaccctcctcacgtctactgctgagcgggctggcaaggcgcatagnnnnnnnnnnnnnnnnnnnnnnnnnnnnnnnnnn

SEQ ID NO: 245730 - DNA, 192 bp, Homo sapiens
  misc_feature: GYAE6OF02IIVXW.1.23.C01.1.454.CMB.1.raw
  modified_base (180)..(192): a, c, t, g, unknown or other
  misc_feature (180)..(192): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgcccctcggtcactctcgttcccaccctcctcctctcgactctgagcgggctggcaaggcgcatagnnnnnnnnnnnnn

SEQ ID NO: 245731 - DNA, 181 bp, Homo sapiens
  misc_feature: GYAE6OF02FSHJT.1.23.C01.1.454.CMB.1.raw
  modified_base (179)..(181): a, c, t, g, unknown or other
  misc_feature (179)..(181): n is a, c, g, or t
tcagacgagtgcgtcacgaccggtgctcgatttagtacacgtgattcgcggggcccagtgttgggtgttcggcggagggaccaagctgaccgtcctaggtcagcccaaggctgcccctcggtcactctgttcccaccctcctctctctcgactctgagcgggctggcaaggcgcatagnnn

SEQ ID NO: 245732 - DNA, 154 bp, Homo sapiens
  misc_feature: GYAE6OF02HC7C8.1.23.C01.1.454.CMB.1.raw
tcagacgagtgcgtcacgaccggtgctcgatttagtacacgtgattcgcgggggaccaagctgaccgtcctaggtcagcccaaggctgccccctcggtcactctgttcccaccctcctcacgtctactgctgagcgggctggcaaggcgcatag

SEQ ID NO: 245733 - DNA, 160 bp, Homo sapiens
  misc_feature: GYAE6OF02GB2J9.1.23.C01.1.454.CMB.1.raw
  modified_base (154)..(160): a, c, t, g, unknown or other
  misc_feature (154)..(160): n is a, c, g, or t
tcagacgagtgcgtcacgaccggtgctcgatttagtacacgtgattcgcgggggaccaagctgaccgtcctaggtcagcccaaggctgccccctggtcactctgttcccaccctcctcacgtctactgctgagcgggctggcaaggcgcatagnnnnnnn

SEQ ID NO: 245734 - DNA, 288 bp, Homo sapiens
  misc_feature: GYAE6OF02IG7OU.1.23.C01.1.454.CMB.1.raw
  modified_base (271)..(288): a, c, t, g, unknown or other
  misc_feature (271)..(288): n is a, c, g, or t
tcagacgagtgcgtcacgaccggtgctcgatttagtacacgtgattagggattggcaggtggatcaggcatagatttacactgaaaatcagcagagtggacggctgaggacgttggggtttattactgcatgcaaggtctacaaacccgatcaccttcggccgagggacacgcctggagacttaaacgactgtggctgcaccatctgtcttcatcttccaccctcctcacgcactcgtctgagcgggctgggctaaagggccgacattagnnnnnnnnnnnnnnnnnn

SEQ ID NO: 245735 - DNA, 220 bp, Homo sapiens
  misc_feature: GYAE6OF02F40XS.1.23.C01.1.454.CMB.1.raw
  modified_base (186)..(220): a, c, t, g, unknown or other
  misc_feature (186)..(220): n is a, c, g, or t
tcagacgagtgcgtcacgaccggtgctcgatttagtacacgtgattcggtcgggggcccagtgttgggtgttcggcggagggaccaagctgaccgtcctaggtcagcccaaggctgccccctcggtcacgtctgttcccaccctcctctctctcgacctctgagcgggctggcaaggccgcatagnnnnnnnnnnnnnnnnnnnnnnnnnnnnnnnnnnn

SEQ ID NO: 245736 - DNA, 184 bp, Homo sapiens
  misc_feature: GYAE6OF02HP59T.1.23.C01.1.454.CMB.1.raw
  modified_base (180)..(184): a, c, t, g, unknown or other
  misc_feature (180)..(184): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctggtcactctgttcccaccctcctctctctcgactctgagcgggctggcaaggcgcatagnnnnn

SEQ ID NO: 245737 - DNA, 184 bp, Homo sapiens
  misc_feature: GYAE6OF02IXE6U.1.23.C01.1.454.CMB.1.raw
  modified_base (181)..(184): a, c, t, g, unknown or other
  misc_feature (181)..(184): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccgccctcctctctctcgactctgagcgggctggcaaggcgcatagnnnn

SEQ ID NO: 245738 - DNA, 191 bp, Homo sapiens
  misc_feature: GYAE6OF02HL33I.1.23.C01.1.454.CMB.1.raw
  modified_base (160)..(191): a, c, t, g, unknown or other
  misc_feature (160)..(191): n is a, c, g, or t
tcagacgagtgcgtcacgaccggtgctcgatttagtacacgtgattcgcgggggaccaagctggaccgtcctaggtcagcccaagggcctgccccctcggtcactctcgttcccaccctcctcacgttctactgctgagcggctggcaaggcgcatagannnnnnnnnnnnnnnnnnnnnnnnnnnnnnnn

SEQ ID NO: 245739 - DNA, 267 bp, Homo sapiens
  misc_feature: GYAE6OF02FNYX8.1.23.C01.1.454.CMB.1.raw
  modified_base (265)..(267): a, c, t, g, unknown or other
  misc_feature (265)..(267): n is a, c, g, or t
tcagacgagtgcgtcacgaccggtgctcgatttagtacacgtgattagggattggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcaccatctgtcttcatcttcccgccatctgaacgcactcgtctgagcgggctggcaaggcgcatagnnn

SEQ ID NO: 245740 - DNA, 155 bp, Homo sapiens
  misc_feature: GYAE6OF02GQZNI.1.23.C01.1.454.CMB.1.raw
  modified_base (155)..(155): a, c, t, g, unknown or other
  misc_feature (155)..(155): n is a, c, g, or t
tcagacgagtgcgtcacgaccggtgctcgatttagtacacgtgattcgcgggggaccaagctgaccgtcctaggtcagcccaaggctgccccctcggtcactctgttcccgccctcctcacgtctactgctgagcgggctggcaaggcgcatagn

SEQ ID NO: 245741 - DNA, 182 bp, Homo sapiens; identical to SEQ ID NO: 245684
  misc_feature: GYAE6OF02F45F3.1.23.C01.1.454.CMB.1.raw
  modified_base (181)..(182): a, c, t, g, unknown or other
  misc_feature (181)..(182): n is a, c, g, or t

SEQ ID NO: 245742 - DNA, 162 bp, Homo sapiens
  misc_feature: GYAE6OF02JYDQU.1.23.C01.1.454.CMB.1.raw
  modified_base (150)..(152): a, c, t, g, unknown or other
  misc_feature (150)..(152): n is a, c, g, or t
  modified_base (154)..(162): a, c, t, g, unknown or other
  misc_feature (154)..(162): n is a, c, g, or t
tcagacgagtgcgtcacgaccggtgctcgatttagtacacgtgattcgcgggggaccaagctgaccgtcctaggtcagccaaggctgcccctcggtcactctgttccacctcctcacgtctactgctgagcggctggcaaggcgcatagnnntnnnnnnnnn

SEQ ID NO: 245743 - DNA, 154 bp, Homo sapiens
  misc_feature: GYAE6OF02FFHS4.1.23.C01.1.454.CMB.1.raw
  modified_base (153)..(154): a, c, t, g, unknown or other
  misc_feature (153)..(154): n is a, c, g, or t
tcagacgagtgcgtcacgaccggtgctcgatttagtacacgtgattcgcggggaccaagctgaccgtcctaggtcagcccaaggctgccccctggtcactctgttcccaccctcctcacgtctactgctgagcgggctggcaaggcgcatagnn

SEQ ID NO: 245744 - DNA, 183 bp, Homo sapiens; identical to SEQ ID NO: 245671
  misc_feature: GYAE6OF02HZ9CD.1.23.C01.1.454.CMB.1.raw
  modified_base (181)..(183): a, c, t, g, unknown or other
  misc_feature (181)..(183): n is a, c, g, or t

SEQ ID NO: 245745 - DNA, 203 bp, Homo sapiens
  misc_feature: GYAE6OF02GNUI0.1.23.C01.1.454.CMB.1.raw
  modified_base (182)..(203): a, c, t, g, unknown or other
  misc_feature (182)..(203): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccgccctcctctctctcgactctgagcgggctggcaagggcgcatagnnnnnnnnnnnnnnnnnnnnnn

SEQ ID NO: 245746 - DNA, 179 bp, Homo sapiens
  misc_feature: GYAE6OF02G6V62.1.23.C01.1.454.CMB.1.raw
  modified_base (156)..(179): a, c, t, g, unknown or other
  misc_feature (156)..(179): n is a, c, g, or t
tcagacgagtgcgtcacgaccggtgctcgatttagtacacgtgattcgcggggggaccaagctgaccgtcctaggtcagcccaaggctgccccctcggtcactctcgttcccaccctcctcacgtctactgctgagcggctggcaaggcgcatagnnnnnnnnnnnnnnnnnnnnnnnn

SEQ ID NO: 245747 - DNA, 181 bp, Homo sapiens; identical to SEQ ID NO: 245666
  misc_feature: GYAE6OF02FRI72.1.23.C01.1.454.CMB.1.raw
  modified_base (181)..(181): a, c, t, g, unknown or other
  misc_feature (181)..(181): n is a, c, g, or t

SEQ ID NO: 245748 - DNA, 183 bp, Homo sapiens
  misc_feature: GYAE6OF02ID03P.1.23.C01.1.454.CMB.1.raw
  modified_base (181)..(183): a, c, t, g, unknown or other
  misc_feature (181)..(183): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccaccctcctctctctcgactctgagcgggctggcaaggcgcatagnnn

SEQ ID NO: 245749 - DNA, 198 bp, Homo sapiens
  misc_feature: GYAE6OF02HFAME.1.23.C01.1.454.CMB.1.raw
  modified_base (182)..(198): a, c, t, g, unknown or other
  misc_feature (182)..(198): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccacccgtcctctctctcgactctgagcgggctggcaaggcgcatagnnnnnnnnnnnnnnnnn

SEQ ID NO: 245750 - DNA, 183 bp, Homo sapiens
  misc_feature: GYAE6OF02I9PWH.1.23.C01.1.454.CMB.1.raw
  modified_base (180)..(183): a, c, t, g, unknown or other
  misc_feature (180)..(183): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccgccctcctctctctcgactctgagcggctggcaaggcgcatagnnnn

SEQ ID NO: 245751 - DNA, 193 bp, Homo sapiens
  misc_feature: GYAE6OF02G16T2.1.23.C01.1.454.CMB.1.raw
  modified_base (155)..(160): a, c, t, g, unknown or other
  misc_feature (155)..(160): n is a, c, g, or t
  modified_base (162)..(193): a, c, t, g, unknown or other
  misc_feature (162)..(193): n is a, c, g, or t
tcagacgagtgcgtcacgaccggtgctcgatttagtacacgtgattcgcgggggggaccaagctgaccgtcctaggtcagcccaaggctgccccctggtcactctgttcccaccctcctcacgtctactgctgagcggctggcaaggcgcatagnnnnnncnnnnnnnnnnnnnnnnnnnnnnnnnnnnnnnn

SEQ ID NO: 245752 - DNA, 189 bp, Homo sapiens
  misc_feature: GYAE6OF02J1QPE.1.23.C01.1.454.CMB.1.raw
  modified_base (179)..(189): a, c, t, g, unknown or other
  misc_feature (179)..(189): n is a, c, g, or t
tcagacgagtgcgtcacgaccggtgctcgatttagtacacgtgattcgcggggcccacgtgttgggtgttcggcggtagggaccaaggctgaccggtcctaggtcagcccaaggctgcccctggtcactctgttccgcctcctctctctcgactctgagcggctggcaaggcgcatagnnnnnnnnnnn

SEQ ID NO: 245753 - DNA, 156 bp, Homo sapiens
  misc_feature: GYAE6OF02HDX0B.1.23.C01.1.454.CMB.1.raw
  modified_base (154)..(156): a, c, t, g, unknown or other
  misc_feature (154)..(156): n is a, c, g, or t
tcagacgagtgcgtcacgaccggtgctcgatttagtacacgtgattcgcgggggaccaagctgaccgtcctaggtcagcccaaggctgcccctcggtcactctgttcccaccctcctcacgtctactgctgagcgggctggcaaggcgcatagnnn

SEQ ID NO: 245754 - DNA, 179 bp, Homo sapiens
  misc_feature: GYAE6OF02I0PS8.1.23.C01.1.454.CMB.1.raw
  modified_base (179)..(179): a, c, t, g, unknown or other
  misc_feature (179)..(179): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgcccctcggtcactctgttcccacctcctctctctcgactctgagcgggctggcaaggcgcatagn

SEQ ID NO: 245755 - DNA, 171 bp, Homo sapiens
  misc_feature: GYAE6OF02GYH5B.1.23.C01.1.454.CMB.1.raw
  modified_base (155)..(171): a, c, t, g, unknown or other
  misc_feature (155)..(171): n is a, c, g, or t
tcagacgagtgcgtcacgaccggtgctcgatttagtacacgtgattcgcgggggaccaagctggaccgtcctaggtcagcccaaggctgccccctcggtcactctgttcccaccctcctcacgtctactgctgagcggctggcaaggcgcatagnnnnnnnnnnnnnnnnn

SEQ ID NO: 245756 - DNA, 191 bp, Homo sapiens
  misc_feature: GYAE6OF02FVOYZ.1.23.C01.1.454.CMB.1.raw
  modified_base (154)..(191): a, c, t, g, unknown or other
  misc_feature (154)..(191): n is a, c, g, or t
tcagacgagtgcgtcacgaccggtgctcgatttagtacacgtgattcgcgggggaccaagctgaccgtcctaggtcagcccaaggctgccccctggtcactctgttcccaccctcctcacgtctactgctgagcgggctggcaaggcacatagnnnnnnnnnnnnnnnnnnnnnnnnnnnnnnnnnnnnnn

SEQ ID NO: 245757 - DNA, 183 bp, Homo sapiens; identical to SEQ ID NO: 245748
  misc_feature: GYAE6OF02FL4V3.1.23.C01.1.454.CMB.1.raw
  modified_base (181)..(183): a, c, t, g, unknown or other
  misc_feature (181)..(183): n is a, c, g, or t

SEQ ID NO: 245758 - DNA, 181 bp, Homo sapiens; identical to SEQ ID NO: 245660
  misc_feature: GYAE6OF02G3QJH.1.23.C01.1.454.CMB.1.raw
  modified_base (181)..(181): a, c, t, g, unknown or other
  misc_feature (181)..(181): n is a, c, g, or t

SEQ ID NO: 245759 - DNA, 155 bp, Homo sapiens; identical to SEQ ID NO: 245740
  misc_feature: GYAE6OF02HVY3O.1.23.C01.1.454.CMB.1.raw
  modified_base (155)..(155): a, c, t, g, unknown or other
  misc_feature (155)..(155): n is a, c, g, or t

SEQ ID NO: 245760 - DNA, 180 bp, Homo sapiens
  misc_feature: GYAE6OF02I51TB.1.23.C01.1.454.CMB.1.raw
  modified_base (180)..(180): a, c, t, g, unknown or other
  misc_feature (180)..(180): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccaccctcctctcttcgactctgagcgggctggcaaggcgcatagn

SEQ ID NO: 245761 - DNA, 197 bp, Homo sapiens
  misc_feature: GYAE6OF02F4SS7.1.23.C01.1.454.CMB.1.raw
  modified_base (195)..(197): a, c, t, g, unknown or other
  misc_feature (195)..(197): n is a, c, g, or t
tcagacgagtgcgtcacgaccggtgctcgatttagtacacgtgattacgacgggggcccaggtcgttgggtgttcggtcggagggtacccaacgcctgaccgtcctaggtccagcccaaggccgtgccccctcggtacacctctgttcccaccctcctctctctcgactctgagcgggctggcaaggcgcatagnnn

SEQ ID NO: 245762 - DNA, 163 bp, Homo sapiens
  misc_feature: GYAE6OF02F197X.1.23.C01.1.454.CMB.1.raw
  modified_base (156)..(163): a, c, t, g, unknown or other
  misc_feature (156)..(163): n is a, c, g, or t
tcagacgagtgcgtcacgaccggtgctcgatttagtacacgtgattcgcggggggaccaagctgaccgtcctaggtcagcccaaggctgccccctcggtcactctgttcccaccctcctcacgtctactgctgagcgggctggcaaggcgcatagnnnnnnnn

SEQ ID NO: 245763 - DNA, 271 bp, Homo sapiens
  misc_feature: GYAE6OF02IILM2.1.23.C01.1.454.CMB.1.raw
  modified_base (266)..(271): a, c, t, g, unknown or other
  misc_feature (266)..(271): n is a, c, g, or t
tcagacgagtgcgtcacgaccggtgctcgatttagtacacgtgattagggattggcagtggatcaggcatagattttacactgaaaatcagcagagtggaggctgaggacgttggggtttattactgcatgcaaggtctacaaaccccgatcaccttcggccgaggacacgcctggagattaaacgaactgtggctgcaccatctgtcttcatccttcccgccactctgaacgcactcgtctgagcggcgtggcaaggcgcatagnnnnnn

SEQ ID NO: 245764 - DNA, 181 bp, Homo sapiens; identical to SEQ ID NO: 245696
  misc_feature: GYAE6OF02I3ZIL.1.23.C01.1.454.CMB.1.raw
  modified_base (180)..(181): a, c, t, g, unknown or other
  misc_feature (180)..(181): n is a, c, g, or t

SEQ ID NO: 245765 - DNA, 184 bp, Homo sapiens
  misc_feature: GYAE6OF02HVBWB.1.23.C01.1.454.CMB.1.raw
  modified_base (181)..(184): a, c, t, g, unknown or other
  misc_feature (181)..(184): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccaccctcctctctctcgactctgagcgggctggcaaggcgcatagnnnn

SEQ ID NO: 245766 - DNA, 183 bp, Homo sapiens; identical to SEQ ID NO: 245748
  misc_feature: GYAE6OF02FRFO9.1.23.C01.1.454.CMB.1.raw
  modified_base (181)..(183): a, c, t, g, unknown or other
  misc_feature (181)..(183): n is a, c, g, or t

SEQ ID NO: 245767 - DNA, 183 bp, Homo sapiens; identical to SEQ ID NO: 245748
  misc_feature: GYAE6OF02GT6AL.1.23.C01.1.454.CMB.1.raw
  modified_base (181)..(183): a, c, t, g, unknown or other
  misc_feature (181)..(183): n is a, c, g, or t

SEQ ID NO: 245768 - DNA, 160 bp, Homo sapiens
  misc_feature: GYAE6OF02GZVGQ.1.23.C01.1.454.CMB.1.raw
  modified_base (156)..(160): a, c, t, g, unknown or other
  misc_feature (156)..(160): n is a, c, g, or t
tcagacgagtgcgtcacgaccggtgctcgatttagtacacgtgattcgcggggggaccaagctgaccgtcctaggtcagcccaaggctgccccctcggtcactctgttcccaccctcctcacgtctactgctgagcgggctggcaaggcgcatagnnnnn

SEQ ID NO: 245769 - DNA, 168 bp, Homo sapiens
  misc_feature: GYAE6OF02JFJU0.1.23.C01.1.454.CMB.1.raw
  modified_base (155)..(168): a, c, t, g, unknown or other
  misc_feature (155)..(168): n is a, c, g, or t
tcagacgagtgcgtcacgaccggtgctcgatttagtacacgtgattcgcgggggaccaagctgaccgtcctaggtcagcccaaggctgccccctcggtcactctgttcccgccctcctcacgtctactgctgagcgggctggcaaggcgcatagnnnnnnnnnnnnnn

SEQ ID NO: 245770 - DNA, 185 bp, Homo sapiens
  misc_feature: GYAE6OF02I3VEW.1.23.C01.1.454.CMB.1.raw
  modified_base (181)..(185): a, c, t, g, unknown or other
  misc_feature (181)..(185): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctcggtcactctgttcccgccctcctctctctcgactctgagcgggctggcaaggcgcatagnnnnn

SEQ ID NO: 245771 - DNA, 161 bp, Homo sapiens
  misc_feature: GYAE6OF02FS8SP.1.23.C01.1.454.CMB.1.raw
  modified_base (155)..(161): a, c, t, g, unknown or other
  misc_feature (155)..(161): n is a, c, g, or t
tcagacgagtgcgtcacgaccggtgctcgatttagtacacgtgattcgcggggggaccaagctgaccgtcctaggtcagcccaaggctgccccctggtcactctgttcccaccctcctcacgtctactgctgagcgggctggcaaggcgcatagnnnnnnn

SEQ ID NO: 245772 - DNA, 160 bp, Homo sapiens; identical to SEQ ID NO: 245768
  misc_feature: GYAE6OF02GITOK.1.23.C01.1.454.CMB.1.raw
  modified_base (156)..(160): a, c, t, g, unknown or other
  misc_feature (156)..(160): n is a, c, g, or t

SEQ ID NO: 245773 - DNA, 167 bp, Homo sapiens
  misc_feature: GYAE6OF02FULM0.1.23.C01.1.454.CMB.1.raw
  modified_base (155)..(155): a, c, t, g, unknown or other
  misc_feature (155)..(155): n is a, c, g, or t
  modified_base (157)..(167): a, c, t, g, unknown or other
  misc_feature (157)..(167): n is a, c, g, or t
tcagacgagtgcgtcacgaccggtgctcgatttagtacacgtgattcgcgggggaccaagctgaccgtcctaggtcagcccaaggctgccccctcggtcactctgttcccgccctcctcacgtctactgctgagcgggctggcaaggcgcatagnannnnnnnnnnn

SEQ ID NO: 245774 - DNA, 192 bp, Homo sapiens
  misc_feature: GYAE6OF02HF8RW.1.23.C01.1.454.CMB.1.raw
  modified_base (180)..(192): a, c, t, g, unknown or other
  misc_feature (180)..(192): n is a, c, g, or t
tcagacgagtgcgtcacgaccggtgctcgatttagtacacgtgattcgcgggggcccagtgttgggtgttcggcggagggaccaagctgaccgtcctaggtcagcccaaggctgccccctggtcactctgttcccgccctcctctctctcgactctgagcgggctggcaaggcgcatagnnnnnnnnnnnnn

SEQ ID NO: 245775 - DNA, 716 bp, Homo sapiens
  misc_feature: GYAE6OF02HBUWK.1.23.C01.1.454.CMB.1.raw
  modified_base (203)..(203): a, c, t, g, unknown or other
  misc_feature (203)..(203): n is a, c, g, or t
tcagacgagtgcgtcacgaccggtgctcgatttagtacacgtgattagggattgggggaggaactgctcagttaggacccagagggaaccatggaagccccagctcagcttctcttcctcctgctactctggcctcccagatgtcaccggagatattatattgacacagtctcagccacctgtctttgtctaccgagggaaancgaccaccctctccgtgcgacgggcccagtcagacgttattaccgtactacgttacgccgttaggtaccaacgagacgaccgtcggccgacgcctccgacggtccttcctacgtatcgtagtcgtacgtcgtaccgttaccgaacgccgggaccacgtcgggactaccgtacccgaacgtacggttaccgaacggtcggacgtcgggtacggtcgcggtaccgaactacggtaccttacgaccttcgtacccaccgtaacgtcgaacgcgaccgtaccgtacggtaaccgtccgtaaggtaaccgttaccgttagtaccgttaacgtttacttacgtaccgtacctacgtacgactaacgtacaagtcccgtacgtccgttacgttccgtttacggtacgggtacggaaccggttacggtacgggtgtaacgtaacggtaacgtaaaccgtacgggttacgtccgggtacgtaccgttaccgaccgttacgtacgttacgttcccttaacccg

SEQ ID NO: 245776 - DNA, 633 bp, Homo sapiens
  misc_feature: GYAE6OF01B6TFA.25.61.F06.1.454.CMB.1.raw
  modified_base (601)..(601): a, c, t, g, unknown or other
  misc_feature (601)..(601): n is a, c, g, or t
  modified_base (606)..(606): a, c, t, g, unknown or other
  misc_feature (606)..(606): n is a, c, g, or t
  modified_base (608)..(633): a, c, t, g, unknown or other
  misc_feature (608)..(633): n is a, c, g, or t
tcagactgtacagtcacgaccggtgctcgatttagctacgctctaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatatttgactggttattatggggggctactactactactacatggacgtctgggacaaaagggaccacggtaaccgtcgtccctacacggcctccaacccgaacggggccccaacgtccggtaccctttcccccccgtcgggcctaccccctccccttacccaacggacgccgtaaccgtccgtacgggggggaccaacgacgggtacccggccccgtcggggccgtacggtacccgtgggtaccgaaacgggaccgtttaacccgtttccccaacccgtttaggtaaccaacgggtttccgttaacgggaacggtcccggggggtaccttggggaacccgaaacggggtcccggactaaacgttaggcacgngtacnannnnnnnnnnnnnnnnnnnnnnnnnn

SEQ ID NO: 245777 - DNA, 636 bp, Homo sapiens
  misc_feature: GYAE6OF02F0B6B.25.61.F06.1.454.CMB.1.raw
  modified_base (607)..(609): a, c, t, g, unknown or other
  misc_feature (607)..(609): n is a, c, g, or t
  modified_base (611)..(613): a, c, t, g, unknown or other
  misc_feature (611)..(613): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
  modified_base (619)..(620): a, c, t, g, unknown or other
  misc_feature (619)..(620): n is a, c, g, or t
  modified_base (622)..(622): a, c, t, g, unknown or other
  misc_feature (622)..(622): n is a, c, g, or t
  modified_base (624)..(625): a, c, t, g, unknown or other
  misc_feature (624)..(625): n is a, c, g, or t
  modified_base (627)..(628): a, c, t, g, unknown or other
  misc_feature (627)..(628): n is a, c, g, or t
  modified_base (630)..(634): a, c, t, g, unknown or other
  misc_feature (630)..(634): n is a, c, g, or t
tcagactgtacagtcacgaccggtgctcgatttagctacgctctaaggggaaaggggcgtggagtgggtttccatacattagtagtagtggtagtaccatatactacgcagactctgtgaaggggccgattcaccatcttccgagggacaacgccaagaactcactgtatctgcaaatgaacagcctgagagccgaggacacggccgtgtattactgtgcgagagaacagttacgattattttgtacgttggttaacgttagtgggggggcctacgtactacgtaactacagtggacgtcgtcgggtacgaaacgggaccaacgggtcaacccgtaccgtcctaccagaccccttaccaccgaaacgggccccaagttccggttacccttcccccgtcggaccctaccccgttcctaccgaacgacggccctaaccgtcggttcggggaccaacgtacggaccggcccggttacgggcgttacggtcccgttggtaacgtaacggtaccctaccgtttaccaccgtaggtacgtacggtcgtacgtacgggcgggaccgttcggaacggacggccgtccaagttaagcgattgactcagtcatgacnnncnnngngngnngngnngnngnnnnngc

SEQ ID NO: 245778 - DNA, 497 bp, Homo sapiens
  misc_feature: GYAE6OF02FWXDY.25.61.F06.1.454.CMB.1.raw
  modified_base (477)..(497): a, c, t, g, unknown or other
  misc_feature (477)..(497): n is a, c, g, or t
tcagactgtacagtcacgaccggtgctcgatttagctacgctctaagggaaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgattattttgacttggttattagtgggggggcctacgtactactactacatggacgtctggggcaaagggaccacggtcaccgtctcctcagcctccaccaagggcccatccggtccttccccctcggccacccctcctcccaagacgccacctcgtgggggcacacggcggccctgggctcgcctgggtcaagggactacttcccacgtcgtacagttctggacgcggggcctgggcaggcgcagtagnnnnnnnnnnnnnnnnnnnnn

SEQ ID NO: 245779 - DNA, 259 bp, Homo sapiens
  misc_feature: GYAE6OF01DELZK.44.83.H06.1.454.CMB.1.raw
  modified_base (257)..(259): a, c, t, g, unknown or other
  misc_feature (257)..(259): n is a, c, g, or t
tcagacagtatatacacgaccggtgctcgatttagatcacgtgcgtcgcgggaagatgaagacagatttcactctcaccgtcagcagcctgcagcctgaagatgttgcaacttattactgtcaaaagtataacagtgcccctcacactttcggccctgggaccacagtggatatcaagcgaactgtggctgcaccatctgtcttcatcttcccgcatctgatatatactgtctgagcgggctggcaaggcgcatagnnn

SEQ ID NO: 245780 - DNA, 190 bp, Homo sapiens
  misc_feature: GYAE6OF01CKQX0.44.83.H06.1.454.CMB.1.raw
  modified_base (188)..(190): a, c, t, g, unknown or other
  misc_feature (188)..(190): n is a, c, g, or t
tcagacagtatatacacgaccggtgctcgatttagatcacgtgcgtcgcgggatgacatcctgagtggactgctattcggcggagggaccaagctgaccgtcctaagtcagcccaaggctgccccctcggtcactctgttcccaccctcctctatatactgtctgagcgggctggcaaggcgcatagnnn

SEQ ID NO: 245781 - DNA, 192 bp, Homo sapiens
  misc_feature: GYAE6OF01BR5B6.44.83.H06.1.454.CMB.1.raw
  modified_base (188)..(192): a, c, t, g, unknown or other
  misc_feature (188)..(192): n is a, c, g, or t
tcagacagtatatacacgaccggtgctcgatttagatcacgtgcgtcgcgggatgacatcctgagtggactgctattcggcggagggaccaagctgaccgtcctaagtccagcccaaggctgcccctcggtcactctgttcccaccctcctctatatactgtctgagcgggctggcaaggcgcatagnnnnn

SEQ ID NO: 245782 - DNA, 269 bp, Homo sapiens
  misc_feature: GYAE6OF02JU1V7.44.83.H06.1.454.CMB.1.raw
  modified_base (257)..(269): a, c, t, g, unknown or other
  misc_feature (257)..(269): n is a, c, g, or t
tcagacagtatatacacgaccggtgctcgatttagatcacgtgcgtcgcgggaagatgaagacagatttcactctcaccgtcagcagcctgcagcctgaagatgttgcaacttatactgtcaaaagtataacagtgtccctcacactttcggccctgggaccacagtggatatcaagcaactgtggctggcaccatctgtcttcatctcccgcatctgatatatactgtctgacgcgggtctggcaaggcgcatagnnnnnnnnnnnnn

SEQ ID NO: 245783 - DNA, 262 bp, Homo sapiens
  misc_feature: GYAE6OF02GLDPG.44.83.H06.1.454.CMB.1.raw
  modified_base (258)..(262): a, c, t, g, unknown or other
  misc_feature (258)..(262): n is a, c, g, or t
tcagacagtatatacacgaccggtgctcgatttagatcacgtgcgtcgcgggaagatgaagacagatttcactctcaccgtcagcagcctgcagcctgaagatgttgcaacttattactgtcaaaagtataacagtgcccctcacactttcggccctgggaccacagtggatatcaagcgaactgtggctgcaccatctgtcttcatcttcccgccatctgatatatactgtctgagcgggctggcaaggcgcatagnnnnn

SEQ ID NO: 245784 - DNA, 311 bp, Homo sapiens
  misc_feature: GYAE6OF02GLSUR.44.83.H06.1.454.CMB.1.raw
  modified_base (271)..(275): a, c, t, g, unknown or other
  misc_feature (271)..(275): n is a, c, g, or t
  modified_base (277)..(311): a, c, t, g, unknown or other
  misc_feature (277)..(311): n is a, c, g, or t
tcagacagtatatacacgaccggtgctcgatttagatcacgtgcgtcggtcggggaagatgaagacagagtttcactctcaccgtcagcagcctgcagcctgaagatgttgccaacttattactgtaccaaaagtataacagtgcccctcacacgttttccggcccgtgggaccacagtggatatcaagcgaactgtggctgcaccgactctgtcttcatcttcccgcctatctgatatatactgtctgagcggctggcaaggcgcatagnnnnncnnnnnnnnnnnnnnnnnnnnnnnnnnnnnnnnnnn

SEQ ID NO: 245785 - DNA, 275 bp, Homo sapiens
  misc_feature: GYAE6OF02I8EUJ.44.83.H06.1.454.CMB.1.raw
  modified_base (259)..(275): a, c, t, g, unknown or other
  misc_feature (259)..(275): n is a, c, g, or t
tcagacagtatatacacgaccggtgctcgatttagatcacgtgcgtcgcgggaagatgaagacagatttcactctcaccgtcagcagcctgcagcctgaagatgttgcaacttattactgtcaaaagtataacagtgcccctcacactttcggccctgggaccacagtggatatcaagcgaactgtggctggcaccatctgtcttcatcttcccgccatctgatatatactgtctgagcggctggcaaggcgcatagcnnnnnnnnnnnnnnnnn

SEQ ID NO: 245786 - DNA, 283 bp, Homo sapiens
  misc_feature: GYAE6OF02F6PWK.44.83.H06.1.454.CMB.1.raw
  modified_base (257)..(258): a, c, t, g, unknown or other
  misc_feature (257)..(258): n is a, c, g, or t
  modified_base (260)..(283): a, c, t, g, unknown or other
  misc_feature (260)..(283): n is a, c, g, or t
tcagacagtatatacacgaccggtgctcgatttagatcacgtgcgtcgcgggaagatgaagacagatttcactctcaccgtcagcagcctgcagcctgaagatgttgcaacttattactgtcaaaagtataacagtgcccctcacactttcggccctgggaccacagtgatatcaagcgaactgtggctgcaccatctgtcttcatcttcccgcatctgattatactgtctgagccgggctggcaaggccgcatagnncnnnnnnnnnnnnnnnnnnnnnnnn

SEQ ID NO: 245787 - DNA, 507 bp, Homo sapiens
  misc_feature: GYAE6OF01BFK77.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttaggaactaaaacagagtatggagagaagttcagggcagagtcatcatcacgcggacacatccacgagtacagcctacatgaactgaggagcctcagatctagacgacacggccacttatactgcgcgagacgattagtgcacgtggtcctggctgtaaccacgcgttgtgggtaccg

SEQ ID NO: 245788 - DNA, 507 bp, Homo sapiens
  misc_feature: GYAE6OF01D055X.42.49.E05.1.454.CMB.1.raw
  modified_base (424)..(424): a, c, t, g, unknown or other
  misc_feature (424)..(424): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagccttacggaactaaaacagagtatggagagaagttccagggcagagtcatcatcacgcggacacatccacgagtacagacctacatggaactgagagcctnagatctagaccgacaccggccaacttattactgcgcgagacgattagtgcactggtcctggctcgtaacacgtcttggtggcg

SEQ ID NO: 245789 - DNA, 521 bp, Homo sapiens
  misc_feature: GYAE6OF01C0RCT.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgagtggatgggatggatcagcccttacggaactaaacagagtataggagagaagttcgagggcagagtcatcatcacgcgacacataccacgagtacagcctaacatcggaactgaggacgcctacagatcgtagacgacacggcctacttatactgcgcgagagtattagtcgctacgtggtcctggactacgtaaccagtcgttggtgggtaccg

SEQ ID NO: 245790 - DNA, 499 bp, Homo sapiens
  misc_feature: GYAE6OF01BPJCZ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttcagggcagagtcatcatcacgcggacacatccacgagtacagcctacatggaactgaggagcctcagatctgacgacacggccacttatactgcgcgagagattatgcatggtcctggctgtaaccagcttgtgggcg

SEQ ID NO: 245791 - DNA, 509 bp, Homo sapiens
  misc_feature: GYAE6OF01DMVQ9.42.49.E05.1.454.CMB.1.raw
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttcagggcagagtcatcatcaccgcgacacatccacgagtacagcctacatggaactgaggagcctcagatctgacgacacggccacttattactgcgcgagagtattagttgctactggtcctggctgtaacccagtcttggtgggaccg

SEQ ID NO: 245792 - DNA, 506 bp, Homo sapiens
  misc_feature: GYAE6OF01CTTA2.42.49.E05.1.454.CMB.1.raw
  modified_base (423)..(423): a, c, t, g, unknown or other
  misc_feature (423)..(423): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttcacctacggtatgaattggttgagacaggcccccggagaggggcttgagtggatgggatggatcagccttacggaactaaaacagagtatggagagaagttccaggcagagtcatcatcaccgcggacacatccacgagtacagcctacatggaactgagagcctnagatcgtgacgacacggccacttattactgcgcgagacgattattgacagtggtcctggctcgtaaccngcttggnggtaccg

SEQ ID NO: 245793 - DNA, 542 bp, Homo sapiens
  misc_feature: GYAE6OF01CSIZE.42.49.E05.1.454.CMB.1.raw
  modified_base (524)..(524): a, c, t, g, unknown or other
  misc_feature (524)..(524): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacacggccccccggagagggggcttggagtggatgggatggatcagcccttacggaactaaaacagagtatggagagagttcaggcagtagcatcatcacgcggacacataccacgagtacagcctaacagtacggaactggacggacgcctacgagactcgtagacgacgacggcctattacttactgcgacgagagtattagttcgactacgttcggtccgtggcctacgtaaccgngtcgttggtcgggtaccg

SEQ ID NO: 245794 - DNA, 595 bp, Homo sapiens
  misc_feature: GYAE6OF01DAR9J.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagacccttacggaaactaaacagagtatggagagagttccgagggcagagtcatcatcaccgcggacacactaccgacgacgtacacgtacctaacgagtacggaacgtacggaaggacgtacctacgagtacgtacgtacgaccgaaccgaccgggtacctaactttacgttacgtcggaccgacggtagacgttattacgttcgacttacggttcggtccgttaggtccgttacggtaacccgaccggttacgttgggtcggtacccggg

SEQ ID NO: 245795 - DNA, 516 bp, Homo sapiens
  misc_feature: GYAE6OF01A9Y57.42.49.E05.1.454.CMB.1.raw
  modified_base (409)..(409): a, c, t, g, unknown or other
  misc_feature (409)..(409): n is a, c, g, or t
  modified_base (424)..(424): a, c, t, g, unknown or other
  misc_feature (424)..(424): n is a, c, g, or t
  modified_base (463)..(463): a, c, t, g, unknown or other
  misc_feature (463)..(463): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggtcctcagtgatggtctcctgcagtgcttctggttacatcttttccacctacggtatgaattggttgagacaggcccccggagaggggcttgagtggatgggatggatcagcccttaggaactaaaacagagtatggagagaagttcagggcagagtcatcatcaccgcggacacatccacgagtacagcctanatggaactgaggacncctcagatctagacgacacggacctacttactactgcgngagagattagtgcacgtcgtcctggactacgtaaccacgtcttggtggtaccg

SEQ ID NO: 245796 - DNA, 522 bp, Homo sapiens
  misc_feature: GYAE6OF01DOTTL.42.49.E05.1.454.CMB.1.raw
  modified_base (514)..(514): a, c, t, g, unknown or other
  misc_feature (514)..(514): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggagtgggatgggatcagacccttacggaactaaaacacgagtatggagagaagttccgaggcagagtcatcatcacgcggacacataccacgagtacagacctacatggaactggaggacgcctcagatcgtagacgacacggcctacttattactgcgcgagagtattagtgcacgttcggcctggctacgtaaccagtcttgngggtaccg

SEQ ID NO: 245797 - DNA, 519 bp, Homo sapiens
  misc_feature: GYAE6OF01CDTD5.42.49.E05.1.454.CMB.1.raw
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (512)..(512): a, c, t, g, unknown or other
  misc_feature (512)..(512): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagtacacggcccccggagagggggcttgaggtggagtgggatggatcagccttaggaactaaaacagagtatggagagaagttccaggcagagtcatcatcaccgcggacacatccaacgagtacacgtcctaacataggaactggagagcctcagatctgacacaccggcacttatcngcgngagagtattagtgctacgtcggtcctggctcgtaaccagtcttgggnggtaccg

SEQ ID NO: 245798 - DNA, 511 bp, Homo sapiens
  misc_feature: GYAE6OF01B8XWT.42.49.E05.1.454.CMB.1.raw
  modified_base (281)..(281): a, c, t, g, unknown or other
  misc_feature (281)..(281): n is a, c, g, or t
  modified_base (409)..(409): a, c, t, g, unknown or other
  misc_feature (409)..(409): n is a, c, g, or t
  modified_base (432)..(432): a, c, t, g, unknown or other
  misc_feature (432)..(432): n is a, c, g, or t
  modified_base (472)..(472): a, c, t, g, unknown or other
  misc_feature (472)..(472): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttnagacaggcccccggagaggggcttgagtggagtgggatggatcagcccttacggaactaaacagagtatggagagaagttcagggcagagtcatcatcaccgcggacacatccacgagtacagcctanatggaactgagagcctcagatcngacgacaccgacacttatactgcgcgagagtattagtganacgtggtcctggctacgtaaccagtcttggtgggtaccg

SEQ ID NO: 245799 - DNA, 620 bp, Homo sapiens
  misc_feature: GYAE6OF01DQYN8.42.49.E05.1.454.CMB.1.raw
  modified_base (219)..(219): a, c, t, g, unknown or other
  misc_feature (219)..(219): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctnagtgatggtctcctgcagtgctttcgtggttactattcttttccacctacggtatgtaattggttagagacgacgggcccccggaggacggggtcttggaggtggagtgggatggatcgacgtacccgttaacggaaactaaaacgaggtaacgtagtaggaaggagtaacggttaccgagggcaaggtagtacactacacgtcgaccgacggacacactaccgaacgagtaacacgacctaacgagtacgggaactggaacggacgtacccgtacgaggtactcgtacgaacgaccgaccgacctaactttagtacgtcgaccgagagacgttaattagttcgacgtacgttcgggtccgtaggtacctacggtacccaggttcgttggtcgggtaccgg

SEQ ID NO: 245800 - DNA, 528 bp, Homo sapiens
  misc_feature: GYAE6OF01BP1AU.42.49.E05.1.454.CMB.1.raw
  modified_base (439)..(439): a, c, t, g, unknown or other
  misc_feature (439)..(439): n is a, c, g, or t
  modified_base (516)..(516): a, c, t, g, unknown or other
  misc_feature (516)..(516): n is a, c, g, or t
tcagtgacgtatgtcacgaccggtgctcgatttagagcgactagcaacacacaaaggggacccaaaaaccacacccctccttgggagaatcccctagatcacagctcctaaccatggacgggacctggagcatccttttcttggtggcagcagcaacaggtgcccactcccaggttcacctggtgcagtctggagctgagctgcagaagcctggggcctcagtgatggtctcccgcagtgcttctggttacatcttttccacctacggtatgaattggttgagacaggcccccggagagggggcttggagtggatggggatgggatcagcccttaaggaactaaaacagagtatggagagaagttccagggcagagtcatcatcaccgcggacacatccacgagtacagcctaacatggaactgaggagcctcagatcngacgacacggccacttatactgcgacgagagtattagtgctacgtggtcctggctagaccacggtcttaggcgggcncggtaccggggg

SEQ ID NO: 245801 - DNA, 525 bp, Homo sapiens
  misc_feature: GYAE6OF01D58M6.42.49.E05.1.454.CMB.1.raw
  modified_base (387)..(387): a, c, t, g, unknown or other
  misc_feature (387)..(387): n is a, c, g, or t
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggagtgggatggatcgagcccttacggaaactaaacagagtatggagagagtacgaggcagagtcatcaatcaccgngacacactcacgagtacagacctanatggaactgagagctnanatctgacacgacggacctacgttatacagcgacgagagtattagtgatacgtggtccctgggccttacgtaaccctacggtcttggtgggtaccg

SEQ ID NO: 245802 - DNA, 533 bp, Homo sapiens
  misc_feature: GYAE6OF01CHF04.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttcgaggcagagtcatcatcaccgcggacacactccaacgacgtacagcctacatcggaactgacggacgcctacagatcgtagaccgacgacggcctacttacttactgcgacgagagtattagttcgactacgtcggtcctggtctacgtaaccagtcttggtcgggtaccg

SEQ ID NO: 245803 - DNA, 577 bp, Homo sapiens
  misc_feature: GYAE6OF01AZ099.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagtacgaggcccccggagagggggcttggaggtggatgggatggatcgagtacccgttacggaaactaaaacgagaagtagtggagagtaagttccgagggcaggagtacatcatcaccgcgacacactacacgagtacagcctaacagtaggaactggaaggacgcctacgagtactcgagaaccgacgaaccggtcctaacgtttacttaacgtcggacgacgtagacgtattacgtcgactacgttggtaccttgggacttacgtaaccgtacgtcgttgggtcggtaccgg

SEQ ID NO: 245804 - DNA, 536 bp, Homo sapiens
  misc_feature: GYAE6OF01BMACJ.42.49.E05.1.454.CMB.1.raw
  modified_base (414)..(414): a, c, t, g, unknown or other
  misc_feature (414)..(414): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggatgggatggatcagcccttacggaactaaaacagagtatggagagaagttccagggcagagtcatcatcaccgcggacacactccgacgagtacagcctanatagggaactggaggagcctcgagatcgtgacgacgacggacctacttactacgtgacgcgagagtattagtgactacgtcggtaccgtggcttacgtaaccacgtcgttggtcgggtaccg

SEQ ID NO: 245805 - DNA, 542 bp, Homo sapiens
  misc_feature: GYAE6OF01EEVG3.42.49.E05.1.454.CMB.1.raw
  modified_base (420)..(420): a, c, t, g, unknown or other
  misc_feature (420)..(420): n is a, c, g, or t
  modified_base (533)..(533): a, c, t, g, unknown or other
  misc_feature (533)..(533): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattcttttccaccttacggtatgaattggttgagtacacggccccccggagacgggggcttggagtgggagtggggatgggatcagcccttaggaactaaaacagagtatggagagaagttcaggcgagagtcatcatcaccgcggacacactccagagtacagcctaanatggaactgaggagcctacagactctgaacgacgacggacctacgttatactgcgcgaagagtatttagtcgctacgtggtccctggtaccttacgtaacccacggtcttggngggtaccgg

SEQ ID NO: 245806 - DNA, 511 bp, Homo sapiens
  misc_feature: GYAE6OF01BGT5Z.42.49.E05.1.454.CMB.1.raw
  modified_base (472)..(472): a, c, t, g, unknown or other
  misc_feature (472)..(472): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccccggagaggggcttggagtggatgggatggatcagcccttacggaactaaaacagagtatggagagaagttcagggcagagtcatcatcaccgcgacacatccacgagtacagcctacatggaactgagagctcagatctagacgacacggaccacttatactgcgcgagagtattatgnacgtggtccctggctagtaaccacgcttggtgggtaccg

SEQ ID NO: 245807 - DNA, 526 bp, Homo sapiens
  misc_feature: GYAE6OF01C5XFM.42.49.E05.1.454.CMB.1.raw
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacaggcccccggagaggggcttgagtggatgggatggatcagcccttacggaactaaaacagagtatggagagaagttcagggcagagtcatcatcaccgcggaacacactccacgagtacagcctaacagtggaactgagncctnagatctgacgacacggcctagttacttaacgtgacgtacgaagagtattagtcgactacgtcggtcctggtctcgtaaccagtcttggtcgggtacg

SEQ ID NO: 245808 - DNA, 535 bp, Homo sapiens
  misc_feature: GYAE6OF01EO7EY.42.49.E05.1.454.CMB.1.raw
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatctttccacctacgtatgattggttgagacacggcccccggagaggggcttggagtggagtgggatggatcgacggtcccttaacggaaactaaaacgaggagtagtggagagtaagttccgagggacagagtacatcatcgaccgcgacacactcacgatacagcctanagtgactgagngcctnagntcngaccgacacggctacttatacgtgcgacgagtagagttatcgactacgtcggtccgtaggcttacgtaacccagtccgtttggcgggtaccg

SEQ ID NO: 245809 - DNA, 575 bp, Homo sapiens
  misc_feature: GYAE6OF01BKSF8.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacacggccccccggaggaggggcttggaggtggagtggggatggatcacgtacccgttaacggaaactaaaacgagagtagtggagagtaagttcgagggacagagtcatcatcaccgcggacacactccacgagtacagcctacatacggaactggaggacgcctacagactcgtagaaccgaccgaccggtacctaacgttacttacgtgaccgacgtagagtattagtgacctacggttcggtcccgtggtaccgttacgtaacccacggtcgttgggtcggtacccgg

SEQ ID NO: 245810 - DNA, 507 bp, Homo sapiens
  misc_feature: GYAE6OF01CIVB9.42.49.E05.1.454.CMB.1.raw
  modified_base (494)..(494): a, c, t, g, unknown or other
  misc_feature (494)..(494): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatggatcagccttacggactaaacagagtatggagagaagttccaggcagagtcatcatcaccgcgacacatccacgagtacagcctacatggaactgaggagcctcagatctgacgacgacggccacttacttactgcgcgagagtattagttgcacgtggtcctgcctgtaaccngtcttgtggtccg

SEQ ID NO: 245811 - DNA, 584 bp, Homo sapiens
  misc_feature: GYAE6OF01CB743.42.49.E05.1.454.CMB.1.raw
  modified_base (351)..(351): a, c, t, g, unknown or other
  misc_feature (351)..(351): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagtacacggcccccggagaggggcttgagtggagtgggatggatcgagcccgttaacggaactaaaacngagtataggagagaagttcgagggcagagtcatcatcaccgcggacacgactccgaacgtacgtacaacgacctaacgaagttcggaactaggaaggacgcctcgaagactcgtagaaccgtacgaccgggtacctacttaagttaccgtgacgccggaagagtaatttacgtcgacctaacgttcgggtaccgttaggccttagaacccgacgtcgtttgggcgggtacccg

SEQ ID NO: 245812 - DNA, 608 bp, Homo sapiens
  misc_feature: GYAE6OF01AZVHZ.42.49.E05.1.454.CMB.1.raw
  modified_base (430)..(430): a, c, t, g, unknown or other
  misc_feature (430)..(430): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccaccttacggtatgaattggttgagacgacggcccccggaggaggggcttggagtggagtgggatggatcgagacccttaacggaactaaaacgagagtagtaggagagtaagtcgagggcagatacatcatcaccgcggaacacgactccgacgacgtacacgtacctanacgtaggaacgtggaacggtacgcctacgagtactacgtacgaacgaaccgaccgggtaccaacgtttaactacgtacggacgtacggaagtacgtaagtttaagtttccgagtacgttcgggttaccgtggacccgttaaggtaaccctaacggttcggtttgggtacggggtccgg

SEQ ID NO: 245813 - DNA, 590 bp, Homo sapiens
  misc_feature: GYAE6OF01BEH7F.42.49.E05.1.454.CMB.1.raw
  modified_base (241)..(241): a, c, t, g, unknown or other
  misc_feature (241)..(241): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcaggtncttctggttacatcttttccacctacggtatgtaattggttgagtacgacggcccccgggaggagggggtcttggaggtggagtgggatggatcgagtcccttaacggaaactaaaacgagacgtaagtggagagaagttccagggcagagtcatcatcaccgacgacacactccaacgacgtacacgacctaacagtacggaactggaggacgctacagtactcgtacggaaccgacgaccggtacctattacttacgtcgccgtagaaggtagtagttacgttcgaccgtacgttacggttcgtacggtacttacggtaaccctaggtcgttgggtcgggtaaccgg

SEQ ID NO: 245814 - DNA, 661 bp, Homo sapiens
  misc_feature: GYAE6OF01B58XF.42.49.E05.1.454.CMB.1.raw
  modified_base (221)..(221): a, c, t, g, unknown or other
  misc_feature (221)..(221): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctnagtgatggtctcctgcagtgcttctggttacattcttttccactacggtatgtaattggttgagtacgacggccccggaggaggggtcttggagtggatgggatggatcgacggtcccgttaacggaaactaaaacgaggtaagtaagtagggaagtaaggaagttccgaagggacaaggtagtacagtacgactaccgaaccggacgggaaccaacgacgtacccgaacggtaacgtaaccaacggtaccctaaacgtaggttacgggaaaccgttggaacgggtaccgacccttacgaaggtacttcgacggaaccgaccgaaccgggtacctaacgtttactaccgtgaccggtacgaagtacgtatttacgtcgaccgtacgttcgggtacccgtggtaccttacgtaacccgtaggtcgttgggtcgggtaccgg

SEQ ID NO: 245815 - DNA, 534 bp, Homo sapiens
  misc_feature: GYAE6OF01AWWL9.42.49.E05.1.454.CMB.1.raw
  modified_base (350)..(350): a, c, t, g, unknown or other
  misc_feature (350)..(350): n is a, c, g, or t
  modified_base (426)..(426): a, c, t, g, unknown or other
  misc_feature (426)..(426): n is a, c, g, or t
  modified_base (466)..(466): a, c, t, g, unknown or other
  misc_feature (466)..(466): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgaggtggatgggatggatcagccttaacggaactaaacagagtanggagagaagttcgaggcagagtcatcatcacgcgacacatccacgagtacagacctaacagtaggaactgaggacncctacagactcgagaccacgaccggtcctacttattacgngcgcgagagtattagtcgacacgttcgtccgtggaccttagtaaccctacgtcttggtcgggtaccgg

SEQ ID NO: 245816 - DNA, 649 bp, Homo sapiens
  misc_feature: GYAE6OF01CMSQ5.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctacagaagcctggggcctcagtgatggtctcctgcagtgcttctggttacattcttttccactacggtatgaattggttgagacaggcccccggagaggggcttgagtggatgggatggatcagcccttacggaactaaacagagtatggagagagtcagggcagagtcatcatcaccgcgacacataccacgagtacagcctaacagtggaactggaggacgccgtacagtactcgtacgaaccgtaacaccgggtaccctaacttttagtttaacgttacggaccggtacggtaaaggtaacggtaagtttttaaagtttacgggtaccgtaacccggtttcggggttaccccggttacggggttacccgtttaacgggttaaaaccccggtaaacccggttccgggtttttacgggttcggggggtaacccgttaacccggggggg

SEQ ID NO: 245817 - DNA, 577 bp, Homo sapiens
  misc_feature: GYAE6OF01CRWAQ.42.49.E05.1.454.CMB.1.raw
  modified_base (446)..(446): a, c, t, g, unknown or other
  misc_feature (446)..(446): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgtaattggttgagacacgggccccccggaggacgggggtcttggagtggagtgggagtggatcagtacccttacggaactaaaacgagtagtagtaggagagaagttacgagggacagagtcatcagtcacgcgacacactccacgagtacagcctacatgaactggagacgcctnagactcgtgacgacgaccggtcctacttacttacgtgacgacggagtaagtatttagttcgacgtaacggttcgggtacccgttggtaccgttacggtaacccgtacggttccgttgggtcgggtacccgg

SEQ ID NO: 245818 - DNA, 604 bp, Homo sapiens
  misc_feature: GYAE6OF01DZKLN.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcagtgcttctggttactattctttccaccgtacgtatgtaattggttagagtacgacggcccccggagaggggtcttggaggtggagtagggatggactcgacgtaccgttaacggaaactaaaacgagagtagtaggaagagtaacgttcgagggacagagtacatacgataccaccggcgacacactaccagaacgtacaacgtacctaacagtacggaacgtaggaggacgtaccgtacgaagtactcgtacgaaccgaccgacggtacccttattacttacgtcgacgacgaagtacgtattacgtcgactacgttcggtccgtaggtaccgtacgtaacccgtgtccgttgggcggtaccgg

SEQ ID NO: 245819 - DNA, 633 bp, Homo sapiens
  misc_feature: GYAE6OF01BAJUF.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgtaattggttgagtacgacggcccccggaggacggggcttggaggtggagtggggatgggactcgacggtacccgttaacggaaacttaaaacgaggagtaagtagggaagtaaggaagttccgaagggacaggagtcatcatcgaccgcggacacactccgacgacgtacagacctacagtacggaactggaacggacgcctacgagactacgtcgaaccgacgaaccggtacctaacgttaacgttaccgtaggtaccgacggtaacggtacgtaatttacgtcggtaccaacggttcggttacccgttacggtaccgttaccggtaacccgtacggtccgtttcgggtcgggtaccccgg

SEQ ID NO: 245820 - DNA, 588 bp, Homo sapiens
  misc_feature: GYAE6OF01EK7U2.42.49.E05.1.454.CMB.1.raw
  modified_base (423)..(423): a, c, t, g, unknown or other
  misc_feature (423)..(423): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggaggtggagtgggatgggatcgagcccgttaacggaaactaaaacacgagtagtggagaggaagttcgaggacagagtcatcatcacgcggacactataccgacgagtacacgctaanatagaactaggaggacgcctagacgatcgtacgaacgaccaccgggtacctaacgtttacttacgtcgtcggacgtagtacgtaatttacgttgaccgtacggttcgggtacccttagggaccttaggttaaaccccacgggttcgtttgggtcggggtacccgg

SEQ ID NO: 245821 - DNA, 582 bp, Homo sapiens
  misc_feature: GYAE6OF01B1MLV.42.49.E05.1.454.CMB.1.raw
  modified_base (472)..(472): a, c, t, g, unknown or other
  misc_feature (472)..(472): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattccttttccacctacggtatgtaattggttgagacacggcccccggaggagggggcttggagtgggagtggggatggatcgagacccgttaacggaaactaaaacgagaagtatagggaagaggaacgttacgagggacaggagtcatcatccgacgcggaacacataccgagacgtacagcctaacagtaggaactaggaggacgcctacgagatcgngaaccgacaccgggtacctaacttacttacgcgcgacgaagacgtagttagttcgaccagttcggtaccttgggaccttacggtaaccctacggtcttgggcggtaccgg

SEQ ID NO: 245822 - DNA, 715 bp, Homo sapiens
  misc_feature: GYAE6OF01C6USJ.42.49.E05.1.454.CMB.1.raw
  modified_base (245)..(245): a, c, t, g, unknown or other
  misc_feature (245)..(245): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagagccgtggggcctcgagtgagtggtctcctgcagtgcttntggttacattccttttccaccgtacggtatgtaattggttgagacgacgggccccggaggacggggtcttggaggtggagtgggatggactcgtacgtaccgttaacggaaactaaacgagtagtagtaggaagtagtaacggttcgagggacaggtacgtacatcacgtccgaccggacggaccaacacgtaccgaacgacgtacgacgtacctaacgacgtacggtaacgtaggaacggtacgtacctacgaggtaccgttacggtaacggaacccgtaaccggaaccggtacccgttaacgtttaacttaccggtacggtaccgggacgtaacgggtaacgtttacgtttaacggtccggtaccgttaacggttcccgggttacccggttcgggttaaacccgtttaaccgggtaaaccccgttacgggtttaccggtttcggggtaacccggggttaaccccgggg

SEQ ID NO: 245823 - DNA, 516 bp, Homo sapiens
  misc_feature: GYAE6OF01DKCH9.42.49.E05.1.454.CMB.1.raw
  modified_base (412)..(412): a, c, t, g, unknown or other
  misc_feature (412)..(412): n is a, c, g, or t
  modified_base (428)..(428): a, c, t, g, unknown or other
  misc_feature (428)..(428): n is a, c, g, or t
  modified_base (501)..(501): a, c, t, g, unknown or other
  misc_feature (501)..(501): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccccggagagggggcttggagtggagtgggatggatcagaccttacggaactaaaacagagtatggagagagttccaggcagagtcatcatcacgcggacacactcacgagtacagacctanatgaactgagagcctnagatctgacgacacggccacttattactgcgcgagacgtattagtgacgactcggtccgtggtctacgtaacncgtctggtgggaccg

SEQ ID NO: 245824 - DNA, 619 bp, Homo sapiens
  misc_feature: GYAE6OF01DXIVR.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacacggcccccggaggaggggcttggagtggagtgggatgggatcagtcccttaacggaactaaaacgagacgtagtgggacgaggaagttccgagggtcagagcatcatcaccgcggacacataccgacgacgtacagacctaacatagggaactggaggagcccttacagtactcgtacgtaaccggacgaccgggtacctacctttaacgttacctacggtccgaccggtaaggacgtaagtttaacgttcggtacctaaccgttcgggttacccgtcgggtaccttacggttaaaccccgtaacggtccgtttcggggtcgggtaaccccggg

SEQ ID NO: 245825 - DNA, 600 bp, Homo sapiens
  misc_feature: GYAE6OF01DCS47.42.49.E05.1.454.CMB.1.raw
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacatcttttccacctacggtatgtaattggttgagacgacggccccccgggaggacgggggtcttggaggtgggagtgggatgggatcgacgacccgttaacggaaactaaaacgagaacgtagtaggagaagaagttccgagggcagagtcatcatcacgcgacacataccacgacgtacacgacctacagtcggaactggacggacgccctacgaacgtagtcgtacggaccgaaccgaccggtacccgtaactttacgttaccgtacggccggtacgaggtagtagtttagttcgactacgtcggtccgttggccgttacgtaaccgaccgttcttggtgggtacccg

SEQ ID NO: 245826 - DNA, 582 bp, Homo sapiens
  misc_feature: GYAE6OF01BNYVU.42.49.E05.1.454.CMB.1.raw
  modified_base (345)..(345): a, c, t, g, unknown or other
  misc_feature (345)..(345): n is a, c, g, or t
  modified_base (432)..(432): a, c, t, g, unknown or other
  misc_feature (432)..(432): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagtacaggccccccggagagggggcttgagtggatgggatggatcagcctacggaactaaaacngagtatggagagaagttccagggcagagtcatcatcaccgcggacacatccacgagtacacgctacatgggaactggacgagcctanagatctgaacgtacacggacccagttaacttactcggacgccggaggacgtaatttacgttacgaccgtaaccgttcgggttacccgttcgggtaccgttaccgggtaaacccgtaacccgggtcgttttcgggtcgggggtaaccccgg

SEQ ID NO: 245827 - DNA, 568 bp, Homo sapiens
  misc_feature: GYAE6OF01A8XMR.42.49.E05.1.454.CMB.1.raw
  modified_base (390)..(390): a, c, t, g, unknown or other
  misc_feature (390)..(390): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacaggcccccggaggaggggcttgagtggatgggatggatcgagcccttacggaactaaacgagagtatggagagaagtcagggcagagtcatcatcacgcggacanactccacgagtacagcctacagtacggaactggacggacgcctcgagactcgtacggaccgacgaccgggtacctaactttaattaccgtacgccgacgagtagtaatttacgttcggcctacgttcggtccgtgggacccttacggttaaccccacggtcgttgggtcgggtaccgg

SEQ ID NO: 245828 - DNA, 527 bp, Homo sapiens
  misc_feature: GYAE6OF01DV6YN.42.49.E05.1.454.CMB.1.raw
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatgggatgggatcagtcccttacggaactaaaacgagagtatggagagaagttcgaggcagagtcatcatcacgcgacacataccagatacagcctaacatggaactgaggagcctcagatctgacgtacgaccggctacttatactgcgacgagacgtattagtcgctacggttgccgtggtaccgtcgtaaacccgagtcgttggtgggtaccg

SEQ ID NO: 245829 - DNA, 638 bp, Homo sapiens
  misc_feature: GYAE6OF01D2SMV.42.49.E05.1.454.CMB.1.raw
  modified_base (486)..(486): a, c, t, g, unknown or other
  misc_feature (486)..(486): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccgtacggtatgtaattggttgagacgacgggcccccggtaggacggggtcttggaggtggtagtgggatgggatcgacgtcccgttaacggaactaaaacgagagtacgtaggaagagtaacgttcgagggtacaaggacgtacatacactacgacccggcggaaccacacctaccgacggtaacgtacacgacctagacgtaggaactggacggacgcctanagtatcgagaccgaccgaccgggtacctaacgtttattaccgtacggtccgacggtaacgtagtaatttgttacgaccgtaacgtttcggggtacccttgggtaccgttacgttaaaccccgacggttccgtttgggtccggggtaacccgg

SEQ ID NO: 245830 - DNA, 563 bp, Homo sapiens
  misc_feature: GYAE6OF01CAHRO.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacgacggtcccccggagagggggcttggaggtggagtgggatggatcagcccttacggaactaaacgagagtatggagagaagttcaggcagagtcatcatcaccgcggaacacactaccgacgacgtacagtcctaacatacggaactgacggacgccgtacgagtatcgtacgaacgtacacgggtccaacttactacgtgacgcgaagagtattagtcgactacgttcggtaccctgggtaccttacgtaaccgtacgtcgttgggtggtacccgg

SEQ ID NO: 245831 - DNA, 674 bp, Homo sapiens
  misc_feature: GYAE6OF01CPN3A.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgatggtctcctgcagtgcttcgtggtactatcttttccacctacggtatgtaattggttgagtacgacggcccccggaggacgggggcttggaggtgggagtgggatgggatcgacggtacccttaacgggaaactaaaaccgtagaaggttagtaggggaagtaaggtaacggttaccgaaggggactaagggtaagtccaagttaccgaactaccgacccggacgggaacccaacgtaacgtacccgaacggtaacgttaaccaacggtaaccctaacgagttaacgggaacgttacgggaacgggtacgtcccgtacgaagtacttacggtaacgaacccggaaccgtaaccgggtccctaacgtttacttacgtcgacgacggaagtagtagttacgtcgactacgttcggtcgtgctacgtaaccgcgttcgttggtcgggtaccgg

SEQ ID NO: 245832 - DNA, 547 bp, Homo sapiens
  misc_feature: GYAE6OF01DFHC4.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacatcttttccacctacggtatgaattggttgagacaggcccccggaggaggggcttggagtggagtgggatggatcagcccgttacggaactaaacagagtatggagagaagttcgaggcagagtcatcatcacgcgacacatccagagtacagcctaacataggaactgaacggagcctacgagactcgtgaacgacgaccggtaccactttacgttactcgcgacgtaggagtacttagttgacacgttcggtaccgtggtaccgtacggtaacccacgtcgttggcgggtaccgg

SEQ ID NO: 245833 - DNA, 709 bp, Homo sapiens
  misc_feature: GYAE6OF01B6H6M.42.49.E05.1.454.CMB.1.raw
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctgagtgatggtctccgtgcagtgtcttcgtgttactattctttccactaggtatagtagttggtgagcgacgggccccggaggagggtcttggagtggagtgggagtggactacgacgtacccgttaacggaaactaaaacgagtagtaagtaggaaggaaggtaacgtaccgaagggtacaaggaacgtacgtaacgtctaacgaccgaaccggaccggaaccaaccgatacccgaacggtacgtaccaacggacctaacgagtacggtaaacgtagggaacggactacccgtacgaagtaccttacgaccgaaccggacgtacccggtaccttaacgttaacgttacccgtaggacccggtaggtaaaggaccttaaaggtttagtttccggaacctttaccggttcgggtacccccggttaagggttacccgtttaacccggaaacccggttaccgggttccgtttggggggtcccgggtaaaccccggg

SEQ ID NO: 245834 - DNA, 587 bp, Homo sapiens
  misc_feature: GYAE6OF01CHG3F.42.49.E05.1.454.CMB.1.raw
  modified_base (430)..(430): a, c, t, g, unknown or other
  misc_feature (430)..(430): n is a, c, g, or t
  modified_base (460)..(460): a, c, t, g, unknown or other
  misc_feature (460)..(460): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacacggcccccggaggaggggcttgagtggatgggatggatcgagacccgttaacggaactaaaaacgagtagtataggaagagaagttccgagggcagagtcatcatcgacgcgaacacactaccaggtactacgacgtcctaanagtagggaaactggaaggcacctcgagtancctagacgaccgaccggtaccctactttaactaccgtggaccgacggtaagagtaattagttcgacctaacgttcgggtcccgtggacttacggtaaccctaccggtctttggggtcggtacccggg

SEQ ID NO: 245835 - DNA, 522 bp, Homo sapiens
  misc_feature: GYAE6OF01EN9UC.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccccggagaggggcttgagtggatgggatggatcagcccttacggaactaaaacagagtatggagagaagttcgaggcagagtcatcatcaccgcggacacatccacgagtacagcctacatggaactgaggagcctcagatctgacgacgacggtaccacttatactgcgcgagagtattagtcgactacgtcggtcctggcttacgtaacccacgcttggtgggtaccgg

SEQ ID NO: 245836 - DNA, 518 bp, Homo sapiens
  misc_feature: GYAE6OF01E3D3D.42.49.E05.1.454.CMB.1.raw
  modified_base (461)..(461): a, c, t, g, unknown or other
  misc_feature (461)..(461): n is a, c, g, or t
  modified_base (510)..(510): a, c, t, g, unknown or other
  misc_feature (510)..(510): n is a, c, g, or t
tcagtgacgtatgtcacgaccggtgctcgatttagagcgactagcaacacgcaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacagggccccccggagagggggcttgagtggatgggatggatcagcccttaacggaactaaaacagagtatggagagaagttcagggcagagtcatcatcaccgcggacacatccacgagtacagcctacatggaactggagagcctcagatctgaacgacacggtccacttattacngcgcgagagattatcgacacgtggtcctggctgtaacccacgtcttggngggtaccg

SEQ ID NO: 245837 - DNA, 562 bp, Homo sapiens
  misc_feature: GYAE6OF01DM071.42.49.E05.1.454.CMB.1.raw
tcagtgacgtatgtcacgaccggtgctcgatttagagcgactagcaacacacaaaggggacccaaaaaccacacccctccttgggagtaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggagtgggatggatcagcccttagaactaaacagagtatggagagaagttccaggcagagtcatcatcacgcgacacatccagagtacagcctacatggaactgacggagcctacagactcgtacgacgaccacgggtaccaacgtttattaacgtcgacgaccgaaggtagtaattacgttagccgtaacgtcggttcccgtaggtacgttacgtaaaccctacggttacgttgggtcgggtacccggg

SEQ ID NO: 245838 - DNA, 804 bp, Homo sapiens
  misc_feature: GYAE6OF01COO0E.42.49.E05.1.454.CMB.1.raw
  modified_base (368)..(368): a, c, t, g, unknown or other
  misc_feature (368)..(368): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatccttttccacctacggtatgtaattggttgagtacacgggcccccggagacgggggtctttggaggtggtagtgggaatgggatacgagtcccctttaacggaaacttaaaacgnggaagttaagtagggaagtaggtaaacgtttaccgaaggggaccaaggaacgttacaagttacgaacttaccgaacccggacgggaaccaaccgtaacgttaccccgaacggtaacggttaaccctaaacgggtaccctaaaccgtaacggtacggggtaaaacccttacggggaaacggggaaccgttacccgttaaccggaaacggtaccgtttaccggttaccggaaacccgggtacccgtaaaccccgggggaccctttaaaccgttttaacgttaacccgtgggtacccggtaacggtaaacggtacggttaaattttacggtttccggaacttaaccgggtttccgggttacccgttacgggttacccgttaacgggttaaacccccgttaacgggttccggttttaggggtccggggttaaaccccggg

SEQ ID NO: 245839 - DNA, 615 bp, Homo sapiens
  misc_feature: GYAE6OF01DXIDF.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacacggcccccggaggaggggcgttggaggtggagtgggatggatcgagaccccgttaacggaaactaaaacgagagtataggagagagttcgaggcagagcagtcatcacgcggacacatccagacgtacacgcctaacacgtacggaacgtcgaagggacgccgtacaagtactacgtacggacgaaccgacgggtaccctaacgtttaacgttacgtcgacggtaccggaagtacgtaagtttagttcggtaccgtaccgttgggttcccggttagggtaccgttaacggtaaccccgtacggtaccgtttgggtcggggtaacccggg

SEQ ID NO: 245840 - DNA, 576 bp, Homo sapiens
  misc_feature: GYAE6OF01DQ011.42.49.E05.1.454.CMB.1.raw
  modified_base (453)..(453): a, c, t, g, unknown or other
  misc_feature (453)..(453): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (533)..(533): a, c, t, g, unknown or other
  misc_feature (533)..(533): n is a, c, g, or t
  modified_base (557)..(557): a, c, t, g, unknown or other
  misc_feature (557)..(557): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacacgggccccccggaggagggggccttggaggtgggagtggggatgggatcgaggtacccgttacggaaactaaaacgagaagtagtggagaagaacgttccgagggtacagtacggtctagtcagtccgaaccggcgggacacactaccaacgacgtacagacctanagtacggaactggacggancctnagtatcgtagaccgacacggtcctaacttactactgcgacgagtagtattagtgacncttcggcgtcggacgttcgaaacncgtcgttggtgggtaccgg

SEQ ID NO: 245841 - DNA, 616 bp, Homo sapiens
  misc_feature: GYAE6OF01CVAGS.42.49.E05.1.454.CMB.1.raw
  modified_base (355)..(355): a, c, t, g, unknown or other
  misc_feature (355)..(355): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagccgtggggcctcagtgatggtctcctgcagtgcttctggttacattccttttccacctacggtatgtaattggttgagacacggcccccggaggaggggtcttggagtggagtgggatggatcagtacccttaaggaactaaaacgngaagtagtaggaagtaaggaacgttccgaagggcaaggtacgtcaatcatccgaccggtcggaacactactcccgaagacgtacacgtacctaacgagtacggaacgtggaaggacgtcctacgagtactcgtagaacccgacgaccggtacctaacgtttactacgtggccgtacggaagtacgtattagtcgacctacggttcggtacccgttggaccgttaccggtaaccctcggttacgttgggtcgggtaacccgg

SEQ ID NO: 245842 - DNA, 571 bp, Homo sapiens
  misc_feature: GYAE6OF01A42K3.42.49.E05.1.454.CMB.1.raw
  modified_base (561)..(561): a, c, t, g, unknown or other
  misc_feature (561)..(561): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagtacagggccccccggagagggggcttggagtggatgggatgggatcagacccttacggaactaaaacgagagtagtaggagagaagttcagggcagagtcatcatccacgcgacacatccgacgagtacagtcctacagtggaactggacgagacctacgaagacgtcaggaacgaccgaaccgggcctaaccgttaactttacgcggaccgacgaggtaagtattagttacgactacgtcgggttacctgggtacctacgtaaccctagcgtttgggnggggtacccg

SEQ ID NO: 245843 - DNA, 639 bp, Homo sapiens
  misc_feature: GYAE6OF01BMU9X.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacattcttttccacctacggtatgtaattggttgagacgtacgggccccccggaggacgggggccgttggaggtgggagtggggatgggatcgaggtacccgttaacggaaacctaaaacgacgagtagtaggagaagaacgttcgagggcaggagtcatcatcaccggcgaacacgactaccaacgacgttacacgacctaacgagtacggaaactagggacggtacgacccgtacgaacgtacgtcgacggaaccggaccgaccgggtacctaacgtttactacgtacgaccgtacggaagtagtaacgtttagtcgtaccgacggttcggtcccgtggtacccttacggtaacccctaggttccgttacgggtcgggtaacccggg

SEQ ID NO: 245844 - DNA, 639 bp, Homo sapiens
  misc_feature: GYAE6OF01ALHU1.42.49.E05.1.454.CMB.1.raw
  modified_base (540)..(540): a, c, t, g, unknown or other
  misc_feature (540)..(540): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtattgaatttcggttgagacgacgggtccccccgggaggacgggggtccttggagtgggagttggggaagttgggatacgacgtccccgttaacgggaaactaaaaacgagtaggtatgggaagagaacggttccagggtcaagtagtcaatcgatcgaccgcggacacataccacgagtaaccacgacctaacgagtacgggaactggaacggacgccgtacgaagacgttctacggacgaccgaccgggaccctaatttacttaccgngaccggcgaagtagtagtttaacgttccgactaccggtcggttacccgtggtaccttaacgggtaacccgtaccggtccgtttgggtcgggtaacccgg

SEQ ID NO: 245845 - DNA, 575 bp, Homo sapiens
  misc_feature: GYAE6OF01CGH25.42.49.E05.1.454.CMB.1.raw
  modified_base (419)..(419): a, c, t, g, unknown or other
  misc_feature (419)..(419): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaatttggttgagacaggcccccggaggaggggctttgagtggatgggatggatcagcccttaacggaactaaaacagagtataggagagaagttccagggcagagtcatcatcaccgcggacacataccacgagtacagccctaanatacgggaactggaacggacgccctagagattcgtacgtacgacgaaccgggcctaacgttattaccgtgacgcgaggtacgtaatttacgttcgactaacgtcggttcccgttaggccttacggtaaccctacggtacgttggtcgggtacccgg

SEQ ID NO: 245846 - DNA, 587 bp, Homo sapiens
  misc_feature: GYAE6OF01EC4XI.42.49.E05.1.454.CMB.1.raw
  modified_base (451)..(451): a, c, t, g, unknown or other
  misc_feature (451)..(451): n is a, c, g, or t
  modified_base (525)..(525): a, c, t, g, unknown or other
  misc_feature (525)..(525): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccccggagaggggcttggaggtggagtgggatggactcagacccttacggaactaaacgagagtatggagagaagtcgagggcagagtcatcatacaccgcgacacactaccgacgaagtaccaagcctaacgagtagggaactggaggtacgcctacganactcgtacgacgaccaaccgggacctaacgtttaacttacgtcggaccggtacgaaggagtaatttagttacgntaccgttcgggtccttcgggaccttacggttaaacccacggttccgttggtcggggtacccg

SEQ ID NO: 245847 - DNA, 550 bp, Homo sapiens
  misc_feature: GYAE6OF01AT7I8.42.49.E05.1.454.CMB.1.raw
  modified_base (244)..(244): a, c, t, g, unknown or other
  misc_feature (244)..(244): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttntggttacatctttccacctacggtatgaattggttgagacagggcccccggaggagggggcttgagtggagtgggatggatcagcccttacggaactaaaacagagtatggagagaagttcgagggcagagtcatcatcaccgcgacacatccacgagtacagcctacatgggaactggaggacgcctacagactcgtggaaccgacgaccgggtcctacttagtactgcgcgagacgtattagttcgacgtacgtcggttccgtgggtcctacggtaacccacggtccttgggtcgggtacccgg

SEQ ID NO: 245848 - DNA, 759 bp, Homo sapiens
  misc_feature: GYAE6OF01D9MQ3.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgtcttcgtggttacattcttttccacctacggtattgtaattggttagagacacgggcccccggaggacggggtcttggaggtggagtgggagtggatacgagtacccgttaacggaaactaaaacgagtacggtagtaggagaagtaacggttacgagggaccgaaggtaacgtactagtaccgtaagtccgaaccgggccgggaaccaaccgtacgttacccgaacggtaacgttaaccgacgtaccctaacgtacggtacggtaaacgtacgggaacggtacgaccctacgacgtacgttccgtaacggaacccgtaaccggtaccgggtaaccccttaacgtttaacgttaccggtacggacccggtaaccggttaaacggtacgttaaacgttttaacggttacggtaacccgttaccggtttccgggttacccggtttacggggaccccgtttaacggttaaacccccggttaccggttaccggttttccggggtccggggttaaaccccgggg

SEQ ID NO: 245849 - DNA, 591 bp, Homo sapiens
  misc_feature: GYAE6OF01CKD0X.42.49.E05.1.454.CMB.1.raw
  modified_base (363)..(363): a, c, t, g, unknown or other
  misc_feature (363)..(363): n is a, c, g, or t
  modified_base (447)..(447): a, c, t, g, unknown or other
  misc_feature (447)..(447): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttcgtggttacattccttttccactacggtatgtaagttggttgagtacgacgggcccccggaggacggggtcttggaggtggagtggggagttggatcgacgtcccttaaggaactaaaacngtagtagtggagagaggttccgagggcagtagtcatcagtacgaccgacgggacacgataccgacggactaacacgtcctaacngtacggaactaggacgacgacctacgagactcgtacgacgaccgacgccgtacttacgttacgtgcgacgagtagtattaagtcgccgtaacgttcggtccgtacggtacgtacggtaacccacgttcgttgggtcggtaccgg

SEQ ID NO: 245850 - DNA, 629 bp, Homo sapiens
  misc_feature: GYAE6OF01BDT1D.42.49.E05.1.454.CMB.1.raw
  modified_base (307)..(307): a, c, t, g, unknown or other
  misc_feature (307)..(307): n is a, c, g, or t
  modified_base (581)..(581): a, c, t, g, unknown or other
  misc_feature (581)..(581): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttcgtggttacattctttcctacctacggtatggtaattggttagagacgtacgggcccccggagnggggtcgttggaggtggagtggggactgggacgtcgacgtccccgttaaacggtaaacgtaaaacgaggtaagtagtacgggaagacggtaaggttaccgagggacaggagtactagtacgtacgtacgacccggtacgaaccgacaacgtaccgaacggtaacgtacgaacgccgtaacagtacggaactaggacggacgtaccgtgagtacgtcgtacgaacgaccgaccggtacctacgttatacgtacggcgacggtagtagtattacgngtctacggtcgtcgtacggctacgaccgtagtcgtggtcgggtaccgg

SEQ ID NO: 245851 - DNA, 695 bp, Homo sapiens
  misc_feature: GYAE6OF01D60YP.42.49.E05.1.454.CMB.1.raw
  modified_base (675)..(675): a, c, t, g, unknown or other
  misc_feature (675)..(675): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcgagtgagtggtctccgtgcaggtgtctttcgtacggttactatttccgttttaccaccgttacggtatgtaagtttgggttagacgtacgaccggcccccggtaggacggggtccttggaggtcggagtgggagtggactcgacgtacccgttaacggaaactaaacgaggtacgtaagtacgggaagtaacggtaacgttacggaacggggtactaacgggtaacgttaacgacgttaccgtaacgtacccgacccgggtaccgggaacctaccgtaacgtacccgaacgtaacgtaaccgacggtaccctacgaacggtacggaaccgtaggaacggtacgtaccctagacgtactccgtacggaaccgtaccgacggtacccttaacgttacttacgcgtacgagagtagtattagtgcctacgttcggtacgtcggtacgtacctaaccgnggttcctgggcggtaccggg

SEQ ID NO: 245852 - DNA, 607 bp, Homo sapiens
  misc_feature: GYAE6OF01A6QJF.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcagtgcttctggttacatcttttccaccttacggtatgtaattggttgagacaggcccccggaggaggggcttggaggtggagtgggatggatcgagtcccgttaacggaactaaaacgagagtatggagagagttcgagggcaggagtcatcatcgaccgcggacacgactccgacgtagacagacctagagtggaacgtggaggacgcctacagacgtcgtagaccgacgaccggtacctaacgtttactaccgtcggacggtaccgaggtaacgtagtttaacgtcgtaccgtacggttcgggttcccgttacgggtacgtttaccgggtaaaccctaccggttcgtttcggggtcgggtacccggg

SEQ ID NO: 245853 - DNA, 684 bp, Homo sapiens
  misc_feature: GYAE6OF01A8RW1.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacacggcccccggaggacgggggcttggagtggagtgggagtggatcgacgtacccgttaacggaactaaaacgagagtagtggaagagaagttaccgagggcaggagtcatcatcgaccgcggacacacgtaccaagacgtaacacgtaccctaacgagtacggaacgtaggaacgggacgtacccgtacgaagtacttaccgtacggaaccggaacccgaacccgggtacccttaaccgttttaacgttaccgttacggacccggtacggtaacggaacgttaacgtttaacgtttaccggtacgtaacccggtttacggggttaccccttcggggtacccgtttaacggttaaaccccgtacccgggttcccgttttcggggtacggggtaccccgg

SEQ ID NO: 245854 - DNA, 723 bp, Homo sapiens
  misc_feature: GYAE6OF01D34EG.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctcagtgatggtctcctgcagtgctttcgtggttacattcttttccaccgttacggtattgtaagtttggttgacgtacgacgggcccccgggaggacggggtcttaggaggttgggagtgggagtgggactacgacggtacccgttaacggaaactaaaacgaggaagtagtaggaagaggtaagttaccgagggacaaggagtacaagttcacgtaccgacccggtacggaacacgtactaccgaaccggaagttaaccaacggtaccctaacgaacgtacggaacgttaggaacggacgccctacgacgtactccgtaaggaaccgtaaccgaccgggtaccctaacgtttaaccgttaccgtagggacccgtacgggaagttacgtaaacgttttagttccggtacgtaaaccggttccgggttacccgtaccggggttacccgttaacgggttaaaccccgttacgggttaccggttttcggggaccggggttaaccccgggg

SEQ ID NO: 245855 - DNA, 585 bp, Homo sapiens
  misc_feature: GYAE6OF01CDDF6.42.49.E05.1.454.CMB.1.raw
  modified_base (425)..(425): a, c, t, g, unknown or other
  misc_feature (425)..(425): n is a, c, g, or t
  modified_base (464)..(464): a, c, t, g, unknown or other
  misc_feature (464)..(464): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtatgtaattggttgagaccgacggcccccggaggagggggtcttggaggtggagtgggatggactcgacgtacccgttaacggaaactaaaacgaggtaagtagtaggaagtaaggaagttaccgagggacagagtcatcatcaccgcgacacanccaagacgtacacgacctagagtaggaactggaggtacncgtcagacgtagtcgaacgaccgacgtcctaacttacgttacgcgacgtacgaaggagtacttagttgcctaagtcggtcctacgggtcttaccggtaactacgtcggttggcgggtaccg

SEQ ID NO: 245856 - DNA, 769 bp, Homo sapiens
  misc_feature: GYAE6OF01CEYPT.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctctgctagtgcttcgttggtactacttccttttccaccgttacggtatacggttaatttgggttgaacggtaccgaccggggcccccgggagggtacggggtcctttagggaggtgggagtggggagtggtactcgaaccggtaccccgttaaacggaaacctaaaacgaggtaacgtaagtacgggtaaagtaagggtaacgttaccggaagggtaccgaaggtaacgtacgtaactaccggtaactacccggtaacccgggaccggaaccaaccgtacgtaccccggaacggtaaacgtacccgaacgtaccctaaactaggtaacgggtaacgtcgggaaacggcctaaccgtacgtaacgtaccgtcgtaaccggaaccgacccggtaaaccggttcccttaaacgttttaacgttacggaccggtacggaacgtacggtaagttaactttacggtccgaccgttacggttccggttacgtcgggtacccttaacggtaacccctgggttacgttggggtaccgggtacccggg

SEQ ID NO: 245857 - DNA, 573 bp, Homo sapiens
  misc_feature: GYAE6OF01EA7AX.42.49.E05.1.454.CMB.1.raw
  modified_base (359)..(359): a, c, t, g, unknown or other
  misc_feature (359)..(359): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacacggccccccggaggaggggcttggaggtgggatggggatggatcgagcccttaacggaactaaaacagagtanaggagagaagttccgagggcagagtcatcatcaccggcgacacatcccgagacgtacacgacctacagtggaactggagacgcctacagactctagaccgacgaccggtacctacttacttacgcgcgacgagacgtaatttacgttcgacgtcgtcgggtccctagggtacccttacggttaaccccacggttccgttgggtcgggtacccgg

SEQ ID NO: 245858 - DNA, 601 bp, Homo sapiens
  misc_feature: GYAE6OF01DDNUH.42.49.E05.1.454.CMB.1.raw
  modified_base (584)..(584): a, c, t, g, unknown or other
  misc_feature (584)..(584): n is a, c, g, or t
tcagtgacgtatgtcacgaccggtgctcgatttagagcgactagcaacacacaaaggggacccaaaaccacacccctccttgggagaatccctagatcacagctcctcaccatggacgggacctggagcatccttttctggtggcagcagcaacaggtgcccactcccaggttcacctggtgcagtctggagctgagctgcagaagcctggggcctcagtgatggtctcctgcagtgcttctggtacattcttttccacctacggtatgtaagttggttgagtacacgggcccccggaggaggggtcttggacggtggaggtgggatggactcgacgtaccccgttaacggaaacttaaaacgaggtaagtacgtaggaggaagtacggttaccgagggtacaggtagtcgtaagtcgactccgtaaccggcggtaacacgactacccacggaacgtacgaacgtacctaacgtagtacgggtaactagggaacgacgtccagacgtactcgtcgacgacgtaccgctacttatacgtgacgtcgagatagttagtcgctaggtcgtccgtgtcgtacgtaccngtacgtgtcgggtaccg

SEQ ID NO: 245859 - DNA, 536 bp, Homo sapiens
  misc_feature: GYAE6OF01DVWX4.42.49.E05.1.454.CMB.1.raw
  modified_base (491)..(491): a, c, t, g, unknown or other
  misc_feature (491)..(491): n is a, c, g, or t
  modified_base (520)..(520): a, c, t, g, unknown or other
  misc_feature (520)..(520): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggaggtggagtggggatgggatcgagcccttaacggaactaaaacagaagtagtggagaagaagttccagggcagagtcatcatcaccgcggacacactccacgagtacagacctacataggaactggacggagcctcaggtatcgtagacgacgaccgggccaactttatactgcgcgagagtnttagtcgcacgtggtcctggctgtaaccngtcgttgtgggtaccg

SEQ ID NO: 245860 - DNA, 630 bp, Homo sapiens
  misc_feature: GYAE6OF01DN7SI.42.49.E05.1.454.CMB.1.raw
  modified_base (241)..(241): a, c, t, g, unknown or other
  misc_feature (241)..(241): n is a, c, g, or t
tcagtgacgtatgtcacgaccggtgctcgatttagagcgactagcaacacgacaaaggggacccaaaaccacacccctccttgggagaatcccctagatcacagctcctcaccatggacgggacctggagcatcctttcttggtggcagcagcaacaggtgcccactcccaggttcacctggtgcagtctggagctggagctgcagaagcctggggcctcgagtgatggtctcctgcagtncttctgttacatcttttccacctacggtatgtaattgttgagtacgaggccccccggtagacggggtcgtggaggtggagtgggatgggatcagtacccgttacggaaactaaacgagaagtagtaggagaagaagttccggaggtacgaggagtcgattcacgtcaccgcgggaaccaacactacccgaacgaacgtaacacgtacctaacagtaggaactaggagacgcctacgagtaatcgtaaggaccgaaccgtaccgggtacctaacgtttaacttacgtcgtaccggacgaaggtagtagtttagtacgtacgtactttccgggtaccttaggggtaccttacggtaaacccgtaccgtacgtttcggggtcggtacccggg

SEQ ID NO: 245861 - DNA, 751 bp, Homo sapiens
  misc_feature: GYAE6OF01DU9QL.42.49.E05.1.454.CMB.1.raw
  modified_base (566)..(566): a, c, t, g, unknown or other
  misc_feature (566)..(566): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcgagtgagtggtcctcgtgctaggtcgcgtttcgtggttactacgtttccttttacccaaccgttaccggttatacggttaagtttcggttaggacgacggtaccgggcccccgggaagggtacgggggtcctttagggtagggtgggtaacggtaggggtagttcgggaacgttccggtaaccggttaccccggttaaaacgggtaaaacctaaaaccggtaggtaaacgttaggtacgggaacgggtaacggtaacggtttaccggacgggtacaggtacgtacacgtacgacgtaccgaccggaccgaacactaacgtccgaacgtacgaaccagtacccgtanaaggtaccggacgtgggaaccggagtacccgtacgaagtactcgtaaccggaccgtacgacccggtacttaacgttacgtacgtcgacgtacggtagtagtacgttacgtcggacgttaccggtcgggttcccgtaggtacccgttaacgggtacccacgggttccgtttgggccggtacccggg

SEQ ID NO: 245862 - DNA, 614 bp, Homo sapiens
  misc_feature: GYAE6OF01DV90K.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatcgtaattggttgagacacggcccccgggagagggggcttgaggtggagtgggagtggatcgagtacccgttacggaaactaaaacagacgttagtaggagaaggacgttacgagggctagagtcatcatcaccgcgacacactaccacgagtacacgacctacacgttaggaaccgttagacggacgaccctacgagacgtcgtaacgacccgaacgaaccgggtaccctaacgtttaactaccgtcggccgtacgaagtagtaactttagtcggtacctacgttcgggtcccgtgggaccttacggtaaaccctacggttaccgttggtcggggtaacccgg

SEQ ID NO: 245863 - DNA, 681 bp, Homo sapiens
  misc_feature: GYAE6OF01AFOGO.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtctggagctgagctgcagagccgtggggcctcgagtgatggtcctcctgctagtcgtcttcgtcggttacattccttttccaccgtacggtatgtaagttggttgacgacgccggacccccggaggacggggtcttggacgtggtagtgggtagtgggtatccgacgtaccccggttaaacggaaactaaaacgagtagtaaggtaggaaggtagtaacggttacgacgggtcgaaggtacgtacagtactacgtaccgaccgtacgaccacgactaccgaacgtacgaaccgtacgtacctaacgacggtaacggtacgtaggacggacgtacctagacgtacgtacgtacggaaccgtaccgaacccgtaccttaacgttactacgttcgaccggtaacgagtaaacgtattacgttacgtaccgtacggttccggtacgttacggtaccgttaaccgaccgtaacgtcgttgggtcccggtaacccggg

SEQ ID NO: 245864 - DNA, 627 bp, Homo sapiens
  misc_feature: GYAE6OF01DRTBV.42.49.E05.1.454.CMB.1.raw
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagtacacggcccccggaggaggggcttggaggtggagtagggatgggatcgacgtaccttaacggaaactaaacgagagtagtggagagaagttccgaggacaggagtcatcatcgacgcggacacataccacgagtacacgacctacagtacggaactggacggacgccctacgaagtactacgtacgaaccgaacgaccgggacccttaacgttacttacgtcggacggtaccgaaggaacgtagtttaacgttacggtacctaccggtttcgggtcccgttacgggtaccgttaccggttaaacccgtaccggttccggttagggtttcggggaaaccccggg

SEQ ID NO: 245865 - DNA, 664 bp, Homo sapiens
  misc_feature: GYAE6OF01CH93T.42.49.E05.1.454.CMB.1.raw
  modified_base (222)..(222): a, c, t, g, unknown or other
  misc_feature (222)..(222): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttttcttggtggcagcagcaacaggtgcccactcccaggttcacctggtgcagtctggagctgagctgcagaagccgtggggcctnagtgatggtctcctgcagtgcttcgtggttacattcttttccaccgtacggtatagtaattggttagagacgacggccccggtaggaggggtcttaggagtggagtgggagttggatacgacgtacccgttaacggaaactaaaacgagtaagtagtaggagtaggaacgttaccgagggacgtaggagtacgtactacacgacgaccgggacgaacaaccgtactaccgaaccgtaacgttaacgaccgtaccgttaacgaaggtaccggtaacgtagggaacggacgtacccctagacgtactcgtacgaccgacgtaccggtactacgttaactacgtcgacgtaggtaacagttaagttacgttcggattacgggttccgttaccggtcggtacccttacggtaacccttacggttcgttagggtccgggtacccggg

SEQ ID NO: 245866 - DNA, 545 bp, Homo sapiens
  misc_feature: GYAE6OF01BFVOZ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacgacggccccccggaggacgggggcttcggaggtggagtggggatgggatcgagcccttacggaactaaacagagtagtggagagaagttccaggcagagtacatcatcacgcgacacactccagagtacagcctacatgaactgagacgcctcagactcgtcgaacgtacgaccggacctaacttataccgtgccgcgagagtagttacgtgactacgtgtccgtggtacctcgtaaccagtccgttggtcgggtaccgg

SEQ ID NO: 245867 - DNA, 666 bp, Homo sapiens
  misc_feature: GYAE6OF01BN4XK.42.49.E05.1.454.CMB.1.raw
  modified_base (639)..(639): a, c, t, g, unknown or other
  misc_feature (639)..(639): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggtgagacgacggcccccggtaggagggggtcttggaggtggagtggggatgggatcgacgtacccgttaacggaaactaaaacgagtacgtagtcgggaagtaaggtaacgttccgagggacgtaaggacggtactatacaacgtccgaaccggtacggaccacgaactacccgaacggaacgtaaccacgacctaacgagtacggaacgttggaacggacgtacctcgagactcgtacggaaccgtaccgacccggtacctaactttacgttaacgtcgaccggacggtaacgtagttaagtttagttcggtactaccggttcgggttcccgtagggttaccgttacggttaaacccgnggttacgtttcgggtgggtaacccggg

SEQ ID NO: 245868 - DNA, 710 bp, Homo sapiens
  misc_feature: GYAE6OF01EK6BK.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagacgcctggggcctcagtgatggtctcctgcagtgcttcgtggttactattctttaccaccgttacggtatgtaatttggtagacgacgacgggcccccggaggacggggtcgttggaggtggagtgggatggatcgacgtacccgttaacggaaactaaaacgaggtaagtacgtagggaagagtaacggttccgagggactaggacgtacatcgagtaccgacggacggaacacactaccgaaggactacgacgtacctagacgtacggacgtaggacggtacgtacccgtacgtacgacgttacgtacggaccggaaccgaccgggtaccttaacgtttaacgttaccggtacggaccgtaacgggtaacggttaacgttaacgttttaccggttcggtaccgttacccgggttcgggttaccccgttacgggttacccgtttaaccggttaaaccccgtaccgggtttaccgttttcgggggtacccgggttaacccgggg

SEQ ID NO: 245869 - DNA, 705 bp, Homo sapiens
  misc_feature: GYAE6OF01DGOQQ.42.49.E05.1.454.CMB.1.raw
tcagtgacgtatgtcacgaccggtgctcgatttagagcgactagcaacacacaaagggacccaaaaccacacccctccttgggagaatcccctagatcacagctcctcaccatggacgggacctggagcattccttttcttggtggcagcagcaacaggtgcccactcccaggttcaccgtggtgcagtctggagctgagctgcgagagccgtgggcctgagtgagtggtctcctgcgtgtgtcgttcgttggttaactctttccttttaccctaccgtaaggttataggttaagttggttagagtacccggacgggacccccgggaaggtaggggtccttaggtaaggtgggtagtaggggtagtagggtactacgacggtacccgttaaacggaaactaaaacgtaagtaaggtaagtagggaaaggtaacggaacgttaccggaagggacgaaggagttaccagtacgtaacgtaccgaccgggacggtaacacggtaactaccgaacgtacgtaacgacgtaccgtagtaacgacgggtaactaggaacggacctacgtacgtaagacgtacgtacgaaccgtacgaccgtacctaacttagttaccgtcgacgtacgacggtatacgtttagcgtacgtacgttcggttaccgtgggttactacgggtaaaccctggtcgtttcgggtgggtaaccccgg

SEQ ID NO: 245870 - DNA, 652 bp, Homo sapiens
  misc_feature: GYAE6OF01C61KW.42.49.E05.1.454.CMB.1.raw
  modified_base (549)..(549): a, c, t, g, unknown or other
  misc_feature (549)..(549): n is a, c, g, or t
  modified_base (556)..(556): a, c, t, g, unknown or other
  misc_feature (556)..(556): n is a, c, g, or t
  modified_base (564)..(564): a, c, t, g, unknown or other
  misc_feature (564)..(564): n is a, c, g, or t
  modified_base (627)..(627): a, c, t, g, unknown or other
  misc_feature (627)..(627): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcgagtgatggtctccgtgcagtcgctttcgtggttactattccttttaccaccgttacggttatagtaagtttggttagagacgacggtcccccggaggtaggggtcttaggaggtggagtgggagtggatcgacgtaccgttaaggaaactaaacgacgagtagtaggaagaagtaacgttccgaaggacaggtaacgtcagtcaatacgaccgcggacaactactaccgaacgtaactaacgacgtaccaagtagtacggaacgtagacgggactacctacgagactacggtacgaacgaccggaacggtacctaacgttagtttaccngggaccncgggtaanacggttatttaacgtcgtaactacggttcggttacccgtaggttaccctacggttaaacccgnggtttaccgtggtcgggtaacccgg

SEQ ID NO: 245871 - DNA, 608 bp, Homo sapiens
  misc_feature: GYAE6OF01EQG8T.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtatgaattggttgagacacggcccccggaggaggggtcttgaggtggagtgggatgggatcgacgtcccgttaacggaaacctaaaacgagagtatggagagaagttccgagggcagatacatcatcgaccgcggaacacactccaacgtacgtacacgcctaacacgtaggaactggaggacgcccttagacgtatacgtggtaaccgaaccgaccggacctaactttaacgttactcggacgaccggtaaggtacgtaatttacggttcgaccttaacgtcgggttccgttgggaccttacggtaacccgtacggtcgtttgggcgggtacccggg

SEQ ID NO: 245872 - DNA, 634 bp, Homo sapiens
  misc_feature: GYAE6OF01B1425.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctccgtgcagtgtcttcgtggttactattccttttaccaccgttacggtatggtaatttggttgaggacgacgggtcccccggaggacgggggtcttggaggtggagtgggagtggatcgacgtacccgttaacggaaactaaaacgaggagtagtaggaagaaggtaacgttcgagggtacagtagtacatcataccgaccgcgaacacgatccgaagtacgtacacgacctaacagtacggaacgtggaacggacgccgtacgagtactcgtaacggaccgaaccgaccggtacctaactttacgtaacgtcggaccgacggaagtagtaattacgtcgacgttacggttcggttaccgtcggtaccgttacgtaaccgagttcggttagggcgggtacccgg

SEQ ID NO: 245873 - DNA, 562 bp, Homo sapiens
  misc_feature: GYAE6OF01BU1UJ.42.49.E05.1.454.CMB.1.raw
  modified_base (453)..(453): a, c, t, g, unknown or other
  misc_feature (453)..(453): n is a, c, g, or t
  modified_base (554)..(554): a, c, t, g, unknown or other
  misc_feature (554)..(554): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacgacgggcccccggaggacggggtcttggaggtggagtgggagtggatcgacgtcccttaacggaaactaaaacgagagtagtggagagaagttcgagggcagagtcatcatcacgcggacacactccacgagtacacgcctagagtcgaactggaggcgcctcgagntctacgaccgacgacggtacctacgttacgttacgcgaccgacgagtagtagttagtcgactacgttcggtccctggccttacggtaaccacgtcgttggnggtaccgg

SEQ ID NO: 245874 - DNA, 700 bp, Homo sapiens
  misc_feature: GYAE6OF01EWB9F.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacattcttttccaccttacggtactgtaattggttgagacgacgggcccccggaggacgggggtcttggaggtcggagtgggagtggatcgacgtacccgttaacggaaactaaaacgagtagtaagtaggaaggaggtaacgttacgagggacaggagtacatacactaccgaccggacggaacaccgtactacccgacgacgtacacgtacctacgacgtacggaacgtggaacggtacgacccgtacgaacggtacttacgtacggaaccggaaccgaaccgggtaccctaacgttttacgttaaccgtcggtaccggtacggtaacggtaacgtaacgttttaacgttacggtaccggttaacggttccgggttacccgttacgggtaccgtttaacggttaaaccccgtaacgggtttcccggtttgggttccggggtaacccgggg

SEQ ID NO: 245875 - DNA, 705 bp, Homo sapiens
  misc_feature: GYAE6OF01EEN6F.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttcgtggttacattcttttccaccttacggtatgtaattggtgagacgacggcccccggagaggggtcttggaggtggagtgggatggactcgacgtacccgttaacggaaactaaaacgaggtaaggtaagtagggaaggaacggtaacggttaccggaagggtacgaaggtacgtacgaagttcaacgtccgaaccggaccggaacacctacgtaccgaacggtaacgtaacacgtacctaacgacggtacggaacgtggaacggacgtaccctacgaagtacgtacgtacgaaccgaaccgaaccgggtacccttaacgtttaacttaccgtacggaccgacggtaagtaacgttaactttaacgttcggtaccgtaaccggtttcgggtacccgttcgggtaccgtttaaccggtaaaccccgttaccggttacggtttcggggtcgggtaaccccggg

SEQ ID NO: 245876 - DNA, 535 bp, Homo sapiens
  misc_feature: GYAE6OF01CXOBX.42.49.E05.1.454.CMB.1.raw
  modified_base (520)..(520): a, c, t, g, unknown or other
  misc_feature (520)..(520): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacaggcccccggagagggggcttggagtggatgggatggatcgagcccttacggaactaaaacagagtatggagagaagttccgaggcagagtcgatcatcgacgcggaacacataccacgagtacagacctaacagtggaactggaaggacgcctacgagatcgtagaccgacgacggcctacttattactgcgacgagagtattagtgctagttcggtcctggcttcgtaaccngtcgttgcggtacgg

SEQ ID NO: 245877 - DNA, 589 bp, Homo sapiens
  misc_feature: GYAE6OF01EAUJ2.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacagggcccccggaggagggggtcttggaggtggagtggggatgggatcgacgcccgttaacggaaactaaaacgagagtagtggagaagaacgttcgagggcagagtcatcatcaccgcggacacactaccacgagtaacagacctacagtacggaacgtgacggagcctcaagatacgtacgacggacgaccgggtacctaacgtttacttacgtcgacggacgaaggagtaattagttcgtactacgttcggttcccgtgggtaccgttacgtaacccaggtccgttgggtcgggtaccgg

SEQ ID NO: 245878 - DNA, 580 bp, Homo sapiens
  misc_feature: GYAE6OF01AISK3.42.49.E05.1.454.CMB.1.raw
  modified_base (349)..(349): a, c, t, g, unknown or other
  misc_feature (349)..(349): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacacggcccccggaggagggggcttgagtggagtggggatggatcagcccttacggaactaaacngagtatggagagaagttccgaggcagagtcatcatccgaccgcggacacgactccgaacgtacgtaccgacgaccctaacgtacgtacgggtaactgggaacggtacgacccgtacgacgtactcgtacggaaccgaccgaccggtaccctaacgtttactacgtcgacgacggagtagtattagtgactacgtcggtccgtggctacgtaccagtcttgggcggtaccgg

SEQ ID NO: 245879 - DNA, 562 bp, Homo sapiens
  misc_feature: GYAE6OF01AO4G9.42.49.E05.1.454.CMB.1.raw
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactccccaggttcacctggtgcagtctggagctgagctgcagaagcctggggcctcagtgatggtctcctgcagtgcttctggttacagtcttttccacctacggtatgaattggttgagacaggcccccggagaggggctttgagtggatgggatggatcagccttacggaactaaacagagtagtggagagacgttcgaggtcagagtcatcatcaccgtcgaacgtacatccgacgaggtaccaggtaccctanagtagaacgtagaggacnccgtacagtatcacggacgaccgacggacctaactttactacgtcgcgacgagtacgtgttaacgtggaccagttcgggtccctgggtaccttgaacccctaggtccttgggtcgggtacccg

SEQ ID NO: 245880 - DNA, 659 bp, Homo sapiens
  misc_feature: GYAE6OF01C0PVZ.42.49.E05.1.454.CMB.1.raw
  modified_base (218)..(218): a, c, t, g, unknown or other
  misc_feature (218)..(218): n is a, c, g, or t
  modified_base (508)..(508): a, c, t, g, unknown or other
  misc_feature (508)..(508): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcgtgggcctnagtgatggtctctgcagtgcttcgtggttacattcttttaccaccttacggtatagtaagttggttgagacgacggcccccggtaggacgggtcttggagtggagtgggagtggactacgacgtacccgttaacggaaacgtaaaacgagaagttagtaggaagtaaggtaacgttaccggaagggtacaggtaagtacaactacgaacgtaccgaaccgggacgaccgtaacacgtacccgaagaacgttaacgacgtaaccgtacaaggttacgaacgtggacggacnccgtagacgtatacgtagaaccgacgaaccggtactaaccgtttacttaaccgcgacgtaacgacgtaagttaattcgtacggactaccggttcggtaccgttcggtacttacgggtaaaccctggttaccggttggtaccgggtacccgg

SEQ ID NO: 245881 - DNA, 646 bp, Homo sapiens
  misc_feature: GYAE6OF01D6S5I.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactattccttttcccacctacggtatgtaagttggttgagacgacggcccccgggaggacgggggtcttggaggtggagtgggagtggatcgacgtaccgttacggaaactaaaacgagagtagtggagagaacgtacgaggcagagtcatacatcaccggcggacaacactacccgaacgacggtaacacgacctaacgagtacggaacgtaggacggtacgtccgtagacgtactacgtcggaaccggaaccgtacccgggtacctaacctttacttaaccgtggaccggacggtaaggtacgttaagttttacgtaccggtacctaccggttcggttacccgtgggtaccttaccggtaaacccgtacggtaccgttgggtacgggtacccggg

SEQ ID NO: 245882 - DNA, 665 bp, Homo sapiens
  misc_feature: GYAE6OF01BTMO5.42.49.E05.1.454.CMB.1.raw
  modified_base (654)..(654): a, c, t, g, unknown or other
  misc_feature (654)..(654): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttctggtggcagcagcaacaggtgcccactcccaggttcacctggtgcagtctggagctgagctgcagaagccgtgggcctcagtgatggtctcctgcagtgcttcgtggtactattctttccacttacggtatgtaattggttgagacgtaccggcccccggaggacgggtcgttagaggtggagtgggagtggatcgacgtacccgttaacggaaaacgtaaaacgagtaaggtagtaggaagtaaggtaaacggttcgaagggacctaaggacgtacgagtacacgtaccgaaccggtaccggaacaccgtaactacccgaacgtaagtaaccgaacgtaccctaacgacgttaacggaacgttagggaacggtacgaccgtagaacgtactacgtacgtaaccgaaccgtaccggtaccttaacttaacgtactacggaccgagaaggtattaacgtttagtacgacgtacggtcggtccgtaggtcttaaccggtaaccgtacgtcgtttggngggtaacccgg

SEQ ID NO: 245883 - DNA, 742 bp, Homo sapiens
  misc_feature: GYAE6OF01A3S28.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtgacagcagcaacaggtgcccactcccaggttcacctggtgcagtctggagctgagctgcagaagcctggggcctcagtgatggtctcctgcagtgcttctggttacattctttccactacggtatgtaattggttgagacgacgggcccccggaggaggggcgttggaggtggagtgggatgggatcgagtacccgttaacggaaactaaaaacgaggtaacggtaaggttagggaacggtaaggtaaacggtttaccggaacggggtacaaggtaacgtacgagttaccgaacgttaccgaaccccgggtaccgggaacctaaccgaaccgttaccccgaacggtaacggttaaacccgtaaccggtaacccttaaacccgtaaggttaaccgggaaaaccggttacgggaaacgggtaccggtaccctacgaacggtaactacggtacgaaccggaaccgaccgggtaacccttaacgtttaacgttaccgtacggacggacgtaaggaacgttagtttacgttcgacctaccggttcgggttcccgttaggtcgttaacggtaacccgtacggttcgttgggtcgggtacccgg

SEQ ID NO: 245884 - DNA, 616 bp, Homo sapiens
  misc_feature: GYAE6OF01BGLTI.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcgagtgatggtcctccgtgctagtcgcttctggttacattccttttccaccgttacgtatgtaagtttggttagagtaccgacgggccccccggaggtacgggggtccttggaagtgggtagtggggagtggaattcgacgtacccgttaacggaaactaaaacgaggaagtagtaggaagtaggaacgttaccgagggcaagacgtacactacacgtcgaccggacggactaaccgactaccgagagtaaccgagacctacagtacgaaccgtaggacggacgtccgtagtagactacgtacgacgaccgacgtaccctattacgtactcgacgagtagagtaattgtcgcgtacgtcggttactcggctacgtactacgtcgttggcggggtacg

SEQ ID NO: 245885 - DNA, 726 bp, Homo sapiens
  misc_feature: GYAE6OF01CY1BP.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtctggagctgagctgcagaacgccgtggggcctgagtgatggtctcctgctagtgtcttgtggttactacttccttttccaccgtacggttataggtaacttgggttagagaccgacgggacccccggaggtacggggtcttggaggtggagtgggagtggacgtcgacgtacccgttaacggaaacttaaaacgagtagtaagtaggaagtagtaacgttaccgaggacgagtagtacagtacataccgacgacggacacacgtaccaaggacgtaacacggtaaccctagaagtaacggtacgtacggaaggtaccgtccctacgtaacggtaccttaccggtaacggaaccgtaacccggaaaccccgggttccttaaaacccgtttacgtttaaccggacggaaccggtaacgggtaacgtaaacggttaacttacggtttacgaccgttacgggtttaccggtcccggttacgggttaaccgttaacggttaaaccccgacggtttcgggttaggggtccgggtaccccggg

SEQ ID NO: 245886 - DNA, 658 bp, Homo sapiens
  misc_feature: GYAE6OF01AS0WQ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctgttacattctttccacgtacgtatgtaattggttgagacgacgggcccccggaggtagggggcttggacggtggaggtgggagtggatcgacgtacccgttaacggaaactaaaacgagtagtagtaggaagaggaagttccgaagggtcgaagagtacagtacacgtccgaaccggtcggaacacgacttacccgaacggtacgtaacccgagtacccgttaacaagttcgggaaactgggaacgacgcctacgagactacgtcgaacggaccgacgggtacctaaccgtttacttaccgcgtaccggacggtaacgagttacttaacgttcggacccgttaacggtcggttacccgtacggtaacgttacccggttaaccgtacgtccggtttagggtcgggtacccggg

SEQ ID NO: 245887 - DNA, 758 bp, Homo sapiens
  misc_feature: GYAE6OF01ALOBN.42.49.E05.1.454.CMB.1.raw
  modified_base (244)..(244): a, c, t, g, unknown or other
  misc_feature (244)..(244): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttntggttacattctttccacctacggtatgtaattggtgagacgacggcccccggaggagggggcttggaggtggagtgggagtggatctacggcccgttaacggaaacttaaaacgaggtaacgtaagtaggggaagtaaggtaaacggttaccgaggggacgaacggtagtaccgtagtaccgaacgttacccgaaccggtccgggaacccaacaaccgttccccgaacggtaaaccggtaaccaaccggacccttaaccgtaacgttacggggaaaccttacgggaacggggtaccgtacccgttacgaacggtaacgttaccgttacggaaacccggaacccggtaacccggggtacccttaaccgttttaacgttaaccgtccggtaccggaccgggtaagaaacggttaactttaacgtttcggaccgttaacggttcgggttaccccgtgggttacccgttaaccggttaaaccccgaccggttacggtttgggtcggggttaacccgg

SEQ ID NO: 245888 - DNA, 667 bp, Homo sapiens
  misc_feature: GYAE6OF01CLYI9.42.49.E05.1.454.CMB.1.raw
  modified_base (218)..(218): a, c, t, g, unknown or other
  misc_feature (218)..(218): n is a, c, g, or t
  modified_base (252)..(252): a, c, t, g, unknown or other
  misc_feature (252)..(252): n is a, c, g, or t
tcagtgacgtatgtcacgaccggtgctcgatttagagcgactagcaacacacaaaggggacccaaaaccacacccctccttgggagaatccctagatcacagctcctcaccatggacgggacctggagcatccttttcttggtggcagcagcaacaggtgcccactcccaggttcacctggtgcagtctggagctgagctgcagagccgtggggcctnagtgatggtctcctgcagtgcttctggttaactnttcctttaccacttacggtatagtagttggtgacgacgacgggccccggtaggacggggtcttggaggtggtagtgggagtggatcgacgtaccgttaacgaaacgttaaaacgagtaagtagtaggtaagagtaacgtacgaggcaagagtacagtacacgtacgaccggacgaacaacgtacgtaccgaacgaacgtacgaacgacccttaacgagtaacggaacgtggaaacggtacgaccgtacgaaggtaacctacgtacgaaccgaaccgaccggtaccgttaactttaacgttacgtacgacggtaacgtaaggtacgttacttaggttccgacgtaaccggttcggtacccgttacgggaccgtttaacggaaccccgtcgggttcgttcggggtcggtaacccggg

SEQ ID NO: 245889 - DNA, 629 bp, Homo sapiens
  misc_feature: GYAE6OF01EP9PB.42.49.E05.1.454.CMB.1.raw
  modified_base (244)..(244): a, c, t, g, unknown or other
  misc_feature (244)..(244): n is a, c, g, or t
  modified_base (473)..(473): a, c, t, g, unknown or other
  misc_feature (473)..(473): n is a, c, g, or t
  modified_base (529)..(529): a, c, t, g, unknown or other
  misc_feature (529)..(529): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttntggttacatctttccactacggtatgtaattggttgagtacacggcccccggaggacggggcttggaggtggagtgggatggatcgacgtaccttaacggaaactaaacgagagtataggagaggtaagttccgagggacagtacgtacacgtcatccgaccggcggacaccactaccgacgtaagtacacgacctacgacgtacgggaactaggacggacgcccgtanaggtactacgtacggaaccgaccgaaccggggtacctaaaccgtttacgttaccgnggtaccggaccggtaagtagtaatttacgttggaccgtacgttcggtccgtcggaccgttacggtaacccgtacggtccgttagggtcgggtaacccggg

SEQ ID NO: 245890 - DNA, 580 bp, Homo sapiens
  misc_feature: GYAE6OF01BVOGV.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctctgcagtgcttctggttacattcttttccaccttacggtatgtaattggtgagacgacggcccccggaggaggggtcgttggaggtggagtgggagtggatcgagcccgttaacggaactaaacgagagtagtggagagacgtacgaggacagagtcatcacgtcgacgcggacacactaccgaacgacgtaccagacctaacgagtaggaactggaacggacgccctacgagacgtcgtacgacgaccgacggtaccttacttacttacgcgacgcgacgtagtattacgtgactacggttcggtcctgggtactacgtaaccgtacggtcgttgggcgggtaccgg

SEQ ID NO: 245891 - DNA, 652 bp, Homo sapiens
  misc_feature: GYAE6OF01E1FIO.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacattcttttccacctacgtgtatagtagttggtagacgacgaccggcccggaggtacgggtcttaggaggtggtaggtgggtagtaggtactacgtacgtacccgttaacggaaactaaacgagtaagtagtagggaagtaaggtacgttacggagggacgaagtacgtactacgtacacgtaccgacccggacgaccaccgtactaccgacgtaacgtacacgtacctaacgacgtacgaacgtggacggtaccgacctacagtactcgacgaccgacgaccgtacttaacgttacgtacgacggccggagtacggaagttaacgttacgtacgaccgtcggttccggttcccgtaggtaccgttaaccggtaacccgtacggttcgttacggggtaccggg

SEQ ID NO: 245892 - DNA, 594 bp, Homo sapiens
  misc_feature: GYAE6OF01D7H9L.42.49.E05.1.454.CMB.1.raw
  modified_base (455)..(455): a, c, t, g, unknown or other
  misc_feature (455)..(455): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccaccttacggtatgtaattggtttgagactacggccccccggtaggacgggggtcttggaggtgggagtggggagtgggatcgacgtccccgttaacggaaactaaaacgagtaagtaagtggaagagtaagttccgaagggcaaggagtcatcaatcgaccgacggacacactccacgacgtaacacgacctaanacgtcggaactggaggagcctacagtatcgtagaaccgacgaccggtacctacttattacgtgacgacgagtagtatttagtcgtactacgtcggtaccgtgaccgtacgtaacccgtacgtcgttggtgggtacccgg

SEQ ID NO: 245893 - DNA, 656 bp, Homo sapiens
  misc_feature: GYAE6OF01BJ5O9.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctctgcagtgcttcgtggttacattccttttccaccttacggtatagtattggttagagacgacgggccccggaggaggggtcttggaggtggagtgggatggatcgacgtaccgttaacggaaactaaacgagagtagtaggaagaaggtaacgtcgaggacgagagtcatcacgtcgaccgacggacacactccgaacgtacgtacagacctaagacgtaggaacgtggaacggacgtcctacgagactcgtacgaccgaacgtaccgggtacctaactttacgttaacggtcggaccggtacggtaaaggtacgttaacgtttaacgttcggtaaccgtaccgggttcggttacccgttacgggttaacccttaccgggtaaacccgtccggttccgttttagggggcgggttaaccccgggg

SEQ ID NO: 245894 - DNA, 658 bp, Homo sapiens
  misc_feature: GYAE6OF01A5537.42.49.E05.1.454.CMB.1.raw
  modified_base (639)..(639): a, c, t, g, unknown or other
  misc_feature (639)..(639): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttcgtggttacattcctttccaccttacggtatgtaagttggttagagtaccgacggccccggaggagggtcgttggaggtggagtgggatggactcgacgtaccgtaacggtaaacgtaaaacgaggagtaagtaggaagagtaacggtccggagggacaaggtagtacgaactacgtacgtaccgaccggtaccggaacgaaccgtaacgttaccgaacggtaacgtaacccgacgtacccgtaaagtaccggtacgaaaccggtggaacgtacgaccctagacgactccgtaagaaccgtaaccgaccggtaccttaactttaacgaccgtggaccgacgtaaacgtagtacttagttcgaccgttacgtcggtccgtaggccgttacgtaacncggtcgttgggcggtacgg

SEQ ID NO: 245895 - DNA, 702 bp, Homo sapiens
  misc_feature: GYAE6OF01C63JD.42.49.E05.1.454.CMB.1.raw
  modified_base (235)..(235): a, c, t, g, unknown or other
  misc_feature (235)..(235): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgatggtcctccgngcagtgctttcgtggttacattcctttccaccgtacggtatggtaatttcggttagacgtacgaccgggtccccccggaggtacggggtcgttaggaggtgggtaagtggggagttagggacgttaccgtaccggtacccgttaaacggaaaccttaaaaacgaggtaagttagtaggggaaggtaacggtaacggtttacccgaagggtaccgaaggtaacgtacgaactacgacgtaccggaacccgtacgggaaccaaccaccgttacccgaacggtaacgtaaccgacgtaccttaaccgagttagaaacgtggaacggacgtaccttagacgtagtcacggtaacgaaccgacggtacctaactttacgtacgtcgtacggaccgtagaacgttagttacgtcgtcgacgttcggtaccgttgaccgttacgtaaccgtaggtccgttggtcgggtacccgg

SEQ ID NO: 245896 - DNA, 609 bp, Homo sapiens
  misc_feature: GYAE6OF01ERV2W.42.49.E05.1.454.CMB.1.raw
  modified_base (246)..(246): a, c, t, g, unknown or other
  misc_feature (246)..(246): n is a, c, g, or t
  modified_base (426)..(426): a, c, t, g, unknown or other
  misc_feature (426)..(426): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgctttcnggttacattctttccaccttacggtatgaattggttgagacgacggcccccggaggaggggtcttggaggtggatgggatgggatcgagccttaacggaactaaaacgagaagtatggagagtaagttccgaggcagagtcatcatcacgcggacacgactccacgagtacacgacctanagtaggaactgacggacgcctacgatagtctacgaacgaccgaacggacccttaactttaacttaccgtcggaccgacggtaagaacgttaagtttaaggttccgtacttacggtacggtttcccgtaggtacccgttaaggttaaaccccgtaacggtcgtttacgggtggggtaaccccgg

SEQ ID NO: 245897 - DNA, 614 bp, Homo sapiens
  misc_feature: GYAE6OF01CW62N.42.49.E05.1.454.CMB.1.raw
  modified_base (323)..(323): a, c, t, g, unknown or other
  misc_feature (323)..(323): n is a, c, g, or t
  modified_base (546)..(546): a, c, t, g, unknown or other
  misc_feature (546)..(546): n is a, c, g, or t
tcagtgacgtatgtcacgaccggtgctcgatttagagcgactagcaacacacaaagggacccaaaaccacaccctccttgggagaactccctagatcacagctcctcaccatgggacgggacctggagcatccttttcttggtggcagcagcaacgaggtcgcccactcccgaggttccaccgtggtgctagtcaggagctgagctgcagacgcgtcgggcctgagtgattcggtctcgtgcgtgtcgtcttagtaggttactcttcctttaccaccgtaggtatagtagttggtagacgacgacgggcccggaggtacgggntaggagtggagtgggatggactacacggtacccgtaaggaaactaaacgagtaaggtagtaagggaacgtaggtaagtaccgaagggctaaggaagttcaacgtacgacgtacgaccggaccgaacactaaccgtaccgaagtacgaactacgtactaacgtagacgtagaggacgtacgtactacgagacgtacgagtacgacgaccgtactagtactacgnggacgtaggatagtattaggtcagtactcgtacgtgtacgaacgttacaggtcgtcggtcggtaccgg

SEQ ID NO: 245898 - DNA, 562 bp, Homo sapiens
  misc_feature: GYAE6OF01CLNJA.42.49.E05.1.454.CMB.1.raw
  modified_base (419)..(419): a, c, t, g, unknown or other
  misc_feature (419)..(419): n is a, c, g, or t
  modified_base (439)..(439): a, c, t, g, unknown or other
  misc_feature (439)..(439): n is a, c, g, or t
  modified_base (476)..(476): a, c, t, g, unknown or other
  misc_feature (476)..(476): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggatgggatggatcagcccttaacggaaactaaaacagagtagtaggagagaagttccagggacagagtcatcgatcaccgcggacacatccacgagtacagacctanatggaactgacggagccctnagactctagaacgacaacggtccaactttacttacgngcgtacgagtacgtagttagtcgactacgttgggtccctgggtaccttacggtaaacccgtaccggtcgtttgggtcggggtaccg

SEQ ID NO: 245899 - DNA, 706 bp, Homo sapiens
  misc_feature: GYAE6OF01DY53M.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattgtgagacaggcccccggaggacgggtcttggaggtggagtgggagtggatcgagtacccgttaacggaaactaaaacgagaagtagtagggaagaaggaacggttccgaagggtacaaggtaggtacatacgaacttaccgaacccggcggaaccaacctactaccgaacgaagttaccgaacggtaccctaacgaagtagggtaaaccgtggacgggacgcccgtacgaacggtaacttcgtaaggaacccgaacggtaaccccgggtacctaaccgtttaacgttaccgtacggtaccggaccggtaaaggtacggttaatttaaccggttacgtaccgttaaccggtttcgggtacccggttacgggtaccgttaaccggtaaaccccgtacggttacccggtttggggtaccggggtaaccccgg

SEQ ID NO: 245900 - DNA, 528 bp, Homo sapiens
  misc_feature: GYAE6OF01C41XZ.42.49.E05.1.454.CMB.1.raw
  modified_base (349)..(349): a, c, t, g, unknown or other
  misc_feature (349)..(349): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccccggagaggggctttggagtggagtgggatggatcgagacccttacggaactaaaacngagtatggagagagttcaggcagagtcagcatcaccgcggacacatccacgagtacagactaacngtagaactggagngcctnagatctacgacgacacgggaccagttacttacgtcgacgcgaagagtattagtgactacggtcgtcctgcttacgaaccagtcgtggtggtaccgg

SEQ ID NO: 245901 - DNA, 620 bp, Homo sapiens
  misc_feature: GYAE6OF01AEV6A.42.49.E05.1.454.CMB.1.raw
  modified_base (220)..(220): a, c, t, g, unknown or other
  misc_feature (220)..(220): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctnagtgatggtctccgtgctagtcgtctttcgtggttacctacttccttttcccaaccgttacggtataggtaagtttggttagacggaccgaccgggcccccggagggacggggtcttggacggtggtagtgggatggatcgacgtaccgttaacggaaactaaacgagagtagaggagaggtacgtcgagggcaggatcatcactccgacggacgacacactaccgacgtagacacgcctacagtacggaactaggacggacgtcccgtagaaggtactacgtacggaacccgtacgaccggtacccttaactttacgttaccgacggacgacgagtacgtattacgtcgtacgtcgtcggtccgtaggcgttacgtacctaggtcgttggcgggtaccg

SEQ ID NO: 245902 - DNA, 637 bp, Homo sapiens
  misc_feature: GYAE6OF01DXC2M.42.49.E05.1.454.CMB.1.raw
  modified_base (240)..(240): a, c, t, g, unknown or other
  misc_feature (240)..(240): n is a, c, g, or t
tcagtgacgtatgtcacgaccggtgctcgatttagagcgactagcaacacacaaagggacccaaaaaccacacccctcttgggagaatccctagatcacagctcctcaccatggacgggacctggagcattccttttcttgggtggcagcagcaacaggtcgccccactcccaggttccaccgtggtgcagtcgtggagctgagctgacagacgccgtgggcctgagtgatcggtctccngcagtctcttcgttgtactactttcctttacctacgtacgtatgtaagttggtcgacgtaccggaccggccccggagggtacgggtcgttaggaggtggagtgggtagtggactcgaacggtaccgttaacgaaactaaagaggtagtagtggaagaagtacgtacggaggacgagtagtacgacgtacacgtaccgaccgacgaccacacaccgaagacgtacacgtacatagtagacgtaggacggtcaccgtacgatacgtcgacgaaccaccggtacgtacctaattacgttacgacgtacggagtaggaagttaattacggtcgtagtaccggttcggttaccgtaggtaccgttcggaaaccgttccggttggttacgggtcggtaccggg

SEQ ID NO: 245903 - DNA, 768 bp, Homo sapiens
  misc_feature: GYAE6OF01A6CMC.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattcttttccaccttacggtatgtaattggttagagaccacgggcccccggaggaggggtcttggacggtggagtggggatggatcagtcccgttacggaactaaaacgagaacgtagtaggagagtaaggttcgagggcaggtagtacgaatcaacgttacgaaccggtacgggaactacctaacgtacccgaacgtaacggttaccaaacggtaccctaaacggaacgttacgggaaacgttacgggaacggtaaccggtacccgttacggaacgtaaccggttaccgtaacggggtaaacccgtacccgggtaaccgggtaaccccgttaaccgggttttaaacttaacccggttagggtacccggtaacggtaacgggtaacggttaaacgttttacgttaacggtaccgtttaacggttacccggggttacccgttacggggtaaccccgtttaacggttaaacccccgtacgggtttacccgtttacgggggttacgggttaaaccccgggg

SEQ ID NO: 245904 - DNA, 737 bp, Homo sapiens
  misc_feature: GYAE6OF01DFN8E.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacgaggcccccggaggagggggtcttggaggtggagtggggagtggattacacggtaccccgttaacgggaaactaaaacgagaacggtagtagggaagaaggaaggttacccgaaggggaccaaggtaagtacgaactaccgtacgttaccgaacccggtacgggaacctaccgtaaccgttacccggaacggtaaacgggttaacccaacggtaccccgttaaacgacgtttacgggaaaccgttcgggaacgggtacggacccttacgaacggtacttaccgtacggaacccgtaaccgaaccgggtccctaaacgtttacgtttaaccgtcggtaccggaccggtaagtaccggtaattacgtttacgacgtaaccggtttcgggtacccgttacgggaccgttaacggttaaacccctacggttacgtttgggtcggggtaacccgg

SEQ ID NO: 245905 - DNA, 648 bp, Homo sapiens
  misc_feature: GYAE6OF01AKY40.42.49.E05.1.454.CMB.1.raw
tcagtgacgtatgtcacgaccggtgctcgatttagagcgactagcaacacacgaaaggggacccaaaaaccacacccctccttgggagaatcccctagatcacagctcctcacccatggacgggacctggagcatccttttcttggtggcagcagcaacaggtgcccactcccaggttcacctggtgcagtctggagctgagctgcagaagcctggggcctcagtgatggtctctgcagtgcttctggttacatctttccacctacgtatgtaattggttgagacgacgggccccccggaggacggggtcttggacgtgggagtggggatggatcgacgcccttaacggaactaaaacgagtagtatggagagaagttcgagggcaggagtcagtcatcgacgacggacacactccgacgagtacacgcctaacgatcggaacgtggacggacgtccgtacgaagtactacgtacgtaaccggtaccgaaccgggtaccctaacgtttacgttaaccgtacggtaccgtacggtaggtaacggtaacgtttaacgttcggtaccgttaccggttcgggttaccccgttacgggtaccgttaaccggttaaacccgtaaccggttcgtttcgggtccggggtaacccgg

SEQ ID NO: 245906 - DNA, 645 bp, Homo sapiens
  misc_feature: GYAE6OF01ACC4P.42.49.E05.1.454.CMB.1.raw
  modified_base (162)..(162): a, c, t, g, unknown or other
  misc_feature (162)..(162): n is a, c, g, or t
  modified_base (195)..(195): a, c, t, g, unknown or other
  misc_feature (195)..(195): n is a, c, g, or t
  modified_base (452)..(452): a, c, t, g, unknown or other
  misc_feature (452)..(452): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtncccactcccaggttcacctggtgcagtctgganctgagctgcagaagcctggggcctcagtgatggtctcctgcagtgcttcgtggttactattcctttccacctacggtatcgtaagttggttagacgacgtacgggcccccggaggaggggtcttagacggtggagtgggatggactcgacggtacccgttaacggaaactaaaacgacgtaagtagtagggaagaggtaaacgttccgaagggccaaggtaacgtctagttacgactacggacccggacggaaccanacctaccgaacgacgttaacacgtctaacagtagaactggaacgtacgcctagacgtactcgcgtaaccgaccgaccggtaccttagtttaacgtactagggaccgtaggactaggttaacttacgttcgacgttaacgtcggttacccgtgtaccgtacggttaaaccgcgttcggtagtcggggtacccgg

SEQ ID NO: 245907 - DNA, 776 bp, Homo sapiens
  misc_feature: GYAE6OF01C499T.42.49.E05.1.454.CMB.1.raw
  modified_base (199)..(199): a, c, t, g, unknown or other
  misc_feature (199)..(199): n is a, c, g, or t
tcagtgacgtatgtcacgaccggtgctcgatttagagcgactagcaacacacaaaggggacccaaaaaccacacccctcttgggagaatcccctagatcacacgctcctcaccagtgggacgggacctggagcatccttttctggtggcagcagcaacaggtcgcccactcccaggttccaccgtggtgcagtctggancgtgacgctgacgaggacgcgtcggggcctgagttgagtcgtcctcgtgactaggtcgtctttacgttacggtttaacctatttccttttaccctaccggttaggttaagtacggttaagtttggttacggacgtaccggaccgggacccccgggtaggacgggggtcttagggaggtaggacggttagggaggtggtacgtacggtaaccgttacccgtaaacgggtaaactaaacggaggaggttacgaggggtaagaaacggttacggtacggacgggtaagagtacgtacgtataccgagttaacccgaccggacgaaaccgaccgtaacgtacccggaacgtaacgtacgaaccgttaacctaacgagtaacgtaacggtagaccggtacgacttacggataccttacgggacgtacggaacccgtaaccgtaccgtttaacgtacttaaccggtacggaacggttacggaaacgttacggtttacgttaacgttccggtactaacgggtttcccgtacggttccgttacgtaaccggttactaacccggttgggtaccgggtcggtacggg

SEQ ID NO: 245908 - DNA, 718 bp, Homo sapiens
  misc_feature: GYAE6OF01CH47E.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacatcttttccacctacggtatgaattggttgagacacggcccccggaggaggggcttggaggtggagtggggatgggatcgacgtcccttaacggaacttaaaaaccaggaagttaagtgggaagtaaggtaaaggttccgaagggacgaggtaggtactaatcgaacgtaccgaaccggtcggaaccacgacttacccgaacggaacgtaacccgtaacggaccctaacgaagttaacgggaaacttagggaacgggacgtaccctacgaaggtacgttaccgtacggaaccggaacccgaaccggggtaccctaaccgtttaactttaaccggtcggtaccggaccggtaaggtaaccggtaagtttacgtttcggaccgttaaccggtttcgggttcccgtagggtacccgttaccgggttaaaccccgtaccgggttcccgttttaggggcgggttaaccccggg

SEQ ID NO: 245909 - DNA, 750 bp, Homo sapiens
  misc_feature: GYAE6OF01D02FP.42.49.E05.1.454.CMB.1.raw
  modified_base (189)..(189): a, c, t, g, unknown or other
  misc_feature (189)..(189): n is a, c, g, or t
  modified_base (199)..(199): a, c, t, g, unknown or other
  misc_feature (199)..(199): n is a, c, g, or t
tcagtgacgtatgtcacgaccggtgctcgatttagagcgactagcaacacacaaaggggacccaaaaaccacacccctccttgggagaatcccctagatcacagctcctcaccagtggacgggacctggagcatccttttcttgggtggcagcagcaacaggtcgcccactcccaggttccacctggtncagtctgganctgagctgcagagccgtggggcctcgagtgagttggtcctcctgcaggttcgctttcgtggttactactttccttttacccaaccgttacggttatgtaacgtttggttacggacgtaccggaccgggaccccgggtagggacgggttcgttagggacggttgggaggttgggagttgggacttacgaccggtaacccgttaaggaaaaacgtaaacgtaggaagttagaagggtacggtaaagtaacggttaccggaaggacgtaaggtacgtacgaacgttacaacgtaccgaaccgcgaacacacgtaaccgagtacgtacaacgtaccgtaagacgaggaactggacggtaccgactacgaacgtacgtacgaaccggacgaccggtaccggtaccttaactttacggtaaccgcggtaccgtaacggtaagtagttaacgtttagtcccggtaagtcggtttaccgggtttcccggtagggttaaccccttacgggttaaaccccgtacgggtttacccgggttggggttcccggggtaacccggg

SEQ ID NO: 245910 - DNA, 644 bp, Homo sapiens
  misc_feature: GYAE6OF01ESDOS.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactccccaggttcacctggtgcagtctggagctgagctgcagagccgtggggcctcgagtgatggtctccgtgcagtgcttcgtggttacattcctttccacctacggtatgtaattggttgagtacgacggcccccgggaggaggggtcgttggaaggtggagtgggtatgggtatacgagtaccccttaaggaaaccgtaaaacgagagtaagtggaagagtaacgttacgaggacgagagtacgatacgatcgacggacgacacactaccgagtactacacgtacctacgagtagaactaggacgacgcctagagactcgtaacgaccgaacgaccggtacctaacgtttacgtaaccgttcggaccgacggtaacgtacgttaaatttacggtacggtacgtaccggttcggtacccgttagggtaccgtttaacccgtaacccgtacgttcgggtttcggcggggttaacccggg

SEQ ID NO: 245911 - DNA, 770 bp, Homo sapiens
  misc_feature: GYAE6OF01AGWXT.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtctccgtgctagtcgtcttcgttgttactctttcctttacctacgtacggttatagttagttggtagacgaccggaccgggacccggagggcgggttcgtaggagggtaggtaggtgggtaggtaggtacgtacgtaaccggtaacccgttaaacggtaaacgtaaaacggtaggttaaggtaaggtagggtaaacggtaacgggtaaccggtacgggtaacggacggtaacggtacgtacgtacgtacgtaccgtaccggaaccggtaccggaaacctaccgtaccgtaacccgaggtaaccgtacccgacggttacctaacggtaaggaccgtacgtagggaaacggtccctaccgtagacggttactccggaacggaacccgaccggtaccgtaccgtttaattttacccgacggtacgaccgaacggtaggtaacttaggttacgtccgtaccggttcggttccggttccggtacggtttaaccgtacccggttacccggttacggtttccgggtttgggcccgggtaacccggg

SEQ ID NO: 245912 - DNA, 680 bp, Homo sapiens
  misc_feature: GYAE6OF01BSXSO.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggaactgagctgcagaagcctggggcctcagtgatggtctcctgcagtgcttctggttacattcttttccacctacggtatgtaattggttagagacgacggcccccggaggacggggcgttggagtgggtagtggggtagtggatcgacgtacccgttaacggaaacgtaaaacgagtaagtagtaggagaagtaacgttcgagggcgagagtacgatcgatacgaccgccggacacactaccgaacgacgtaacacgtacctaacacgtacggtaacgtaggacggtacgacccgtacgaagtacgttacgacggtaaccgaaccggtaacccggaccttaaccgtttaaccgtttacgtacggaccggtacggtaaggtaacggttaatttaacggtcgtaccgtaacggttcgggttccgttcgggtacccgttacggttaacccgtacggttcgtttacggggttccgggacgttaaccggggg

SEQ ID NO: 245913 - DNA, 633 bp, Homo sapiens
  misc_feature: GYAE6OF01B0SC7.42.49.E05.1.454.CMB.1.raw
  modified_base (481)..(481): a, c, t, g, unknown or other
  misc_feature (481)..(481): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacattctttccaccttacggtatgtaattggttgagacgacgggcccccggaggacggggcttggaggtggagtgggagtggactcgacgtacccgttaacggaaactaaacgagagtagtaggagagtaacgttcgagggcaggacgtacatcagtccgaccgacggaaccacactaccgacgacgtaccagaccctaagacgtaggaacgtggaacggtacgcccgtanaggtactcgtacggaacccgaaccgtaccggtaccttaactttacgtaccgtacggccggacgaaggtacgtaagtttacgtcggtacgtacggttcggtacccgttggtaccgttacgtaacccgtacggtcgtttgggtcgggtacccgg

SEQ ID NO: 245914 - DNA, 649 bp, Homo sapiens
  misc_feature: GYAE6OF01AKU9L.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccaccgttacggtatgtaagttggttagagacgacgggcccccggaggacggggtcttaggagtggagtggggagtggatcgacggtacccgttaacggaaacgtaaaacgaggtagtaagtagggaagaaggaacgttaccgagggacgaaggacgtcaagtcagtccgaccggacggacactacgtacccgaacgaacgtacaacgtacctaacgtacgtacgggaaacgtagggaaggacgacccttacgagtacttcgacggaaccggaccgaccggtacccttaacttacgttacgacggtaccgacggaagtaagtacttagttcggactacgttccgggtccttcggtcgtacggtaacccgtagtcgttgggtccgggtaccg

SEQ ID NO: 245915 - DNA, 718 bp, Homo sapiens
  misc_feature: GYAE6OF01D349E.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttcgtggttacattccttttccaccgtacggtatagtaattggttgagacgacggcccccggaggaggggtcttggaggtggagtggggatggactcgacggtacccgttaacggaaactaaaacgaggtaacgtagtagggaagtaacggtaacgttaccggagggacgtaaggtacgtacagtacaacgtaccgacccgggtacgggaactaaccgacgtacccgaacggtaacgtaccacggtaccctaacgagtacgggaaacgtcggaacgggtacgaccccgttacgacgtaacgtccgtaacgggaacccgaaccggacccggtacccttaaaccgttttacgttaacgtacggaccggtaacggtaaggtacgttaagtttacgttcggaccttaccggttcgggttacccgtacgggtaccgttaacggtaacccgacgggtttcgtttcggggcgggtaacccggg

SEQ ID NO: 245916 - DNA, 605 bp, Homo sapiens
  misc_feature: GYAE6OF01E2BCK.42.49.E05.1.454.CMB.1.raw
  modified_base (429)..(429): a, c, t, g, unknown or other
  misc_feature (429)..(429): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacgacgggcccccggaggaggggcttggaggtggagtgggatgggatcgacgtcccttaaggaaactaaaacagagtagtggagagaagttccgagggcagagtcatcatcgacgcggacacactccaagacgtaacacgacctanacgtaggaactggaggacgccctacgagactcgtacggaaccgaccgaccgggtaccttaacgtttacttacgtacggcgacgtaggaacgtaagtttacgttcgacgtaccgtttcggtacccgttcgggccttaaccggttaaccgacggttccggtttcggtcgggtacccgg

SEQ ID NO: 245917 - DNA, 667 bp, Homo sapiens
  misc_feature: GYAE6OF01EEER2.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccacctcccaggttccaccgtggtgcagtcgtggagctgagctgcagagccgtggggcctcgagtgagtcggtctccgtgcagtgtcttgttggttactactttcctttacctaccgttacgtagtagtaagtttggtgacgtaccgacgggaccccggaggtacgggtcgttaggaggtggaggtgggtagtggactcgtacgtaccgttaaggaaactaaagagtagtagaggagagtaacgtacggaggacgtagtacgtacacgtacacgtacccgaccggaccggaaccaccgtacgtacccgaacgtacgtacaccgtaacctagacgtacggacgtaggacgtactccgtacgacgtactacgtacgaccgaccgacgtaccttacttacgttcgagccgtacggtagtaacgttacgttagtccggtaccgttacgttccgggttacctcggtacccttacggtaccgtccggttcggttcggccgggtaccgg

SEQ ID NO: 245918 - DNA, 698 bp, Homo sapiens
  misc_feature: GYAE6OF01BTDAU.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactccccaggttcacctggtgcagtctggagctgagctgcagaagcctggggcctcagtgatggtctcctgcagtgctttcgtggttactattcttttcccaccttacggtatgtaattggttgagacgacggccccccgggaggacgggggtcgttggaggtgggaagtggggtaagtgggtaatcgtacgtacccgttaacggaaaccttaaaacgaggaagtagtagggaagaaggtaaacgttccggaagggtacgaggaagtacaagttacaacgtccgaaccggaccggaacaaccgaactacccgaaccggtagttaaacccgaacgaccctaaagacgtaacgggaacgttaggaacggtacgcccttaacgaacggaccttacgaacgtaaccggaacccgaccggtacccttaactttaccttaacggcgtacggaccgaagacgttaattaagttcgcgttaaccggtggttcccgtaggtaccgttaacgtaacccgtaggtacgtttggcgggtacccgg

SEQ ID NO: 245919 - DNA, 655 bp, Homo sapiens
  misc_feature: GYAE6OF01AV4VR.42.49.E05.1.454.CMB.1.raw
  modified_base (454)..(454): a, c, t, g, unknown or other
  misc_feature (454)..(454): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttctggttacatcttttccaccgtacggtatgtaacttggttgagacgacgggcccccggaggaggggtcttagagtggagtggggatggactcgacgtacccgttaacggaaacttaaaacgagtaacgtagtggaagaggtaacggttccgagggtcaggacgtacatacatcgaccgcggacacgtactaccacgacgtacacgtcctaanagtacggaactgggaacggacgtcccgtacgaagtaccttcgtacgaaccgaccgacgggtaccctaacgtttacgttacgttacggaccgtacggaacggtacgtaacgtttaacgttcgacccgttaccggttcgggtaccccgtagggtacctttacggtaaccccgtacggttccgtttcgggtcggggtaccccgg

SEQ ID NO: 245920 - DNA, 754 bp, Homo sapiens
  misc_feature: GYAE6OF01BH0ZM.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggctcagtgatggtctcctgctagtgtcttcgtggttaactattccttttccaccgttaaccggttatacgtaaagtttggttaggacgaaccgacggaccccccggaggaacggggtccgttggtaggttgggaagtcggggtaagttcgggaatccgtaacggtacccttaaacgggaaacttaaaaaacgaggtaagttaagtagggaaggaaacggtaacggttaccgaaggggaccaaggacgtacgtaataccgtaagtacgaacccgacgggaacctaccgaacgttacccgaacgtaacgttaacaaacggtccctaaagactaacgggaacttaaggacggtacgaccgtacgaagaccttacgaacgtaacccgaccggaaccgggtaccttaaccgtttaacgttaccggtacggccgtaacggaagggtaacttaagttaaacgttcgggaccttaaacggttccggtaccgttaggacccgttaacggtaaacccgtacggttacgttacggggtccggtaacccggg

SEQ ID NO: 245921 - DNA, 577 bp, Homo sapiens
  misc_feature: GYAE6OF01CC91X.42.49.E05.1.454.CMB.1.raw
  modified_base (497)..(497): a, c, t, g, unknown or other
  misc_feature (497)..(497): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccgttacggtatgtaattggttgagtacgacggccccggaggaggggtcttggagtggagtgggatggatcgacgcccttaggaactaaacgagagtagtggagagagttcgaggacagagtcatcatacaccgacgacacatccgacgagtacacgacctaacagtaggaactggaacggtacgcctacgagtactacgtacgaaccgaccgaccggtacctacttagttacgngaccgcgagtagtattagttcgactacggttcggtaccgtggtaccttacgtaacccgtacgtcgttggtcgggtaccgg

SEQ ID NO: 245922 - DNA, 705 bp, Homo sapiens
  misc_feature: GYAE6OF01E5JAP.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccaccgttacggtatgaagttggttcgagtaccgacggcccccggaggacgggggtcgttggagtcggaggtggggatgggatcgacgtacccgttaacggaaactaaaacgagaaggttagtagggaagaggtaaggttccaagggtcagagtacatcactcgaccgacggaacacgactccgaacgacgtacacgtacctacgaagtacgggtaactaggaacggtaccgtaccctacggtagtaacgttccgtacggaacccgtacgtaccgggtacccttaacttttaacgttaaccggtcggtaccgaacggtaacggtaacttaaacggttttacggttaccgaccggttaaccggttacgggttacccggtttcgggtaaccgttaccggttaaaccccggtccggttaccggtttaccgggggtggggttaaccccggg

SEQ ID NO: 245923 - DNA, 690 bp, Homo sapiens
  misc_feature: GYAE6OF01CGCM0.42.49.E05.1.454.CMB.1.raw
tcagtgacgtatgtcacgaccggtgctcgatttagagcgactagcaacacacaaaggggacccaaaaccacacccctccttgggagaatcccctagatcacagctccctcaccatggacgggacctggagcattccttttcttggtggcagcagcaacaggtgcccactcccaggttcacctggtgcagtctggagctgagctgcagagccgtgggctcagtgatggtctcctgctagtgcttcgtggttactattcttttaccacgtacggtatgtaattggttagagacgacggccccggaggacggggtcttaggagtggtagtgggataggtagtcgacgaccgttaacggaaactaaaacgagtagtagtaggacgagtaacgtcgaggacgagagtacatcgataccgacgacggtacaacactaccgaacgaagtaacgacgtaccaactaggtacgaagtagggaaggaccgtaccgtacgagtaacttcgtaacggaaccggtaccgtaacccggtaaccctaacgtttaacttaccgtacggtaccggacggtaaggacgtttaacgtttaacgttacggaccgtttaccggttcgggttaaccccggttacggttaccggttaaacccggttaacccggtacgggtttcccggtttggggttaacggggtaaccccggg

SEQ ID NO: 245924 - DNA, 677 bp, Homo sapiens
  misc_feature: GYAE6OF01A61LZ.42.49.E05.1.454.CMB.1.raw
tcagtgacgtatgtcacgaccggtgctcgatttagagcgactagcaacacacaaaggggacccaaaaccacacccctccttgggagaatccctagatcacagctcctcaccatggacgggacctggagcatccttttcttggtggcagcagcaacaggtgcccactcccaggttcacctggtgcagtctggagctgagctgcagaacgccgtgggcctcagtgagtggtctccgtgctagtcgcttcgtggttactattcctttccaccgttacggttatcgtaagttcgggtttgaacggtaccgtaccggggcccccggaagggtacggggtaccgttagggtacggtgggaggttagggagtggagttcgacggtaccgtaacggaaactaaaacgacgtaagtagtaggaagaacgtacggtacgaacggcgtaggaacgtacgatacgtactccgaccgacgacacgtactaccgaacgaacgtacaacggacctagaacgttaggacgtaggacgacgtacctagacgactccgtaaggaaccgtaccgaaccggtaccgtacgtttaacgtacccggtgaccggtacaggtacgtacgtttaagtcggtactacggttcggtaccgtgtaccgttacggaacccttaggttcgtgggtccgggtaccggg

SEQ ID NO: 245925 - DNA, 601 bp, Homo sapiens
  misc_feature: GYAE6OF01E4AZ3.42.49.E05.1.454.CMB.1.raw
  modified_base (435)..(435): a, c, t, g, unknown or other
  misc_feature (435)..(435): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgtaattggttgagtaccgacgggccccccggaggacgggggtcttggacggttggagtggggatgggatcgacgtcccttaacggaactaaaacgagagtatggagagtaagttcgaggcagagtcatcatcgaccgcgacacactccacgagtacacgacctanagtaggaactggaacggacgtacctacgaacgtatcgtacggaaccgacgaccggtaccttaacgtttacttacgcggtaccgacggagacggtaatttacgtcgtacctacgttccgggttcctgggtaccttacgtaaccctacggtcttgggtcggtaccggg

SEQ ID NO: 245926 - DNA, 729 bp, Homo sapiens
  misc_feature: GYAE6OF01CNERB.42.49.E05.1.454.CMB.1.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (324)..(324): a, c, t, g, unknown or other
  misc_feature (324)..(324): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgccccactccccaggttcacctggtgcagtctggagctgagctgcagaagcctgggcctnagtgatggtctcctgcngtgcttcaggttacnttccttcacctagtangtaagttggtgaagacgacggcccccggaggacggggcttgaggtggagtaggggntagggatcgaacggtaccttaaacggaaaacttaaaacgagaaggtagtagggaagaaggaacgttccgaggacgagtagcgtatacactaccgaccggcggaacaaccggtacaccgaacgtagtaacccacggacccgtaacctaaggtacgtaacgggttaaccggtacgggaaccggttaccctaaccgaagttaccggtaaccgttaacgggaaacccggtacccggaaacccgggttaccctaaaccggtttttaaaacccttcgggtaaccggtaccgggacggttaaaccggtaacgttaaagtttaagttaccgggtaacgttaacccggttcgggttacccgtaggttacccgtcgttaaacccgtaccgggtccttggggttacgggacccggg

SEQ ID NO: 245927 - DNA, 662 bp, Homo sapiens
  misc_feature: GYAE6OF01DSITG.42.49.E05.1.454.CMB.1.raw
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (397)..(397): a, c, t, g, unknown or other
  misc_feature (397)..(397): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (469)..(469): a, c, t, g, unknown or other
  misc_feature (469)..(469): n is a, c, g, or t
tcagtgacgtatgtcacgaccggtgctcgatttagagcgactagcaacgacacgaaaggggacccaaaaaccacacccctccttgggagaatccctagatcacagctcctcaccatggacgggacctggagcatccttttctggtggcagcagcaacaggtgcccactcccaggttcacctggtgcagtctggagctgagctgcagacgccgtgggcctnagtnagttggtcctccgngctagtgtcgtttcgtaggttactattccttttaccaccgttacggtagtagtaagtttggttagacgacgtaccgggcccccggtagggacgggtcttagggaggtaggtaggtagggtagtgggactaccgacgttaccgtaacgaaacttaaacgngtaagtagagaagagtacgtcgagnagatnatcataccgacgagacatacacgagacgtacgacaccgtaanacgtacgaactggacgtacgtcccgtagaacgtactcggtaacgaccggaaccgtacccggtaccctttaacgtttaaccgttaccggcggtacccggtaagtaccgttaggtactttacgtaccgtaccgttacggttccgttacggtcggttacctaccggtaaacgtccgtggttcggcggtaacccggg

SEQ ID NO: 245928 - DNA, 656 bp, Homo sapiens
  misc_feature: GYAE6OF01DX7HZ.42.49.E05.1.454.CMB.1.raw
  modified_base (561)..(561): a, c, t, g, unknown or other
  misc_feature (561)..(561): n is a, c, g, or t
  modified_base (632)..(632): a, c, t, g, unknown or other
  misc_feature (632)..(632): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaagttggttagacgacgacgggcccccggagggacggggtcgttggacgtgggagtggggtagtgggatcgacggtacccgttaacggaaactaaaacgagtaacgtagtagggaagtaaggtaacggttacgaacggggacaggtacgtacatacgactaccgaaccggcgggaactaacgacgtacccgaacggaacgtaaccgacgacctaacagtacgggaactggaggacgtcctacgagtactcgtaacgaccgaacgaccggtaccttacttattaccgngtaccggagtaaggtacgtaatttacgtacgtacctacggttcggtaccgtggtaccgttcgtaaacccgnggttaccgttgggtcgggtaccgg

SEQ ID NO: 245929 - DNA, 630 bp, Homo sapiens
  misc_feature: GYAE6OF01BU1WC.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgtcttcgtggttactattcttttaccaccgttaccggtatagtaagtttggttagagaaccgacgggcccccggaggacggggtcgttggaggtggagtggggtatggatcgacgtacccgttaacggaaactaaaacgaggtaagtagaggaagtagaacgttacgaggacgagagtcatacacgtacaccggacggaccacgtactccgaacgaacgtaacacgtacctaacgaagtacggaacgtcggacggacgccgtacgagtactcgacgaacgacgaccgtacctaacttataccgtagccgacggagtacgtaattacgtacggtcacggttcggtaccgtcgggaccttacggtaacctacggttcggttggcggtacccgg

SEQ ID NO: 245930 - DNA, 644 bp, Homo sapiens
  misc_feature: GYAE6OF01A11JL.42.49.E05.1.454.CMB.1.raw
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
  modified_base (395)..(395): a, c, t, g, unknown or other
  misc_feature (395)..(395): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttntggttacnttctttccacgttacgtatgtaattggtgagacgacggccccggaggacggggtcttggaggtggagtgggagtggatcgacgtcccgttaaggaaactaaacgagagtaagtggagaagtagtacgaggacgagacgtactanacgtagtaccgaccgacggacaacgactaccgacgaagacaacgtacctaacgatacgggaaccgtaggaggaccgtaccgtacgaagtacgttacgaccggaacgtacccgacggtaacccttagtttaactaccggtagacccggagtaacgagttaacgtttacggtcgaccggttacgttccggttccgtacggtacccgttacgtaacccggttaccgtttcggttacggtccggggtaacccg

SEQ ID NO: 245931 - DNA, 714 bp, Homo sapiens
  misc_feature: GYAE6OF01EUJ8C.42.49.E05.1.454.CMB.1.raw
  modified_base (332)..(332): a, c, t, g, unknown or other
  misc_feature (332)..(332): n is a, c, g, or t
  modified_base (391)..(391): a, c, t, g, unknown or other
  misc_feature (391)..(391): n is a, c, g, or t
tcagtgacgtatgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtcgcccactcccaggttcaccgtggtgcagtctggagctgagctgcagaagccgtgggcctcagtgagtcggtctcctggggcagtcgtctttctggttactcttccttttccacgttacgtatagtaatttggtagacgacgccggaccccgggaggacgggtcgttggnggtaggaggtgggagtggacttacgacgttaccgtaaacgaaactaaacgagagtaagnggagagtaacgtacgaggacgagagtcagttcacgtaccgaccgaccggtacaaccgtacgtaccgaacgaacgtaaccgacgtaacctaacgtaacggtacgtaacggtagaaccgggtacgacccgtaagaacgtagtaccgtacggaacgacccgtacccgggtaaccttaaccgtttaagtaccggttacggaccggtaacgtaacgtaacgttaacgtttacgttacggtacccgttacggttccgggttcccggtaggttacccgttaacccgggtaacttaccgggttccggttacggggtaccgggtaacccggg

SEQ ID NO: 245932 - DNA, 594 bp, Homo sapiens
  misc_feature: GYAE6OF01DUIVD.42.49.E05.1.454.CMB.1.raw
  modified_base (376)..(376): a, c, t, g, unknown or other
  misc_feature (376)..(376): n is a, c, g, or t
  modified_base (444)..(444): a, c, t, g, unknown or other
  misc_feature (444)..(444): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacgtatgtaattggttgagacaggcccccggagaggggtcttggagtggagtgggatggatcagccttacggaaactaaacagagtatggagagaagttccagggcagagtnatcatcaccgtcggacacactaccacgacgtacacgacctaacactaggaactggaacggagccctanagtatcgtagacgaccgaccgggtacctacgttaacttacgtgcgtaccggaagacgtaatttagttcgtacgtaccgttcgggttacccgttgggtacccttaccggttaaaccccgacggttaccgtttgggtcggggtaaccccggg

SEQ ID NO: 245933 - DNA, 614 bp, Homo sapiens
  misc_feature: GYAE6OF01AX0G3.42.49.E05.1.454.CMB.1.raw
  modified_base (141)..(141): a, c, t, g, unknown or other
  misc_feature (141)..(141): n is a, c, g, or t
  modified_base (416)..(416): a, c, t, g, unknown or other
  misc_feature (416)..(416): n is a, c, g, or t
  modified_base (434)..(434): a, c, t, g, unknown or other
  misc_feature (434)..(434): n is a, c, g, or t
  modified_base (482)..(482): a, c, t, g, unknown or other
  misc_feature (482)..(482): n is a, c, g, or t
  modified_base (488)..(488): a, c, t, g, unknown or other
  misc_feature (488)..(488): n is a, c, g, or t
  modified_base (600)..(600): a, c, t, g, unknown or other
  misc_feature (600)..(600): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttnttggtggcagcagcaacaggtcgcccactcccaggttcaccgtggtgcagtcgtggagctgagctgcagacggccgtggggcctcgagtgagtggtctcctgctagtgtcttcgttagttactacttcctttccacgttacgtatagtaacgttggttagacgacgaccgggaccccggagggacgggtcttaggaggtggagtgggatggatcgacgtaccgtaacgaaactaaacgagtagtagaggagagtaacgtcgaggacagagtacanacacgtacgaccgacganacgactacgacgtagacctagacctaagacgtagaacgtagacggacnccgtanacggtatacggacgaccggtaccgaaccggtactacgtttactacgacgtcgacgtagacgttattagtacgactacggtcggtcgtacgacgttaacgtacgtaccggttnttgggcggtaccgg

SEQ ID NO: 245934 - DNA, 594 bp, Homo sapiens
  misc_feature: GYAE6OF01EGQOE.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacacggcccccggaggaggggcttggaggtggagtgggatggatcgagtacccgttacggaaactaaacagtagtagtaggagagaacgttcgagggcagagtacatcatcaccgcggacacactaccacgtagtacacgacctaacgagtacggaacgtcggaggacgaccgtacacggatcgtacgaaccgacgaccggtacctactttaacttacgtcgacgacgtagagtaagtttacgtcgtaccgtacggttcggtaccgttgggaccttacggttaaccgaccgtcgttcggtgggtaacccgg

SEQ ID NO: 245935 - DNA, 618 bp, Homo sapiens
  misc_feature: GYAE6OF01CIH03.42.49.E05.1.454.CMB.1.raw
  modified_base (610)..(610): a, c, t, g, unknown or other
  misc_feature (610)..(610): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttcacctggtgcagtctggagctgagctgcagagccgtggggcctcgagtgatggtctcctgcgagtgtcttcgttggttactattccttttaccaccgttacggtatgtaagttggttaggacgacgtaccgggcccccggaggcgggggtcgttggaggtgggagtgggtagtggacgtacgacgtcccgttaaacggaaactaaaacgagagtagaggagagtacgtacgagggcaagtgtacatacactcgaccggcgacacgactcgacgagtacacgtacctaagagtaggaactggacggagcccgtagagtactcggtacgaacgaccgaccggtcctaacgtttactacgtgaccggagtaagtacttagttacgtcgacgttacgtcggtccgtagtacgtaccgtaccgtacgtcgtttcgggngggtcccg

SEQ ID NO: 245936 - DNA, 746 bp, Homo sapiens
  misc_feature: GYAE6OF01DK3NM.42.49.E05.1.454.CMB.1.raw
  modified_base (196)..(196): a, c, t, g, unknown or other
  misc_feature (196)..(196): n is a, c, g, or t
  modified_base (453)..(453): a, c, t, g, unknown or other
  misc_feature (453)..(453): n is a, c, g, or t
  modified_base (713)..(713): a, c, t, g, unknown or other
  misc_feature (713)..(713): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtctgganctgagctgcagaacgccgtggggcctcgagtcgtatgggtcctcctgactaggtcgtcttcgttcggttaactcgtttccttttacccacccgttaacggttatgttaagtttgggttcgaacgtacggaccgggtccccccgggaagggtacggggtcgtttgggaaggtgggaggtgggaagtggtactacgacgtacccgtaacgaaactaaaacgagtagtagaggagagtacgtaccgaggtcaaggtactnaacgtctataccgaccgacgaaccaccgtaactacccgaaggtaaccgtaaccgacggtaaccctaaggacgttagggaaccgttcgggaaacggtccgtacccgtacgtaagttacgtaccggaacgtaacccggaacgacccggtttaaccctaaagtttaaccctacgggttacgaccgggtaaccgaagggaccttaagtttaacggtcgtactaccggtttcgggactttccggaactttaacccggggtaaacnccggtttaacgttgggggtcccgtaacccgggg

SEQ ID NO: 245937 - DNA, 741 bp, Homo sapiens
  misc_feature: GYAE6OF01ASU0I.42.49.E05.1.454.CMB.1.raw
  modified_base (244)..(244): a, c, t, g, unknown or other
  misc_feature (244)..(244): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttntgttacatctttccactacggtatgtaattggttgagacgacgggcccccggaggacggggtcttggagtggagtcggggatcggatcgacggtacccgttaacggaaactaaaacgagacgtaagtgggaagaagtaacgttaccgagggtaccaggacgtacagtaccgactacgacccggcggaaccgacctaagtacccgaacggtaacgtaaccgacggtaccctaacgagttaccgggaacgtacggaacgggactacccgtacgacgtaacttacggtaccgaaccggaacccctaacggggtaccccctaaacgtttaacctttaccggtacggaccggaccgggtaacggtacggttaaacgttttaccgtttagggttaacccgtttacggggttaccccgtttacgggtacccgtttaaaccggtaaaccccggttaccggttaaccgggttttcgggtaacccgggggttcgtaaaccccggggg

SEQ ID NO: 245938 - DNA, 744 bp, Homo sapiens
  misc_feature: GYAE6OF01DIDZV.42.49.E05.1.454.CMB.1.raw
  modified_base (244)..(244): a, c, t, g, unknown or other
  misc_feature (244)..(244): n is a, c, g, or t
  modified_base (687)..(687): a, c, t, g, unknown or other
  misc_feature (687)..(687): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttntggttactattcttttaccaccgtacggttatgtaattggttgacgacgacggcccccggaggacggggtcttggaggttggagtgggtagtgggtactcgtacggtacccgttaacggaaacctaaaacgagtaagttagtacggggaagtaagggtaacgttacccgggaaagggtccgtaaggtaacgggttaccaacggttaccgtaaccgtttacccgaacccgggtacccggggtaaaccaaccctaaccggttaccccgaaacgggtaaccgttaaacccgtacggtaaccccttaacgtaacggttacggggaaccttagggaacgggtacgtaccccgttacgaaggttacgtccgttaacggaccggaacccgacccggggtaccttaacgtttaacttaccgtggaccgtacgagtacggttattacgttanacgtacgttcggtccgtacggtctaacggtacccaggttcgttgggcgggtacccgg

SEQ ID NO: 245939 - DNA, 709 bp, Homo sapiens
  misc_feature: GYAE6OF01EH0GB.42.49.E05.1.454.CMB.1.raw
  modified_base (261)..(261): a, c, t, g, unknown or other
  misc_feature (261)..(261): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtcgcccactcccaggttcacctggtgcagtctggagctgagctgcagacgccgtgggcctcgagtgagtcggtctccgtgcgtagtgtcttcgtggttactnttcctttccacgttacgtatgtaagttggtagagtacgacggtcccccggaggacgggtcgttggaggtggacggtagggagtaggtacgtacgacggtacccgttaaacggaaaaccgtaaaacgtaggaacgtagtaggaaggtaacggtaacggttaccgaagggacgtaacggtacgtacgacgtaccgacgtaccgaccgacggacactaccgtaccgaacgtacgtaccgacgtaccgtaacgtagacggtaacgtacgaaggccgacctacgaacggtactacgtaacggaacgtaccgaccggtacctaacgtttaccgtacgtaccggcggaacggtaacgtacggtaactttcgttaacggccttacggttccggttaccgtggttacccgtaaccggttaacccgtacggttcggttacgggtcggttaaccccggg

SEQ ID NO: 245940 - DNA, 748 bp, Homo sapiens
  misc_feature: GYAE6OF01C60U2.42.49.E05.1.454.CMB.1.raw
  modified_base (453)..(453): a, c, t, g, unknown or other
  misc_feature (453)..(453): n is a, c, g, or t
tcagtgacgtatgtcacgaccggtgctcgatttagagcgactagcaacacacaaagggacccaaaaccacacccctccttggagaatccctagatcacagctcctcaccatggacgggacctggagcattccttttcttggtggcagcagcaacaggtgcccactcccaggttcaccgtggtgcagtctggagctgagctgcgagaacgccgtggggccctgagtgagttcggtctccgtgccgtagtcgtcctttcgttcggttactactttccttttacccgtaccgttacggttatggttaagtttgggttagacgaccgaccgggaccccgggagggtacggggtcgttaggagtggaggtggtagtggatacgacgtaccgttaaacgaaactaaacgagtagtagtaggaagaacgtacggtacgaggacgtaagacgtatacgtanacgtacgaccggacgaacgtacacgtaccgaacgtaacgtaacgacgtacccgtaaacgttagacgggtaacgtacgggacggtaccgtaccgtacgtaacgtacgtaccgtaggaacccgtaccggaacccgtaaccctttaacgtttaacgttacccgtaggtaaccggacggtaagttaaacgtacgttttaacgttccggtaaccttacgggttaccggttcccgttaggtacccgttaacccgttaacccggtacggtttccgggttcgggtcccggggttaacccgggg

SEQ ID NO: 245941 - DNA, 563 bp, Homo sapiens
  misc_feature: GYAE6OF01ENZV8.42.49.E05.1.454.CMB.1.raw
  modified_base (385)..(385): a, c, t, g, unknown or other
  misc_feature (385)..(385): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacatcttttccacctacggtatgaattggttgagactacggcccccggaggaggggcttggaggtcgggagtggggatgggatcgagtcccgttaggaaactaaagacgagtatggagagtaagttcgaggcagngtcatcatcaccgcgacactanccacgagtacacgacctanagagaactggagacgcctcgagatcgagaaccggacaccgggtactaactttagttacctggccgacgagtagtatttagtcgtacgacgttggcccttggacgttacgtaacccgcgtcgtttggcggtacccggg

SEQ ID NO: 245942 - DNA, 647 bp, Homo sapiens
  misc_feature: GYAE6OF01EB1XT.42.49.E05.1.454.CMB.1.raw
  modified_base (254)..(254): a, c, t, g, unknown or other
  misc_feature (254)..(254): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtgatggtctcctgcagtgtcttcgtggtactnttcctttccaccgtacgtatgtaattggttagagacgacggcccccgggaggacggggtcgttggaggtcggtaggtcgggagtgggtatcgacggtacccgttaacggaaactaaaacgaggtagtacgtaggaaggagtaacggttcggagggacgaggtacgtacgtatacgaactccgaccggacgaacacgactaccgacgtacgtaacacgacctagtacggtacgaacgtggacgacgtccgtacgagtactacgacggaaccgaaccgtacgtacccttaactttacgttacgtacggccgtacggaagtagtaattgttacgcgttacgtccggttaccgtggtaccgttacgtaaccgacggttcgttcgggcggtacccggg

SEQ ID NO: 245943 - DNA, 653 bp, Homo sapiens
  misc_feature: GYAE6OF01CZACT.42.49.E05.1.454.CMB.1.raw
  modified_base (183)..(183): a, c, t, g, unknown or other
  misc_feature (183)..(183): n is a, c, g, or t
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
  modified_base (412)..(412): a, c, t, g, unknown or other
  misc_feature (412)..(412): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtgcagcagcaacaggtgcccactcccaggttcacctggtncagtctggagctgagctgcagaacgcctggggcctcagtgatggtctcctgcagtgcttntggttacattctttccactacgtntagtattggtgagacacggcccccggtaggagggtcgttaggaggtggagtggggagtggactacgacgtacccgttaacggaaactaaaacgagagtagtaggagtagaacgttcgagggcagagcatacactaccgacgcganacactaccgagtataccgaacgtcctaacagtacggaacgttgaaggcgaccctacgagtactacgtacggaacgaacccgtacccgggtactaaccgttttaacttacgtacggaccgtacggtaaccggaagttaacgtttacggttcggtaccgtaacccgttcggggttcccttacgggtaccttaacccgggttaaccccgttaacgggttccgttcggggtcggggtaaccccgg

SEQ ID NO: 245944 - DNA, 786 bp, Homo sapiens
  misc_feature: GYAE6OF01DDIFR.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtcgcccactcccaggttcacctggtgcagtctggagctgagctgcagagccgtgggcctcgagtgatggtctcctgcagtcgtctttcgtggttactacttcctttacccgtaaccgttacggttattaggttaacgtttgggttacggaagacggtaccgggccccccgggtagggacggggtcgttggtagggtgggtaggtggggtagtgggtactccgtacggtaccccgttaaacggtaaaactaaaacgaggtaaggttagagggtaaggaaaggttaacggttacggacgggacgaggtacgtacgtacgttacgacgtacccgacccgggtaaccggaaccctaaccgtaccgtaacccgaacggtaacggtaaccctaccgtaaccctaacggtaacggttacgggtaacggttacggaacgggtaccgtacccgttacgaacgtacgttaccggtaacggaacccgggaaccgtacccgggtaaccttaaccgttttaagttaccgtcggaccggtacgtaaggtaacgttacgtttagttccgtaacgttccggttacggtccgttcggtaccgttacgttaacccgtaggttcgttcgggtccgggtaccggg

SEQ ID NO: 245945 - DNA, 707 bp, Homo sapiens
  misc_feature: GYAE6OF01EC34L.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtcgtggagctgagctgcagaagccgtggggcctcgagtgatggtctcctgcagtgtcttctggttacattcctttccaccgtacggtatgtaagttggttagagacgacggcccccggaggagggtcgttggagtggagtgggagtggatcacgtaccttaacggaaactaaaacgagtagtagtaggagaagaagttacgaggacagagtacatcaatccgaccgacgacacactaccgacgtacgtacgagtacccgtacgacgtacggtaacgtacggacggacgtacccgtacgaacggtacttacggtaaccggaaccggtaacccgaacccgggtaaccccttaaccttttaacggttaacccgttaccgggacccggtaacggtaaacggtaaccgttaattttaacgttccggtacccggtaaccggtttccgggttacccggttacgggtacccgtttaacggtaaaccccgttacccggtccggttttaggggaccggggtacccgggg

SEQ ID NO: 245946 - DNA, 691 bp, Homo sapiens
  misc_feature: GYAE6OF01DX6M9.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagtggtctcctgcagtgcttcgtggttactattccttttccaccgttacggtatgtaagttggttagacgacgacgggcccccggaggacggggtcgttggaggtgggagtggggtagtgggactcgaacggtaccccgttaacggaaaactaaaacgagtaacggtagtacgggaaggtaaggtaacggttccgagggcaggtagtacagtcactaccgaccggacggacaacactaccgaacgtacgtaccacgtacctaactagtacggaacgtaggacggacgtccgtacgagtactcgtacgaaccgaaccgaccgggtaccttaacgtttaacttacgtacggaccggacggtaaggtaacgttaactttacggttcgtaccgttacggttcgggttcccgtacgggtacccgttacgggtaacccctacgggttccggttgggtccgggtaaccccggg

SEQ ID NO: 245947 - DNA, 724 bp, Homo sapiens
  misc_feature: GYAE6OF01D7BFZ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcaggaacgccgtggggcctcgagtcgattggtctcctgctagtcgtctttctggttactattccttttaccaccttacggtattgtaatttggttgacgtactacgggcccccggaggtaggggtcttggtaggtcggtaaggtggggaatgggattaccgacggtaaccccgttaaacggtaaacttaaaaacgacggtaaagtaagtagggtaagaacgtaacggtttaccgagggacaggacgtacgtaatcaacgtcgaaccggacggaaccaacgtactaccgacgaacgtacagaccctaacgagtacggaacgttggaacgtacgtaccgtacgaacgtaacgtctacggaaccgaaccgaccgtaacccgttaacctttaagttaacccgttggacccggtagtaaaggtacggttaacttttacggtccgttacaacggtttcccggacggttcgggttaccgttaacgtaaccccggtaggtttaccgtttgggttccgggtaaacccgggg

SEQ ID NO: 245948 - DNA, 709 bp, Homo sapiens
  misc_feature: GYAE6OF01CV68L.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccacctggtgcagtctggagctggagctgcagaagccgtggggcctcgagtgagtcggtcctccgtgctagtgtcttcgttaggttactacttccttttaccaccgttacgtatgtaagttggttagacgaacgccgggacccccggaggtacggggtcttggaggtgggtagtgggtagtaggactacgtacgtacccgttaacggaaaactaaacgaggtacgtagtagggaaagtaggtaacgttaccggaaggtacgagtacgtctaagtactacgtaccgaacccggaccgaactaacgtacctaccgaacgaacgtaccacgtacctaacgaggtacgaacgtagggaacgtacgtaccgtacgacgtacgtacgtacgaaccggaccgtacccgggtacttaccgttaacgtacgtcggacgtacgaaggtaagttacgtttacgtcgtaccgtaccggttcgtaccggttacggtaccgttaaccgtaacccggtcggtacgtttcggggtccgggtaacccggg

SEQ ID NO: 245949 - DNA, 774 bp, Homo sapiens
  misc_feature: GYAE6OF01BFJ1A.42.49.E05.1.454.CMB.1.raw
  modified_base (203)..(203): a, c, t, g, unknown or other
  misc_feature (203)..(203): n is a, c, g, or t
tcagtgacgtatgtcacgaccggtgctcgatttagagcgactagcaacacacaaaggggacccaaaaaccacaccccgtccttgggagaatcccctagatcacagctcctcaccatggacgggacctggagcatccttttctggtggcagcagcaacaggtgcccactcccgaggttcacctggtgctagtcgtggagctganctgcagagccgtgggcctcgagtgatcggtctcctgcagtcgccgttgttacggttactcttcctttaccaccgttacggtatacgtaagttggttacgacgtacgaccggtaccccggaggacgggtcttggaggtggagtgggtatggtacgtcgtacgtacccgttaacggtaaactaaacgagtaaggtacgtaggaaggtaacgtaacgtaccggaggacgaacgtacgtacaagtacgtacgtaccgtaccggtaacgactaacgtacctaccggaacgtaaccgtactaaccgacgtacgaacggttaacggacggtacggaacggtacgtaccgtacgtaacggtacgttacggaccggtaaccggaacccgaaccggggttacccttaaacggtttaccgttaacggtaccggtaccgggtaacggtaaggttaacgttaacggtttaccgtacggtaccgtttacccggttcgggttacccggtttacgggtaccccttaaaccgggttaacccggttaaccggttacgggtttacccggggtaccggttaaacccggggg

SEQ ID NO: 245950 - DNA, 589 bp, Homo sapiens
  misc_feature: GYAE6OF01BPWMJ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccctggtgcagtctggagctgagctgcagaagcctggggcctcagtgatggtctcctgcagtgcttctggttacacttctttccaccttacggtatgtaattggttagagacgacgggccccccggaggagggggtcttgacggtggactgggatggatcgagacccttaacggaactaaaacgagtagtacgtaggagagagttccgagggcagagtcatcactcacgcggacacgactccgacgacgtacgacgccctaacgacgtggaacgtggaacgacggcctacgagtactcgtacgaaccgacgaccggaccttacttactacgtcgaccgcggagagtaattagttcggactacggtcggtcctagggcctacgtaacccgacggtccgtttggcgggtaccg

SEQ ID NO: 245951 - DNA, 642 bp, Homo sapiens
  misc_feature: GYAE6OF01AT6LD.42.49.E05.1.454.CMB.1.raw
  modified_base (300)..(300): a, c, t, g, unknown or other
  misc_feature (300)..(300): n is a, c, g, or t
  modified_base (410)..(410): a, c, t, g, unknown or other
  misc_feature (410)..(410): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagtctgagctgcagaagccgtggggcctcgagtgagtcggtctccgtgcgagttgtctttcgtggttacattcctttcctaccgtacggtatcgtaattcgggttanagaccgtcggacccccggagtaggggtccttggaggtggaaggtgggatggatcgacgtacccgtaagaaactaacgagtagtacgaggacgtaagtacgttacaggganaggacgtcagtcgacgtaccaccggacggtaccaacgtacctacgaacgtacgttaacacgtacccgtaatacgacggtaaacgtacggaacggtctaccgttccgaagacgtaccgtagaacccgacgaccgaccgttaaccttagtcgtacgcgtacgaagtgtaactgttcgacgtaccgtcggttaccgacgtacgtaccgttaccgaggtcttgggaccgtaccggg

SEQ ID NO: 245952 - DNA, 691 bp, Homo sapiens
  misc_feature: GYAE6OF01D8QY9.42.49.E05.1.454.CMB.1.raw
  modified_base (467)..(467): a, c, t, g, unknown or other
  misc_feature (467)..(467): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctcagtgatggtctcctgcagtcgctttcgtggttactattccttttaccaccgttacggtatgtaagtttggttagacgacgacggcccccgggaggacggggtcttggaggtggagtgggatggatcgacgtacccgtaacggtaaactaaacgagagtagtaggaagagtaacgtaccgaggacgagagtcagtacacgtaccgaccggacggaacaccacgtacccgaagtacgtacgacgtacctanaacgtacgggaacgtcggtaacggcgtaccgtacgaacgtattacgaacggacgtaccggaaccggtaccttaacgtttaacttaaccgtcggtaccggacggtaacgtaggttaaacgttttacgtaccggtaccggttacggttcccggttaccgttacggggtaccctttaacgggttaaacccgtaccggtttccggttacggggtcgggtaaccccggg

SEQ ID NO: 245953 - DNA, 905 bp, Homo sapiens
  misc_feature: GYAE6OF01EIZ2C.42.49.E05.1.454.CMB.1.raw
tcagtgacgtatgtcacgaccggtgctcgatttagagcgactagcaacgacgacaaagggacccaaaaaccacacccctccttgggagaatccctagatcacagctcctcaccatggacggacctggagcatcctttctggtggcagcagcaacaggtgcccactcccaggttcaccgtggtcgccagtccgtggagctgagcgtgcagtagccgtggggcctgagtgagtggtctcctgcagtgcttcgtggttacagttcctttccaccgttacggtacttcgtaagttggttacgacgtaccgtacgggccccccggtagggtacgggggtccgttaggacggtcgggacggttacggggtaagtgggtacgttacgaacggttaccccggttaaacgggtaaaaccgttaaaaaccggtaggtaacgttaacggtaaccgggtaaaggtaacgggttaaacggtttacccggaaaggggtaaccggtaaacggtacggtaaccgaaacgttacgtaacggttacccgaacccgggtaaccggggaaccgtaaccgtaccgttaaccccgaacggtaaccggttaacccggtaaccggtaccccgtaaacggtaaccgttaacggggtaaaccgtacgggtaaccgggtaaccgtaccgtaaccggttaaacggtacgttaccgggtacggtaaaccccggtaacccggtaccggggtaaccccttaacgttttaaccgttaccgttaccggaccgggtaaccggtaacggttaaccgggttaaacttttacggttaccggtaccgtttaacccggttcggggttaccccgttacggggttacccttaacgggttaaccccgtacccgggtttacggtttcggggtccgggttaaccccggg

SEQ ID NO: 245954 - DNA, 673 bp, Homo sapiens
  misc_feature: GYAE6OF01CEEBC.42.49.E05.1.454.CMB.1.raw
  modified_base (257)..(257): a, c, t, g, unknown or other
  misc_feature (257)..(257): n is a, c, g, or t
tcagtgacgtatgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtgcccactcccaggttcacctggtgcagtctggagctgagctgcagaagccgtggggcctcagtgatggtctcctgcagtgtcttcgtggttactnttctttccaccgttaggtatagtaagttggttagacgaccgaccgggtacccccggagggacggggtcgttggaggtcgggtaggtgggagtaggtagtaccgacggtaccccgttaaaccgggtaaactaaaaacgtaggtaaggtaacgtagggaaggtaagtaacggttccggaaggcgtaagacgtactacgtacacgtacccgaccggacgaaccacaccgtaccgaagacgtaacacggtacacgtaagtacggaacgtggacgtacgccgtacgacgtactcgtacgaccgacgaccgtacctaacgtttactacgcgcgacgaagtatagtttacgcgtataccggttcgtaccgttcggtaccgttacgttaaaccggtccgttaccggttggggtcggtacccggg

SEQ ID NO: 245955 - DNA, 722 bp, Homo sapiens
  misc_feature: GYAE6OF01BWBAF.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtcgatcggtctcctgctagtgtcttctggttaccattcctttccaccgttacggtatgtaacttggttgacggacgacgggcccccggtagggtacggggtcttggacggtggagtgggatggacttacgacggtaccgttaaccggaaataaaacgaggaagttagtagggaagtacgtaacggttaccggaggggtacaaggtacgactacgttacgtacgtaccgaccggacggtaacctacgaaccgttaccgaacggaacgttaaccacggtaccctaacgtacgtacgggtaacgtacgggaacgtcggacctacgaacgtactacgtccggaacgtaccgaccgggtacccttaacgtttacgtaacccggtgacccggtacggtaaacggtacgttagtttacgtcggtaccttaccgggttcgggttacccgtacgggtacccttaaccgggttaacccgtacggttcggttcggtaccggggttacccgg

SEQ ID NO: 245956 - DNA, 658 bp, Homo sapiens
  misc_feature: GYAE6OF01DZSD4.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggtttgagtacgacgggcccccggaggacgggggtcttggaggtgggagtggggatgggactcgagaccccgttaacggaaactaaaacgagagtacgtggagagaacgttccgagggcagagtcatcatcgaccggcgaacaccgactccgaacgtacggtaacacggacctaacgagtcgggaacgtaggaggacgtcccttacaacggtactcgtaacggaacccgtaaccgaccgggtaccccttaacgtttacttaaccgttggaccggtacggaaggtacgttagtttaacgttcgacccgtacggtttaccggtcccgttagggtacccttacgggtaaaccctcggtacccgtttgggtccgggtaacccggg

SEQ ID NO: 245957 - DNA, 727 bp, Homo sapiens
  misc_feature: GYAE6OF01CNOD4.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttctggtggcagcagcaacaggtgcccactcccaggttcacctggtgcagtctggagctgagctgcagaagccgtggggcctcgagtgatggtctcctgcagtgtcttcgtggttactattccttttaccaccgtacggttatagtaagttggttagacgtacgaccgggcccccggagggacggggtcgttggacggtggaggtcgggagtggactcgacgtaccccgttaaggaaacgtaaaacgtaggaacgttaagtacgggaagtaaggtaacgttaccggaagggtacgaacggtacggtactagtaccgtaacgttaccggacccgggaccgggaacctaaccgtaccggtacccgaacggtaacgttaaacccacggtaccctaacgaggtacggaaaccggtggaacggtacgtcccgtaagacgtactacgtacggaccggtaaccgtaccggtacctacgttaacttaccggtgacggtacggaagtagtagtttaacgtcggtacgtacggttacggttccgtaggtacccgttaacggtaaccccgtgggttaccgtttcggggtcggtaccccgggg

SEQ ID NO: 245958 - DNA, 814 bp, Homo sapiens
  misc_feature: GYAE6OF01CVE38.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatcggtctcctgcagtcgtcttcgtacggttactactttccttttaccaccgttacggtattagtaacgtttggttagacggaacgtacgggaccccccgggaggacgggggtcgttaggaggtagggaggtgggtagtgggtactacgtaccggtaaccccgttaaacggaaaacctaaaaacgagtaacggtagttaaggaaggtaaaggtaacggttacgaacgggtacgaagtacggtactaactacgaacgtaccgaacccggcgggtaaacctaaccgtaacctacccgaaacggtaaccgttaaaccgtaaccgtaacccgttaaacgtaacggtacgggaaaccggttaggaacgggaaccgttcccgtaacgtagtaaccgttacgtaaccggtaaccgtaacccggtacccgggttacctaaccttttaacgttaccgtaccggacggaaccggtaaggaacggttaatttacggttaacgtacccgttacggtttccgggttacccggtaccggttaccgttaaccgggttaaacccgttaccgggttaccggttcggggtccggggtaaccccggg

SEQ ID NO: 245959 - DNA, 684 bp, Homo sapiens
  misc_feature: GYAE6OF01BIRM8.42.49.E05.1.454.CMB.1.raw
tcagtgacgtatgtcacgaccggtgctcgattttagagcgactagcaacgacacaaaggggacccaaaaaccacacccctccttgggagaactcccctagatcacagctcctcaccatggacgggacctggagcatcctttccttggtggcagcagcaacaggtgcccactcccaggttcacctggtgctagtctggagctgagctgcagagctggggcctcagtgatggtctcctgcagtgtcttctggttacagttctttccaccgtacggtatgtaacttggttgtacgacgacggcccccggaggacggggtcttggagtggagtggggacgtggatcgacggtcccgttaacggaaacctaaaacgagacgtaagtaggagaaggaacgttaccggagggtacgtaggagtctagtcacgtaccgaccggaccggaaccacacctaccgaacggacgtaaccgacgaccctaacgaacgttacgggtaacttcgggaaggtaccgtcccgtacgaacggtataccgtaacggaccgaaccggaccggtaccctacgtttaacgttacgtacggtccggacggtagtacgtaagttttacgtcggtacttacggttcgggtacccgtggtaccgttacggttaaccccgtacggttccgtttcggtcgggtaaccccggg

SEQ ID NO: 245960 - DNA, 643 bp, Homo sapiens
  misc_feature: GYAE6OF01CJ6W7.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctgagtgatggtctcctgcagtgcttctggttacattcttttccacctacggtatgtaattggttgagacgcggcccccggaggtagggggtcttgaggtggagttcgggagtggatcgacggtaccccttaacggaaactaaaacgagtacgtagtaggaagaggtaacgtcgagggcaggagtacatcgataccgaccggacggaccaccgactaccccgaacggacgtacccgaacgtaccctaacgaacgttacgggaaacgtaggaacggtacgcccgtaagacggtaactcgtacgaaccgtaccgacccggtacctaaccgtttacgtacctcggaccggacgagtacgtagtttagtccgacgtacggtcggttacccgtggacgttaccgaacccgtcgtcggtggtcgggtacccgg

SEQ ID NO: 245961 - DNA, 711 bp, Homo sapiens
  misc_feature: GYAE6OF01CNQC7.42.49.E05.1.454.CMB.1.raw
  modified_base (653)..(653): a, c, t, g, unknown or other
  misc_feature (653)..(653): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttcaccgtggtgcagtctggagctgagctgcaggaacgccgtgggcctcgagtgagtggtctccgtgcagtcgcttcgttggttactacgtttccttttacccacgttacggttatgtaagttggttagacgtacgaccggccccggtagggacgggtcttaggaggtagggtagtgggtagtaggactacgacgtacccgttaaaggaaactaaaacgaggtagtacgtaggaaggtaagtacgtccgaagggacgagtagtactagtactacgtaaccgaccgacgtaacaccgtacgtaccgaacggacgtaaccacgtaccaacgtgtacggaacgtagggaacgaccgtccgtaacgagtacgtccgtaacgaacccggaccgaacccggttacttaagtttacgtaccgtggacccgtaggaacgttaccgttaagtttactaccgggtacttaaccggttcgggttacccnggttaacccgttaacggacccgttacccggtacggtttggggcccggttaaccccggg

SEQ ID NO: 245962 - DNA, 850 bp, Homo sapiens
  misc_feature: GYAE6OF01AP974.42.49.E05.1.454.CMB.1.raw
tcagtgacgtatgtcacgaccggtgctcgatttagagcgactagcaacacacaaaggggaccaaaaccacacccctccttgggagaatcccctagatcacagctcctcaccatggacgggacctggagcatccttttctggtggcagcagcaacaggtcgcccactcccgaggttcacctggtgcagtctggagctgagcctgccagagccgtggggcctcagtgatggtcctaccgtgcagtcgtctttcgtcggttactacgtttcctttaccaccgttacggtagttcgtaaagtttcgggttaggtacgaccggtaccgggaccccccgggtaagggaccggggggttacgtttacgggacgggttagggtaacgtgggggtacgtacgggtacttaccggaaccggttacccgttaaaccgggtaaaccttaaaacggtacggtaacggttaagtacgggtaaagggtaacggttaaccgttccggaaggggtaccgtaaggttaccggtacgaacgtttacgacgttacccggacccgggtacggtaaccgtaccgtaaccgtaccggtaaccggtaaccgttaaccgaaccgggtacctaaaccgtaacggttacggggaaacgttggggaacggtaccggtacccctaaggtacggttacctaccgggttacggaacccggtaacccggtacccgtaccggtttaacctttacggttaccgtacgggaccggtacgtaacggtacgttaagtttaccgtacggttacctacgggttccggttacccgtggtacccgttaaacggtaccccgtaggttccgttacggggttgggtaccccggg

SEQ ID NO: 245963 - DNA, 669 bp, Homo sapiens
  misc_feature: GYAE6OF01B7LGK.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttcgtggttacacgttccttttccaaccgttacggttatacgtaagtttggtttagaagaccgaccggggtccccccgggaaggacgggggtcctttggacggtgggtaacgtggggtatgggtactcgacggtaccccgttaacggaactaaaacgcgaagttagtaggagtaacggtacgttacggaggacaggacgtacgacgtcacgtaccaccggaccgtaacaccgtacgtaccgacgacgtaacacgacctacgtacgtacggaacgtagaacggacgcctagaactacgtacgaacgaaccgtacgaccgtaccgttaattccgtaacgtcgacggacgtagtagttaagtcgttcgacgtacggttcggtaccgtacggtacgttacgtacccgtacggtcttcgggcggtacccggg

SEQ ID NO: 245964 - DNA, 796 bp, Homo sapiens
  misc_feature: GYAE6OF01D9EMQ.42.49.E05.1.454.CMB.1.raw
  modified_base (191)..(191): a, c, t, g, unknown or other
  misc_feature (191)..(191): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaaacaggtcgcccacctcccgaggttccacctggtncagtctggagctgagctgacagacgccgtgggcctcgagtcgagtcgtcctccgtgcgtaggtcggtctttccggttagttacctactttcctttaccctaccgtacgtattagtagtttcggtagacgaccggaccgggtaccccgggagggtacggggtcgttagggtaggttagggaggttagggaggttacgggtacttaccggtaaccggttaaccccggttaaacgggtaaaaaacttaaaccggtaaggaagttaacggaagggtaaaggtaacggtaacggttaccgggaacggggtaacaaggtaacgtacaacgtacgtaacgtacccggaacgtaccgaaccgtaaccacccgtaaaccgacggtaacgtaaccgaccgtaacctaacggtacggttaacgggaaccgtagggacgtaccgtaacctacggaagttacctaccggtaacgaacccgtaaccgtacccggtaacctttaacggttactccggtaacgtacgaacggtaagtacttacgttacggtccgtacgtccggttcgtaccggttacgtaccgtacggttacccacgggttcgttgggtccggtacccggg

SEQ ID NO: 245965 - DNA, 835 bp, Homo sapiens
  misc_feature: GYAE6OF01EU80D.42.49.E05.1.454.CMB.1.raw
  modified_base (222)..(222): a, c, t, g, unknown or other
  misc_feature (222)..(222): n is a, c, g, or t
tcagtgacgtatgtcacgaccggtgctcgatttagagcgactagcaacacacaaaggggacccaaaaaccacacccctccttgggagaatcccctagatcacagctcctcaccatgggacgggacctggagcattccttttcttggtggcagcagcaacaggtgcccactcccaggttcaccgtggtgcagtctggagctgagctgcagagccgtgggcctnagtgatggtcctcctgctagtcgtcttccgtggttactacttccgtttaccaccgttacggttatagttaagtttggttagacgtaaccggtaccgggacccccggggtaaggtacgggggtccgtttagggacggttaggggtagttaggggtagttacggtacgttaccggtaaccggttacccggttaaaaccggtaaaaccgttaaaaacggtaaggtaaacggttaaacggtagggtaaacggtaacgggttaaaccggttaccggaacgggtaacgaacggtagtacgtacgtacgtacctaccggaacccggtacggaaccaccgtaacgtaaccgtaacggtaacgtaacaccggtaacttaacggaacgttacgggaaacgttacgggaaccgttaaccgacggttaacgaacggtgttaacccggtacggaaaccggtaccgtaacccgggttaacccttaaacgttacggttaaccggttacggacccgtaaggtacgtaacgttaacggtttagtccggtaacgttaccggttcggtaacccggttggtaacccttcggttaaaccgtcggttacgggttcgggtaccgggttaacccggg

SEQ ID NO: 245966 - DNA, 695 bp, Homo sapiens
  misc_feature: GYAE6OF01DM2BP.42.49.E05.1.454.CMB.1.raw
  modified_base (398)..(398): a, c, t, g, unknown or other
  misc_feature (398)..(398): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttctggtgcagcagcaacaggtgcccactcccaggttcacctggtgcagtctggagctgagctgcagagcctgggctcgagtgatggtctcctgcagtgcttctggtacattctttccaccgtacgtatagtaagttggttagacgacgacgggcccccggaggacggggtcttaggaggtgggagtaggggatggtactcgacgtaccgtaacggaaactaaacgacgaagtagtacggagtaaggacgttacgacggganagacggtacactacgataccgaccggcgaaccactacgtaacccgacgtaacgtacgtacgtaccctaagacgtacgggtaagtccggtaaggacgtccgtacacgttaccgtactaacggaaccgtaacccgaccgggtacctaacgtttacttaccggtcgtaccggtacggtaacggacgtttaacgttacggttacggtaccggttacggtttaaccggggtcccgtttacgggaccgtttaacccggttaaacccgtccggttaccgtttcggggtaccgggtaacccgggg

SEQ ID NO: 245967 - DNA, 820 bp, Homo sapiens
  misc_feature: GYAE6OF01DJOGB.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccactcccaggttcacctggtgcagtctggagctgagctgcagaagccgtggggcctcgagtgagtggtctccgtgctaggtgtcgtttcttggttactacttccttttaccaccgttaaggttacttagttaagtttgggttagacgtaccggacccggggccccggtaagggtacggggtccgtttaggacggtgggtaggtggggtacgtagggtactaccggtaaccggttaaccccgtttaaaccggaaaacgtaaaacgtaagggtaacgtaaggtaacggggaagtaaacgggtaacggtttaccggagggacgtaaggtacgtaccgtaatacgtaacgtcccgaacccgggacgtaacaccgtacctacccgaaggtacgtaccaacgtccgtaaatacggtacggtaacgtacgggaacgaccggtacctagtaagtacgttaccgaccggaaacccgaaccgacccgggtttaacccttaaagtttaccgttaaccgtacgggaacccgtacggtaaagtaacgttaacttagggtttcccgtaaccgttacggttccggggttacccgtaagggttaaacccggtttaaccgtaaaaccccgggttcgggttcggttttacgggccggggttaaaccccgggg

SEQ ID NO: 245968 - DNA, 677 bp, Homo sapiens
  misc_feature: GYAE6OF01BHXYB.42.49.E05.1.454.CMB.1.raw
  modified_base (199)..(199): a, c, t, g, unknown or other
  misc_feature (199)..(199): n is a, c, g, or t
  modified_base (245)..(245): a, c, t, g, unknown or other
  misc_feature (245)..(245): n is a, c, g, or t
  modified_base (386)..(386): a, c, t, g, unknown or other
  misc_feature (386)..(386): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccactcccgaggttcaccgtggtgcagtctgganctgagctgcagaacgccgtggggcctcgagtgagtcggtcctccgngcagtcgtctttcgttaggttactacttccttttaccacgttacgtatagtagttggtagacgacgacggccccggaggcgggtgtgaggtggagtgggtatggactcgaacgtaccgtaacggaaactaaagagagtagngagagtacgtacgagganacgancacacacgtaccgacgacgactacgactaccgaacgtacgtaacgacgtaccgtaatacggtaacggtaaccgagggtaacggacgttaccgaacggttaacgaccgtttaacgaccggaacctaacgggaccccgtaacctttaaccgtttaagttacccgaggacccgtaacggtaaagttacgtaaacgtttagtcccgtacgtacggttacggttccgtacgtccgtaacgtaccctaggttccggtagggtccggtacccggg

SEQ ID NO: 245969 - DNA, 842 bp, Homo sapiens
  misc_feature: GYAE6OF01BDDRK.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtctggagctgagctgcagacgccgtggggcctcgaggtgagtcggtcctcctggccgagtcggtctttaccgtggtttactagttcccttttaccgaccgttaacggttagttagttaacgtttggttagtaacggaaccgaccggggaccccccggggaagggacgggggttaccgtttacgggtagggttaggggtaggttcgggggaagttagggtaacttccggtaaacggtaacccccgtttaaacgggaaaaaccgttaaaaacgtaaggtaacggttaaggttaacgggggaaacgtaaacgggttaaaccggttacccgggaacggggtacgtaaacggggtaacgtaccgtaaccgttaacgtaaccgtacccggaaccccggtaaccggaacccaacggttaaccctacccgaaggtaaaccggtaacccgtaaccgacctaacgtaacgtacgggtaaacgtcgggaacggaccggtaccgtaacgaacgtacgtaccggtaggaaccgtaccggacgtaacccgtacgtttaaagtccggtaccgaacgcgggtaagtacgtaagttacggttccacgttacggtccgtcggtaccggtaccgttcggaaccccttggtcgtttacggggcgtaacccggg

SEQ ID NO: 245970 - DNA, 605 bp, Homo sapiens
  misc_feature: GYAE6OF01EZHUZ.42.49.E05.1.454.CMB.1.raw
  modified_base (221)..(221): a, c, t, g, unknown or other
  misc_feature (221)..(221): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctnagtgagtggtctcctgcagtgcttcgtaggttacattccttttccaccgttacggtatgtaattggttgagacgacggcccccggaggagggtcgttggacggtggagtggggatggactcgacgtacccgttaacggaaactaaaacgacgtaagtagtaggaagaagtaacgttcgaagggcaagagtacatcatcgaccgcggacacgtactccgacgacgtacacgacctagagtacggaacgtaggacggacgtccgtacagtactacgtacgaaccgaccgtaccggtacctaacgttacgttacgcgacgacgtagagtacgttagtcgactacggtgtaccgtgacgttacgaccgtacgtcgttggcggtaccgg

SEQ ID NO: 245971 - DNA, 664 bp, Homo sapiens
  misc_feature: GYAE6OF01CFZWA.42.49.E05.1.454.CMB.1.raw
  modified_base (158)..(158): a, c, t, g, unknown or other
  misc_feature (158)..(158): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
tcagtgacgtatgtcacgaccggtgctcgatttagagcgactagcaacacacgaaaggggacccaaaaaccacacccctccttgggagaatccctagatcacagctcctcaccatggacgggacctggagcatccttttctgggtggcagcagcaacnggtcgcccactccaggttcacctggtgcagtctggagctgagctgacaggacgccgtggggcctcgaggtgagtcggtcctccgtggcaggttcgtcttacgttcggttaactactttccttttaccacgttacggtatggtaagttggtacgagaccgtaccgggccccggaggtcgggtcttaggaggtagggtagtcgggtagtcggataccgacgtaccgttaacggaaactaaacgagtagtaggagaagagtacgtacgaggcagacgtanacgtnacgtacgaccgacgtacaaccgtagaaccggtaacgacgtacgtaccgacgtaaagtgtaacggaacgtgggaaccgtgaccgtagatacgtcgtaacggaccttaccgacgttaccttaacgttacgacgttacggcgtaagaacgtacgttattacgtaccgtagtaccgtgggttaccctaggtacctaccggaccgtgtacggttgggaccggttaccgg

SEQ ID NO: 245972 - DNA, 679 bp, Homo sapiens
  misc_feature: GYAE6OF01AY7C3.42.49.E05.1.454.CMB.1.raw
tcagtgacgtatgtcacgaccggtgctcgatttagagcgactagcaacacacaaaggggacccaaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactattcttttccacctacggtatgtaattggttgagtacgacggcccccggaggacggggcttggaggtggagtgggatgggactcacgtcccgttaacggaaacctaaaaagaggaagtagtacggaagaaggtaacggttcgaagggcaggtagtcatcataccacccggacggacacctatacccgacggtaacgtaaccacgacctaaccgagttacgggaaacctgggtaaggaccgtccctacgtaaggtaaccgttcgttacgaaccggaacccgaaccggtaccctaaacttttacgttacctcgggccgtaacggtaacggagtttaacgtttagttacggtactaccggttcgggttcccttagggtacccgttaacggtaaccctaaccggttcggttgggttccggggtaacccgg

SEQ ID NO: 245973 - DNA, 792 bp, Homo sapiens
  misc_feature: GYAE6OF01C7WJ4.42.49.E05.1.454.CMB.1.raw
  modified_base (189)..(189): a, c, t, g, unknown or other
  misc_feature (189)..(189): n is a, c, g, or t
  modified_base (785)..(785): a, c, t, g, unknown or other
  misc_feature (785)..(785): n is a, c, g, or t
tcagtgacgtatgtcacgaccggtgctcgatttagagcgactagcaacacacaaaggggacccaaaaaccacacccctccttgggagaactcccctagatcacagctcctcaccatggacgggacctggagcattccttttcttgggtggcagcagcaacaggtcgcccactcccaggttcacctggtncagtctggagctgacgctgacagaacgccgtgggcctcgagtgagtcgtctcctgcgagtcgtcttcgttaggttactacgtttcctttaccaccgtaggtatagtaaggttggttacggacgaccgaccggggccccggtaaggggtacgggtcgttaggtaggtacgggtacggttagggaggtaccgggtaacgtaccggtaaccggtaacccccggtttaaaaccggtaaacgttaaaaaaccgtagggtaagttaacggtaacggggtaaacggaaaggttaaacccgggttaccggaaacggggagtaacggtaacggtaacttaccgtaaaccgtacgttaaccggaacccgggtaccgggaaacctaacccgggaacttaaccccggaacgttaccggtaaacccgacggttaaaccctacgtaaggtaacgggtaaccggtagggtaacgccgtaacgtacgtaacgacttacgaacggtaacccgtaccgaaccgttacctaagtttaaccttacggcgaacggtacgtataggtatttacggtggactacggtcgtacgtcggactacgactacgtgttacgggngtaccgg

SEQ ID NO: 245974 - DNA, 884 bp, Homo sapiens
  misc_feature: GYAE6OF01BVKZY.42.49.E05.1.454.CMB.1.raw
tcagtgacgtatgtcacgaccggtgctcgatttagagcgactagcaacgacaacaaaggggaccccaaaaaccacacccctccttcgggagaatcccctagatcacagctcctcaccatggacgggacctggagctatccttttctggtggcagcagcaacaggtcgcccactcccaggttcacctggtgcagtctggagctgaggctgcgagaagccgtggggcctcgagtgagtggtctccgtagcacgtgtcttcgtggttactacttctttaccgaccgttacggtataggaacttggtgacgacgtacgggtacccccgggaggtacggggtcgttaggaggtagggtaggtcggggacgttgggtacgtacgtacggtaccccgttaaacggaaacgtaaaaacctaggtaacggttaacgtaggggtaaacggaacggtaacggttaccggaacggggaactaacggtacggtactaacgtacgtaaccgttaacccgacccgggtaccggggtaacccaaccggtaaccgtaacccggtaacggtaaccggttaaacccggaaccgtaccgtaaaccgtaacggttaaccgggaaaccggttacgggaaacgggtaacccgtccgtaaccggttagtaaccgttaaccggaccgtaacccggtaacggtaccccgggttacccgttaaaccgtttaccgggttaacgtacccgggacggggttaaccggtaacggttacggttaaaccgttacggtttccggtaacccgttaccgggtttaacccggttccccggttaaccgggtaacccggtttaacccggttaaccccgttacgggttaccccggtttacggggtccggggttaacccccgggg

SEQ ID NO: 245975 - DNA, 654 bp, Homo sapiens
  misc_feature: GYAE6OF01BL0JY.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttcgtgttacattctttccacctacggtatgtaattggttagagacgacgggcccccggaggacggggtcgttaggaggtgggtagtggggtatgggactcgacgtacccgttaacggaaacgtaaaacgagaaggtagtagggaagtaaggtaacgtccggagggtacaggtagctaagtcgaacgtaccgacccggaccgggtaacaaccgtacgtacccaacggtaacgtacaacgaccgtaactaagtacgggtaaacttcgggacggtaaccgtccgtacagtactacgtaagaaccgacgaccggtacctaactttactacgtcgacggcgacgtagagtttagtcgtactacggttcggtaccgtcggtcgtacggtaacccgaggttcgttgggcgggtaaccgg

SEQ ID NO: 245976 - DNA, 619 bp, Homo sapiens
  misc_feature: GYAE6OF01A3WKU.42.49.E05.1.454.CMB.1.raw
  modified_base (552)..(552): a, c, t, g, unknown or other
  misc_feature (552)..(552): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttcgtggttacattccttttccaccgttacggtatgtaattggttagagacgtacggcccccggaggaggggtcttggacggtggagtgggatgggactcgacgtacccgttaacggaaactaaaacgaggagtacgtagggaagaggaacggttcgagggacgagtagtacagtcagtaccgaccgacggacacgactccgaagtacgtacacgtcctaacgagtacggaacgtacggacgtacgtaccctagacgtactcgacgtaaccgaccgaccggtaccctacgtttacgttacgcgtaccggngaacgtagtattacgtcgtacacggttcgtccgtggaccgttacgaccacgtcgttcggtggaccgg

SEQ ID NO: 245977 - DNA, 717 bp, Homo sapiens
  misc_feature: GYAE6OF01BUK8V.42.49.E05.1.454.CMB.1.raw
  modified_base (188)..(188): a, c, t, g, unknown or other
  misc_feature (188)..(188): n is a, c, g, or t
  modified_base (408)..(408): a, c, t, g, unknown or other
  misc_feature (408)..(408): n is a, c, g, or t
  modified_base (676)..(676): a, c, t, g, unknown or other
  misc_feature (676)..(676): n is a, c, g, or t
  modified_base (701)..(701): a, c, t, g, unknown or other
  misc_feature (701)..(701): n is a, c, g, or t
tcagtgacgtatgtcacgaccggtgctcgatttagagcgactagcaacacacaaaggggacccaaaaaaccacacccctccttgggagaatcccctagatcacagctcctcaccatggacgggacctggagcattccttttcttggtggcagcagcaacaggtgcccactcccgaggttcacctggtncagtctggagctgagctgcagacgccgtgggcctcgagtgagtcggtcctcgtgcgtagtcgtcgtttacgtggttaacctcgtttcccttttaccgacgtacggttatagttaagttggttagacgacggtacccgggaccccggaggtacgggtcgttagaggtcggagtgggtactagggactacgtacgtaacccgttaaacgaaacttaaacggngtaaggttagaggaagtacggtacgttaccggagggctaaggtacgtacacgtctaacggtacccgcggaacgttacaccgtacgacccgtaacggacgtaccgaacgtacccgtagtaaccgtacgggaacgtacgggaccgtaccgtaccgttaacgacggtaccttacgggaaccggaaccctacggtacccttaaccgtaacgtttacacggtgcccggtaaagacgttacgttaacgttagcgtaccgttcgtcggttacccncggttaactaccgtactcgggttcncggggtggtaacccgg

SEQ ID NO: 245978 - DNA, 795 bp, Homo sapiens
  misc_feature: GYAE6OF01EGD1V.42.49.E05.1.454.CMB.1.raw
tcagtgacgtatgtcacgaccggtgctcgatttagagcgactagcaacacacaaaggggacccaaaaccacacccctccttgggagaactccctagatcacagctcctcaccatgggacgggacctggagcattccttttcttggtggcagcagcaacgaggtcgcccactcccgaggttcacctggtgcagtcgtggagctgagctgcagaacgccgtgggcctcgagtgagtcggtctccgtgcctaggtgtcgtttcgttcggttactactttccttttacccgaccgttaacggtagttagtaacgtttgggttagaacgtaccgaccgggacccccgggagggtacggggtcgttaggaggtgggtaggtgggagtggactcgtaccgtaccgttaaccggaaaactaacgaagtacgtagaggagtaacgtacggtacgacgggatacggtatcgtaactacgacgtacccgaccggaccggaacaaccgtaccacgacgtaacgtactaccgaacgtaacacggtacgaacgtacggacgggtactaccgtacgtaacggtacttaccggacggaaaccgtaaccccggtacgttaacccgttaacgttttaacgttaccgacgggtaccggttaacgggaaacggttacgttaacggttttaccgttaacgggtaccccgtttacgggttccccgttacccggggttaccgggaaccgtttaaacccggttaaaaccccggttccgggtttacccgggtttaaggggtacccgggggttaacccggg

SEQ ID NO: 245979 - DNA, 616 bp, Homo sapiens
  misc_feature: GYAE6OF01EA94B.42.49.E05.1.454.CMB.1.raw
tcagtgacgtatgtcacgaccggtgctcgatttagagcgactagcaacacacgaaaggggacccaaaaaccacacccctccttgggagaatcccctagatcacagctcctcaccatgggacgggacctggagcattccttttcttggtggcaggcagcaacaggtcgcccacttccccaggttcacctggtgcagtctggagctgacgctgcaggagccgtggggcctcgagtgagtcggtctcctgcagtcgcttcgtgttactagttcttttccaccgttacggtatagtagttggtagacgacgaccggcccccggaggacggggtcgttggacggtggaggtgggtagtggtacgtcgacgtacccgttaacggaaactaaacgagtagtagtggagagtacgtacgaggacgagacgtacatacgacgtacgaccgacgacacacgtccgacgtagtaccgagacctagtacgtaggtaacgtggacgacgtacctagagtactcgtacgaaccgaccgaccggtactacgttacgtacgacggacgagagtagtagttagtcgacgtacgtcgtcgtgccgttacgtaccgtgtcgttgggtcgtaccgg

SEQ ID NO: 245980 - DNA, 827 bp, Homo sapiens
  misc_feature: GYAE6OF01AXXTF.42.49.E05.1.454.CMB.1.raw
  modified_base (256)..(256): a, c, t, g, unknown or other
  misc_feature (256)..(256): n is a, c, g, or t
tcagtgacgtatgtcacgaccggtgctcgatttagagcgactagcaacacacaaaggggacccaaaaaccacacccctccttggggagaatcccctagatcacagctcctcaccatgggacgggacctggagcattccttttcttggtggcagcagcaacaggtcgcccactcccaggttcaccgtggtcgcagtcgtggagctggagctggcagacggtccgtcggggcctcgagtgtatcggtctaccgtgacngttgtcctttcgtaggttacctacgtttccttttacccaaccgttacggttaagttggtaagtttgggttacggaacggaccggaccgggtacccccggggtaaggggtacgggggtcgttagggtacgggtacgggtaggttaggggagtagggtacgttaccggaaccggtaacccgttaaacgggtaaaaccgttaaaaccgaggtaacggtaaggtacggggaaaggtaacggtaaccgggttaccgggaacgggtacggaacggttaacggtacctacgttaccggaacgtacccggaccggaccggtaaccacgtaaccgtaccgaacgaaacgttaccaacgtccgtaaacgagtacgggaagttacggaggtacctcgtacacggtactaccggaacgaccgaaccggacccgttaaaccgtttacgttaacgttaccgtagtaacccgggtcgaagttaaacgttagttacgttaacccggtgtaccgggtttaccggtaccggtacggttaccgttaacccggtacgtaaccgggtttcggttacgggtcggtacccgggg

SEQ ID NO: 245981 - DNA, 649 bp, Homo sapiens
  misc_feature: GYAE6OF01DLF4Q.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgactgtgctttcgtggttactagttcttttaccaccgttacggtatcgtaatttggttggaacgtacgacgggcccccggaggacgggggtcttaggacggtggagtgggatggatcgacgtccttaacggaaactaaaacgagtacgtacgtggaacgtaaggtaacggttccgaagggcaaggacgtcaatcgaacgtaccgaccggtacggacacgactccgaacgacgtacgacgacctagacgtacggaacgttaggaacggtacgtaccgtacgaacggtctacggtacggaacccgaccgacccggtacctaactttacgtaccgtcggacgacgtagacgtatttacgtcgacgtacggttcgtaccgtaggtactacgtaacccgagttccgttagcggtaaccgg

SEQ ID NO: 245982 - DNA, 791 bp, Homo sapiens
  misc_feature: GYAE6OF01EK54Y.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttgatggcagcagcaacaggtgcccactcccaggttcacctggtgcagtctggagctgagctgcagaagccgtggggcctcgagtgatggtctcctgcagtgtcttcgtcggttactacttccttttacccaccgttacggttactagtaagtttggttagaacggtaccgaccggggacccccggtaggacgggggtcgttaggagggttagggtaggttacggggtagtagggtacgtacccgtaacggtaccccgttaaacgggtaaaaccgtaaaaacgagggttaacgtaaggtacggggaaagtaacggtaacggtttacccggagggtaccgaaggtacgtactactacgtactaccgaacccggtacggaacctaccgtaacctaccgtaaacggtacgtaaacgaaccgtaacccgttaagaacggtttacgggaaaccgtacggaacgggtcctacccggtaagtacgtaccgttaacgtaaccgggaacccgtaccggtaacccgggtaccttaaacgtttacgttaaccggtcggaccggtaacggtacggtaaagtttacgtttaacgtccgtacggtcgttaccgggtaccgttacggtaccgttacgtaaacgtcggttcggttcggtacccgggg

SEQ ID NO: 245983 - DNA, 697 bp, Homo sapiens
  misc_feature: GYAE6OF01AQ6D5.42.49.E05.1.454.CMB.1.raw
  modified_base (528)..(528): a, c, t, g, unknown or other
  misc_feature (528)..(528): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtctggagctgagctgcagacgccgtggggcctcgagtgagtcggtcctccgtgctagtgtcttcgtcggttactcttcctttacccgaccgttacggtatgttaagttggttagagaccggaccgggacccccggagggacggggtcgttaggacgggtggaggtgggtagtaggtactacgacgtaccccgttaacggaaactaaacgacgtaggtagtagggaagtacggtaacgtacggagggtacaggtacgtacaccgtctaacgtccgaccggaccgaactaccaccgtaccgaacggtacgtaacccgacgtacaacgtagtacggtaacgngggaacgtacgacccgtagacgacgttacggacgaaccgtaccgaccgtaccttaacgttagtaccgtacgcggtaacgtagtacgttaattacgtacgtccgtacggttcccgtacggttcgtaaccttaccgggtaacccgtaggttcggttcgggcggtacccggg

SEQ ID NO: 245984 - DNA, 1161 bp, Homo sapiens
  misc_feature: GYAE6OF01CJS2F.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacgaggtgcccactcccaggttccacctggtgcagtctggagctgagctgcagaagccgtggggcctcagtgagtggtctccgtgctagtcgtcttcgtcggtttactacgtttcccttttacccgtaacccgttaacgggttaagttcggttaaaacgtttttggggtttacggtaacgggtaaccggacccggggggtaccccccccggggtaaggggtaaccggggggggttaccgttttagggggaaccggggttacggggtaacggttaggggggaaacgtttggggtaaccgtttacccgggaaacccgggtttaaaccccccggttttaaaaccggggtaaaaaaccccgttaaaaaaaaccggtaacgggttaaaaccggggtttaaaggttaaccggggggtaaaagggttaaaacggggttaaaaccgggttttaccccgggaaacggggggtaaccgtaaacggggttaaccggttaccggtaaacgtttaacccgtaaaccggtttaccccggaaccccggggttaaccggggaaaccctaaacccggttaaaccgttaacccccggtaaacgggtaaaacccgttaaccccggtaaacccgggttaacccctttaaaacgggtaaccggttaaacggggtaaaaccccggtttaggggaaacccggggtaacccggtaacccccggtttacggaaaccgggtaacccgtttacccgggttaaccggaaacccgggtaaacccccggtaacccggggttacccctttaaacgttttaaaccccggtttaccggtacggggtaacccggttaaccggggtaaaacggtttaacgggttttaaacgttttacggttacccgggtaaccgtttaaacccggggttcccgggtttaacccggttacccggggtttaacccgtttaaaccccggggttaaaccccgtacgggttttcccccgggttttagggggttaacccccggggttaacccggggg

SEQ ID NO: 245985 - DNA, 702 bp, Homo sapiens
  misc_feature: GYAE6OF01DGNNS.42.49.E05.1.454.CMB.1.raw
tcagtgacgtatgtcacgaccggtgctcgatttagagcgactagcaacacacaaaggggaacccaaaaaccacacccctccttgggagaatcccctagatcacagctcctcaccatggacgggacctggagcattccttttcttggtggcagcaagcaacaggtcgcccactcccaggttccacctggtgcagtctggagctgagctgcagaagccgtgggcctcgagtgtactggtctccgtgctagtgtcttcgttggttactactttccttttaccaccgttaacggttatagttaagttggttagaacgtacgaccgggcccccggagggacggggtcttaggaggtaggagtcgggagtggatccgaccgtaaccgtaacggaaaactaaacgagtaacgtagtaggagtaagtaacggttacgaaggacaggatactactacacgtaccgaccggtcgaacaccgactaaccgacggtaacgtaaccgacgtaacctaacgtaacggtacgtaagtacgggaacggactccgtactacgtactcggtaacaaccggaccctaacggtacctaacgttacgttacgtccggacgtagtaagtacgttagttacgttccggacgttacgttccgtaccggtacggtacccgttaacgttaaccccgtacgggttcgttcgggtcgggtaaaccccggg

SEQ ID NO: 245986 - DNA, 790 bp, Homo sapiens
  misc_feature: GYAE6OF01ASHE8.42.49.E05.1.454.CMB.1.raw
tcagtgacgtatgtcacgaccggtgctcgatttagagcgactagcaacacacaaaggggacccaaaaaccacacccctcttgggagaatccctagatcacagctcctcaccatgggacgggacctggagcatccttttctggtggcagcagcaacgaggtcgcccactcccgaggttccaccgtggtgcagttctggacgctgacgctgacagaacgccgtgggcctcgagtgagtcggtcctcgtcgctaggtcgtcttcgtggttaccactttcctttaccaccgttacgtatgtagttgtgagacgtacggccccggtaggacgggtcgttagagggtcggtagtgggtaagtggtactcgtaacggtacccgttaacgggaaaacttaaacgaggtacggttaaggtacgggaaacgtaacggtaacggtttaaccggaacggggtaccgtaacggtacggttaacgacgtttaacggtaaccgtttaccggaaccccgggtacgggaacctaaccgttacccgtaacccggtaacgggtaaccgttaacccgaacggtacccgttaacgaaggttacgggaaaccgttcgggaaacgtaccggtacccgtaggtacgtacgttacgtacggaaccgtacccggtacgtacccttaacgtttacgtaccgtacgaccggtacggaaggtacgtaacgttttacggcgtaaccgttacggtcggttacccggtagtacccggtttaacgtaccggtacccgttcggttcggggtacgtaacccgggg

SEQ ID NO: 245987 - DNA, 735 bp, Homo sapiens
  misc_feature: GYAE6OF01C92CU.42.49.E05.1.454.CMB.1.raw
  modified_base (392)..(392): a, c, t, g, unknown or other
  misc_feature (392)..(392): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtgcagcagcaacaggtgcccactccccaggttccacctggtgccagtcgtggagctgagctgcagaagccgtggggcctcgagtgagtggtcctccgtgctagtgtcttcgttcggttactactttccttttacccaccgttacggtataggttaattggttagaacgacgaccgggcccccggaggacggggtcttaggaggtggagtgggatggactacgacgtaccgtaaaggaaacctaaaacgngtaacgtagtaggaacgtaaggtaacggttccgaggacgaaggtacggtactaactacgtaacgtaccgaacccggcggaacctaaccgaccgtaacccgaacggaacgtaaccgacgtacctaacgaggtacggtaacgtgggaaacgcgtacccgtacgaaggtaccttacgtaccggaaccgaaccggtaaccccgtccgttaaactttaacgtttaccgcgggtaccggaagtaaggaccgttagtttacgtaccggtacttacgggttccggttaccggttggtaacccgttaccggtaaaccctcggtttaccgggtgggttccgggtaacccgggg

SEQ ID NO: 245988 - DNA, 866 bp, Homo sapiens
  misc_feature: GYAE6OF01CDHCH.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcgagtgatggtctcctgctagtgtcttcgttggttatacttccttttacccgaaccttacggttattaggtaaagtttggggtttacgaaggaccgtaccggggacccccccggggtaaggggtaacggggggtccgtttagggaagggttgggtaagggttggggtaagttcggggtaagttaccggtacggtaacccccggtttaaacgggaaaacgttaaaaaccgaggtaaggttaagtaggggaaggtaaaggtaaacggtttaccggaaggggaccgtaagggtaacgtacgtaacgttaccgaacgtacccggaacccgggtaccggaacccgtaaccgtaaccgttacccgaaacgggttaccgtaaaccgtaccgtaacccgttaaacaacggttaacgggaaaccgttagggaaccgggtaccgtacccgtacgaacgtacggtacgtaacgggaaccggaaccggtaaccgggtacccttaaacgttttaacgttaccgtacggtacggaccggtaaaggtagtttaacggtttaagtccggtaccgttaacccggttccggggttaccctcggggttaacccttaccgggttaacccgtacccgggttacggtttcgggaccggggtaccccggg

SEQ ID NO: 245989 - DNA, 604 bp, Homo sapiens
  misc_feature: GYAE6OF01EWCF0.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccgtacggtatgtaattggttgagacgacggcccccggaggaggggcttggaggtggagtgggatggatcgacgtcccgttaacggaaacgtaaaacgacgtagtacgtaggaagagtaacgttaccgagggcgaaggagtacatacacgtacgaccgcggacacacgtaccacgtagtacacgacctacagtacggaactaggaggacgccgtacgacgtactcgtacgaaccgacgaccggtacctaactttactacgtcgcgacgaggtagtagttacgtcgtacgtacgtcggtaccgtggtaccgttacgtaccgtacgtcggttggcgggtaccgg

SEQ ID NO: 245990 - DNA, 722 bp, Homo sapiens
  misc_feature: GYAE6OF01B0J87.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctgggcctcagtgatggtctccgtgcagtgcttcgtggttacagttctttccactacggtatagtaagttggttgagacgtacggacccccggaggacgggggcttggagtggagtgggatggatcgacgacccgttaacggaaactaaaacgagtagtaacgtaggaagaaggtaacgttaccgaaggggtacctaagggtaacgtacgtaacgtaccgaacgttaccgaacccggtacgggaacctaacgtaaccgttaacccgaacggtaaacggtaacccgaacgtaaccccgttaaacgaacggtacgggtaaaccgttacgggaaacgggtaaccgtacccgtaacgaacggtaacgttcggtaacgtaaccggaacccgaccgggtaccctaacttttaaacgttaccgtacggtaaccggacggtaagtaagtaagtttacgtgtacctacggttcgtaccgtaggaccttacggaacctacgtcggttacggcgggtaacccgg

SEQ ID NO: 245991 - DNA, 667 bp, Homo sapiens
  misc_feature: GYAE6OF01BK8XQ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacgacggcccccggaggagggggtcttggaggtggagtgggagtggactcgagtaccccttaacggaaactaaaacaggtagtacgtagggagaacgtaacgttcgagggtacaggacgtacatacaactccgaccggacggaccaacgactaccgacgtaagtaaccaagtaccctaacgacgttagggaaacctggaaggacgtccgtaacgagtaacgttcgtaacggaacgaaccgaccgggtaacccttaactttaacgttaacctcggaccgaggtaacgtagtaacgtttagttcgaccttaccggtcgggttaccccttgggtacccgttaacggtaacccgttacccggttcgtttggggtccgggtacccggg

SEQ ID NO: 245992 - DNA, 700 bp, Homo sapiens
  misc_feature: GYAE6OF01AK1QA.42.49.E05.1.454.CMB.1.raw
  modified_base (251)..(251): a, c, t, g, unknown or other
  misc_feature (251)..(251): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgatggtctctgcagtgcttcgtggttacnttccttttccaccttacggtagtgtagtttggtgagtccgacggcccccggaggcggggtcttagaggtggagtgggatggactcgacgtaccccgttaacggaaactaaaacgacggtaagtaaggtagggaagtaacgggtaacggtttacccggacgggtacgtaaggtacgtacgtacttaccgacttaccgaaccgggtacgaaccgacgacctaccgaacggacgtaaccgacggaccctaacgtaagtcgggaaacttagggaacggaccgccgtacgaatacgtacggtacgaacccgtacgaccgtccgtaactttacgtaccgtcgaccgacggaacggtaagttacgttacgtcgtaccgaccggtttcgggacccgttacgggtaccttacccgggtaacgttaccggttccggtccgggttcggggtaaccccggg

SEQ ID NO: 245993 - DNA, 628 bp, Homo sapiens
  misc_feature: GYAE6OF01AQLS4.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtgggggcctcgagtgatggtctccgtgcagtgcttctggttacattcctttccacctacggtatgtaattggttgacgacgacggcccccggaggtacggggtcttggaggtggagtggggtatgggactcgaacggtacccgttaacggaaactaaaacgaggaacgtaagtagggaacgaaggtaacggttacccggaggggaccaaggtacggtacagtcacgtaccgaccggacggaacaccacgtaccgaacgtacgtacacgacctaacgagtcggaacgtggacggacgtccgtacagtactcgtacgaaccggacgtaccggacctaccttacgtacctgacgcggagtacgtattagtcggctacggtcggtccgtggtctacgtacctagtcgtgttgggtcggg

SEQ ID NO: 245994 - DNA, 776 bp, Homo sapiens
  misc_feature: GYAE6OF01ERMFS.42.49.E05.1.454.CMB.1.raw
tcagtgacgtatgtcacgaccggtgctcgatttagagcgactagcaacacacaaaggggacccaaaaccacacccctccttgggagaatcccctagatcacagctcctcaccatggacgggacctggagcattccttttcttggtggcagcagcaacaggtcgcccactcccaggttcaccgtggtgcagtctggagctgagctgcagagccgtgggcctgagtgagtggtcctccgtgcaggttcgtcttcgtaggttactctttccttttacccgaccgttacggtagtaggtaagtttcgggtagacgaacggaccgggacccccgggtaggacggggtcttggacgggttggagtggggagtggtactcgacgtacccgtaacggtaaactaaaacgaggtagtacgagggaacgaagggttaacgttaccgggaagggtacgaacggtagtaccgaagttaccacgtacccgaaccgggacgaaccaaccgtacgtaccgaacggtaacgtaccaacggtccctaacgtacggttaacgggaacgttagggaaccgggtactacccgtacgaacggtaccttaggacccggaaccggaacccggtaccgtaacccgtttaaacgtttacgttacccggacggtaaccgtcggtaaagtacggttaaacgttttcggtaccgtaccgttaccggttcgggttaccgttacccggtaacgttaacccgggttaaacccgttacggtacggttacgggtcccgggggtaaccgg

SEQ ID NO: 245995 - DNA, 629 bp, Homo sapiens
  misc_feature: GYAE6OF01ELWQ4.42.49.E05.1.454.CMB.1.raw
  modified_base (252)..(252): a, c, t, g, unknown or other
  misc_feature (252)..(252): n is a, c, g, or t
  modified_base (508)..(508): a, c, t, g, unknown or other
  misc_feature (508)..(508): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttcgtgttactnttcctttccaccttacggtatacgtaatttggtagagacgacgggcccccgggaggagggggcttggaggtgggagtgggagtgggatcgacgtaccccgttaacggaaactaaaacgagtagttaagtagggaagtaaggtaacggttccgaacgggacgtagtaagtacagttacacgtacgacccggacggaaccaccacgtaccaacgtaacgtacacggacctaacagtaggaacgtggacggacgtccanagtactcgacggaaccgaccgaccggtacctaacttacgttaactacggaccggacgagttagtatttagtcgactacggtcgtccgtggacttacgtaccgtagtcgttggtcggtacgg

SEQ ID NO: 245996 - DNA, 706 bp, Homo sapiens
  misc_feature: GYAE6OF01DBO1G.42.49.E05.1.454.CMB.1.raw
  modified_base (238)..(238): a, c, t, g, unknown or other
  misc_feature (238)..(238): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtcgtggagctgagctgcagagccgtcggggcctcgagtgagtggtctccngcgtagtgtcttcgttcggttactacttccgttttacctaacccgttacggttattaggttaacgtttgggttaggacgtaccgacgggccccccgggaggtacggggtcgttaggtagggtaggtaggtgggtagtcggtagtacgacgtacccgttaacggtaaaacgtaaacggtagtaggtaggtaggaacgtaaggtaacgttaccggagggtacaaggtaacgtactagtaacgtaccgtaaccggacccggacggaaccaccaaccgtacccgaacgtacgtaacccgaccgtaccgtaacgtacggtaacgtaacgtaggaacggacctaccgacgaataccgtacgacgaaccgacgtacccgaaccttacgttaactacgtacgagacgagtagttataggtcgtacgtacgtccgtacgtcgtactaacggtaccgtaggtcgttcggcgggtaccg

SEQ ID NO: 245997 - DNA, 678 bp, Homo sapiens
  misc_feature: GYAE6OF01D5QTY.42.49.E05.1.454.CMB.1.raw
  modified_base (261)..(261): a, c, t, g, unknown or other
  misc_feature (261)..(261): n is a, c, g, or t
tcagtgacgtatgtcacgaccggtgctcgatttagagcgactagcaacacacaaaggggacccaaaaaccacacccctccttgggagaatcccctagatcacagctcctcaccatgggacgggacctggagcattccttttcttggtggcagcagcaacaggtgcccactcccaggttcacctggtgcagtctggagctgagctgcagagcctggggcctcgagtgtagtggtctccgtgctagtgtcttcgtggttactnttctttccacgtacggtatgtagttggtgagaccgacggccccggaggagggtcgttggaggtggagtgggatggatcgacgtaccgtaacggaaactaaacgagtagtacgtaggaagagtagttaccggaaggcgtaaggacgtacacgtcgtaacgtaccgaccggacgaaccacgacctaccgaacgagttacgacgtacctaagagtacgggaacgttaggaacggtaccgtcgtaacgagtacgtaccgtaagtaacccggacggtaacccggtaccttaacgttttacgttaaccgtggacccggtagaaccggttagtaaacttttacggcgtaacccgttacggccggtttccgtaggttacctaacccggttaaccgtacgggttccgtttagggcgggtacccggg

SEQ ID NO: 245998 - DNA, 862 bp, Homo sapiens
  misc_feature: GYAE6OF01CA8XU.42.49.E05.1.454.CMB.1.raw
  modified_base (755)..(755): a, c, t, g, unknown or other
  misc_feature (755)..(755): n is a, c, g, or t
tcagtgacgtatgtcacgaccggtgctcgatttagagcgactagcaacacaacaaaggggacccaaaaaccaccacccctccttgggagaactcccctagatcacagctcctcaccatgggacgggacctggagcattcctttttcgttgggtggcagcaggcaacaggtcgacccactcccgaggttcaccgttggtgcgagttcgtggagctggagccgtaggacaaggaacggtccggtcggggccctcgtaggtggtacgttcggtcctccgtagctagtcggtcttcgtacggttactactttcctttaccgacgttagtagtagtagttcggtagaacggtaccggacgggtcccggagggtacgggtcgttaggtaaggtgggtaggtagggtagtggaacctacgtaccggttaacccgttaaacggaaaacgttaaaacgagggtaacggtaaggtacgggtaaagtaacggggtaaaccggttacccgggaagggtaacgtaacggacgtaacctaacgtaaccgaacgtacccggaaccggaacgggttaaccaacgttaacctaacccggtacggtaaaccgtaccggtaaccgtaacccgtaaaccggtggtaaaccgggtaacgtaacggggaaaccgtacggtaccccttaagggaaccgtaaccgtaccggtaacgaacccggttaacccggtaaccccggtaaaccttttaaccgttaacgttaacccgcggggtaanaaccggtaggttaaccgttagttacggtaggtacccgttacggtcgttaacccggtacggtttccgtaaaccggtacgtaccgttacgttggggaccgtacccgggg

SEQ ID NO: 245999 - DNA, 615 bp, Homo sapiens
  misc_feature: GYAE6OF01ALX6A.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggaccctggagcatccttttcttggtggcagcagcaacaggtgcccactcccaggttcacctggtgcagtctggagctgagctgcagagcctggggcctcagtgatggtctcctgcagtgtcttcgtggttacattcctttccaaccgttacggtatagtaatttggtagagacgacgggcccccggaggacggggtctaggaggtacggagtgggagtggatcgacgtacccgttaacgaacgtaaacgagagtagaggagagtacgtcgaggacagtagtacatcgactcgacggacgacacactaccgagtacgtacacgtacctacgaagtacggaacgtaggacggactaccgtacgaagacgtacgtacggaccgaccgtaccggtaccttacttacgttacgtacgacggtacgagtaagtattacgtcgactacggtccggtaccgtcggaccgtaccgtaccgtacgtccgttgggcggtacccgg

SEQ ID NO: 246000 - DNA, 745 bp, Homo sapiens
  misc_feature: GYAE6OF01AW0JP.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgctagtgcttcgtggttacacttctttccacgttacggtatgtaagttggttacgagacgtaccgggacccccggaggacggggtcttggacgttggaggtgggatggactacgacggtacccgttaacggaaacttaaaacgaggtaacggtagtagggaagtaacggtaacgttaccgagggactaaggtaaccgtactacgtacgtaacgtacccgaacccggacgggtaccaacgtacctacccgaacggtaagtaccgaccgtaccctaacgaggttaaccggaacgtacgggaacggtacgcccgtagtaacgaagttccgtaacggaaccgtaaccgaacccgggtaccttaaaccgttacggttaaccgtcgggaaccgtacgggtaagtaacggttatttaacggtccgtacccgtacggttacccgggttaccgttacccgggtacgttaaccccggtaacccttaccgggttcggtttccggggtaccggggtaacccggg

SEQ ID NO: 246001 - DNA, 698 bp, Homo sapiens
  misc_feature: GYAE6OF01ELGN3.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggtacattcttttccaccgttacgtattagaagttggttagacgtacgaccggcccccgggaggacggggtcgttaggacggtggaggtgggagtaggatcgacggtacccttaacggaaactaaaagaggagtagtaggaaggaggtaacgtaccggaggacgtagagtacatacgactaccgaccggacggaacacgacgtaccgaacgtagtaaccagtaccctagaacgttacggaacgttacggaacgggactacccgtacgagttaccgtacgtaaccggtaacggaacccgtacccggggtaccttaaccgtttaacgtttaaccggacggtaccgacgggtaaggtaacgttaattttacggtaccgtaccggttaccggttcggtacggttaccggtcgttaaaccggtacccgtccggttacggtttcgggcggtacccggg

SEQ ID NO: 246002 - DNA, 808 bp, Homo sapiens
  misc_feature: GYAE6OF01DA1CJ.42.49.E05.1.454.CMB.1.raw
tcagtgacgtatgtcacgaccggtgctcgatttagagcgactagcaacacacaaagggacccaaaaaccacacccctccttgggagaatcccctagatcacagctcctcaccatggacgggacctggagcatccttttcttggtggcagcagcaacaggtcgcccacctcccaggttccaccgtggtgcagtcgtggagctgagctgcgagacgccgtcggggcctcgagtgagtcggtctccgtgctaggtcgtctttcgttcggttactactttccttttacccgacccgttaacggttattaggttaaggtttggttagacggtaaccggacccggggacccccgggaggggtacggggtcgttagggagggtgggtaaggtcgggtagtagggtactaccggtaaccggtaacccgtaaaacggaaaactaaaacggtaggtaagttagtaggggaacgtaaacggtacggttaccggaaggagaacggtacgtactacgtacgaccgtaccgaccggacggaaccaccgtaccgaaccgtaacggtaaccgtaacgaccgtaaccgtaacgacggttaacgggaacgtcgggaaacggccctacgtaaccgtaaggtaccttaccgggaacgaaccccgggtaaccgtaaccggttaccttaacgtttaaccgttacgacggaccggtaagaggtaaacgttacgtttaacgtcggtacccgttaccggtttccgggccggtttacggtaccgttaacccggtaaccgttccggttaacggtccggggtaccgggtacccggg

SEQ ID NO: 246003 - DNA, 813 bp, Homo sapiens
  misc_feature: GYAE6OF01B4L3C.42.49.E05.1.454.CMB.1.raw
tcagtgacgtatgtcacgaccggtgctcgatttagagcgactagcaacacacaaaggggacccaaaaaaccacacccctccttgggagaatcccctagatcacagctcctcaccatggacgggacctggagcatccttttcttggtggcagcagcaacaggtcgcccacctcccaggttccacctggtgcagtcgtggagctgagctgcagaacgccgtgggcctgagtgacgtggtctccgtgcgtagtcgtcttcgtggttactacttccttttacctaaccgttacggttagtacgtaagtttgggttacgacggaccggacccgggacccccgggaagggtacggggtccgttaggtaggtaggtaggtgggagtacggactaccgtaaccggtaacccgttaaacggaaaacgtaaaacgagtaagtagaaggaagtaaggtaacggtacggaagggacaaggtacgtacacgtacgacgtaccgaccggaccgaaccaccgtaacctaccgaacggtaacgtaaccgaaccgtaccgtaaacgtaacggtacgggtaaaccgtcgggaacgggtaccgtaccgtaacggaacgtaaccgtacggtaaccgaaccgtaacccggtaaccggttacccttaaacgttttacgtaaccgtacggaaccggtaaccgtaaaggttaccgttaaacgtttcggttaaccggtacccgttacgggttacccggttaccggttacccgggttaacggttaacccgtaaacccggttaccggttaccggtttcggggtaccgggtaaccccgggg

SEQ ID NO: 246004 - DNA, 873 bp, Homo sapiens
  misc_feature: GYAE6OF01BHYZA.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccgaggttcacctggtgcagtctggagctgagctgcaagagccgtggggcctcgagtgagttcggtcctccgtgcctagtcgtctttcgttggttaactactttccttttacccgaaccgttaccggttagttaggttaaacgttttggggttacggaacggtaccggacccgggggtacccccccgggtaaggggtacggggggtttaccgttagggtaacgggttagggggtaacggttagggggtaagttacggggtaacgttaccggtaaaccggttacccccggtttaaaacgggtaaaaaacccttaaaaaaccggtagggttaacggttaaaggttaacgggggaaaggttaaacgggtaaccggtttaaccgggaacgggtacggaaggtaacggttaccgtaacgtacgtaaccgtaccggtaacccggaccgggaactaaccgtaacctacccggaacgtaaacgtaaccgtaaccgtaacccgttaagacgttaacggtaacgtacggaacggtaccgtccgtaagaacgtacgtacacggaaccgaaccgaccggtaccttaactttaccgtaacggtcggaccgtaggaattacggttaaactttaggtccgtaaccgttacgggttcgtaccgtacggttaaccttaccgggtaacgtacccggttggttacgggtccggtaacccgggg

SEQ ID NO: 246005 - DNA, 564 bp, Homo sapiens
  misc_feature: GYAE6OF01EBHIW.42.49.E05.1.454.CMB.1.raw
  modified_base (298)..(298): a, c, t, g, unknown or other
  misc_feature (298)..(298): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggctcagtgatggtctcctgcagtgcttctggttacatcttttccacctacggtatgaattggtgagacacggcccccgggaggngggcgttgaggtggatgggagtggatcgagtccgaaaccggtaaacgaaacgaagagtagtagaggaagtaacgtacgaggacgagagtactatacacacgaccgacgacgacactacgacgaacgacacgactacagtagtacgtagacgacgcgacgagagtacgtacgacgacgaccgacctacttactacgtacgcgacgagtaagtagttagttagtacgtcgtacgtcgtcgtacgtacgtaaccgtacgtcgtggtcgg

SEQ ID NO: 246006 - DNA, 691 bp, Homo sapiens
  misc_feature: GYAE6OF01DIX5E.42.49.E05.1.454.CMB.1.raw
  modified_base (544)..(544): a, c, t, g, unknown or other
  misc_feature (544)..(544): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcattcctttttcttggtggcagcagcaacaggtcgcccactcccaggttccacctggtgcagtcgtggagctgagctgcagaagccgtggggcctcaggtgtagtggtctcctgcagtgtcgttcgttgttactattccttttaccaccgttacgtatgtaagttggttgacgacgaccggcccccggaggacggggtcgttggaggtggaggtgggagttggagtacgacgtacccgttaacggaaacgtaaaacgagtaagtagaggaaggtaaggtaacgttacggagggaccgtaggacgtacgtatacgtacgtccgaacccggcggaaccaaccgtacgtacccgaacggaacgttaaccaccgtaacccttaacgacggtacggaacgtaggaacgggactaccgtanacgtactacgacggtaccgaaccgtaccggtaccttacgttacttacgcgacggagtaaggacttagtttacgtcgacgttacggttcggttcccgtacggtccgttaaccgtaaccgttacggttcgttggggtcggtaacccggg

SEQ ID NO: 246007 - DNA, 804 bp, Homo sapiens
  misc_feature: GYAE6OF01CN0VN.42.49.E05.1.454.CMB.1.raw
  modified_base (143)..(143): a, c, t, g, unknown or other
  misc_feature (143)..(143): n is a, c, g, or t
  modified_base (784)..(784): a, c, t, g, unknown or other
  misc_feature (784)..(784): n is a, c, g, or t
tcagtgacgtatgtcacgaccggtgctcgatttagagcgactagcaacgacacaaaaggggaccaaaaaccacacccctccttgggagaactcccctagatcaacagctcctcaccatggacgggacctggagcatccttttntggtgcagcagcaacaggtcgcccactcccaggttcacctggtgcagtctggagctgagctgcagaacgcctgggcctcagtgatcggtctctgcaggtgtcgttctaggttactacttcttttaccgaaccttacggttattgtaaagtttggttagaacgaccgtaccgggcccccgggaagggtacgggggtcttaggacggtagggtacggtacgggtagtacggtacgttacggtaaccgttacccggttaaacggaaaaccgttaaaaacggtacggaagttaacggtaagggtaagtaaacgggttaaacgttaccgggtaagggtaccgaaggttacgacgtaacgtacctaaggtacccgaaccgggtaaccgaacctaaccgtaaccgttaaccgaacgggtaacgtaacccgaacggtaacccttaaaaggacccgttagggtaaaacccgtgggaaaggtacccgttaaccctaggtaacgacgttaacgtccggtaaacgggaaccgtaacccgggtaccttaaacgttttaaccgtacggttacggaccggttaacgacggtaaaccgtttaggttaacggttcgaagttaccggttaggtacccgtagtacccgttaagtacccgngtccgttagggtcgtacccg

SEQ ID NO: 246008 - DNA, 635 bp, Homo sapiens
  misc_feature: GYAE6OF01B0RN1.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttcgtggttacattcttttccaccgttacggtatgtaattggttagacgacgacgggcccccggaggagggggtcttggaggtggagtggggatggatcgagacccgttaacggaaactaaaacgagtaagtagtaggagtaagtaacgttccgagggacagagtcgatcactccgaccgcggacacactaccacggataccacgtacctaacgagtacggaactaggacggacgtccctacgagtactacgtacggaaccgaccgaccgggtacccttaacgtttaaccttacgtacggccggtaacggaggtaagtaattttacgtcggaccttacggtcgggttccgtaggtccgttacggtacctaccggtcgtttgggcgggtacccgg

SEQ ID NO: 246009 - DNA, 596 bp, Homo sapiens
  misc_feature: GYAE6OF01CTDE3.42.49.E05.1.454.CMB.1.raw
  modified_base (425)..(425): a, c, t, g, unknown or other
  misc_feature (425)..(425): n is a, c, g, or t
  modified_base (520)..(520): a, c, t, g, unknown or other
  misc_feature (520)..(520): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtctccgtgcagtgcttcgtggttactattctttccaccgttacggtatagtaattggttgacgtacgacgggcccccgggaggacggggtcttggaggtggagtgggagtggatcgacgtacccgtaacggaaactaaaacgaggagtagtaggagagtaacgtcgaggcagagtcgatcgatcgacgcgacacnctaccgagtacgacacgacctaagagtacggaacgtcggaaggacgccgtacgagtactcgacgaccgacgtaccggaccttacgttacttacgngaccgagaagtagttagtagtcgctacggtcggttaccgtggacttaccgtaaccgtcgtcgtcggtcggtaccgg

SEQ ID NO: 246010 - DNA, 779 bp, Homo sapiens
  misc_feature: GYAE6OF01ASWZ1.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcattcctttcttgggtggcagcagcaacgaggtcgcccactcccgtaggttccaccgtggtgctagtcgtggagtctgagctgcagacgccgtggggcctacgaggtgacgttggtcctccgtacggactggtcgttcctttacgttacggttacttctttcccgtttaccctacgttaaccggttataggttacgtttggttagtacgaccggtaccggggtacccccggtaggggtacgggggttacgttacgggtacggggtaggtacggggtaggggtactacggggttaacctacggtaccggttaaccccgttaaaacggggtaaaaaccgttaaaaggacgggttaaaccggtaggttaacggggtaaaggaacgggtttaaaccgggacggtagggaaccgtaaggttacgactagaccgttacaccggaccggtacgacaccgtaacgtaccacggtactaacgcctacgtaacgtacgtacggacggtacgaggcctacgtacgactagtcgacgaaccgacggtcccgacgttaagttacgtacgtacgccggtaataggtacgttagttcgtaacgtcgttacggtcggtccgttacggtacgtaacgcgtaccggttggtacgggcgttacccggg

SEQ ID NO: 246011 - DNA, 643 bp, Homo sapiens
  misc_feature: GYAE6OF01BLSTE.42.49.E05.1.454.CMB.1.raw
  modified_base (256)..(256): a, c, t, g, unknown or other
  misc_feature (256)..(256): n is a, c, g, or t
  modified_base (501)..(501): a, c, t, g, unknown or other
  misc_feature (501)..(501): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcgagtgatggtctcctgcagtgtcttcgtggttactnttcctttccaccgttacggtatgtaagtttggttagacgtaccgaccgggccccgggtaggacgggtcgttaggaggtggagtgggtagtggactcgacgtacccgttaaggaaactaaacgagtagtagtaggagaaggtacgtcggaggtacgagtacgtacactacgactaccgaccggacgtacactacgtaccgacggtaataccgacgtaccaacgtagtacggtaacgtggacgtacncctagaagtactacgacggaaccgaccgaccgtaccttaattacgtccgtcgacgcgaagtacgtagttacgtcgtaccgtacggttccggtaccttggtaccgttaccgtaaccgtcgtttggtagggtcggtaacccggg

SEQ ID NO: 246012 - DNA, 845 bp, Homo sapiens
  misc_feature: GYAE6OF01CW8S0.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccagtggacgggacctggagcattccttttcttggtggcagcagcaacaggtcgcccacctcccgaggttccacctggtgctagtcgtggagctgagctgacagaacgccgtggggcctcgagtgagttcggtcctccgtgcgtagtcgtccgtttcgttggttaactactttccgtttaccctaaccgttacggttactaggttaagtttgggttacgaacggtaaccggacccggggtacccccggtaagggtacggggtcgttagggacggttagggtaggtacgggtagttaggtacgtaaccgtaccgtaacccgttaaacggaaaaccgtaaaacgaggtaacgtaggtaggaagtaacggtaacgtaccggaagggtacaggtaacgtactagtaccgtacgtaccggacggtaccgaaacctaccgaccgtaaccgaacgtaacgtaacctacgtaacctaacgtaagttacggaagtacgggaacgtacgtaccttacggaagttaccgtacgtaaccggtaccgtaaccccggtaccgttaacccgttaagtttaaacccgtcggtaccggtacggtaaaccggtaaggtttaagttaaccgttacggtaacggttaacccggttacggtttcccggttacccgttaaccgggttacccgtttaacccggtaaacccggttaccggttaacgggtttacggggtcccgggttaaaccccggggg

SEQ ID NO: 246013 - DNA, 715 bp, Homo sapiens
  misc_feature: GYAE6OF01CH0E4.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccagtgggacgggacctggagcattccttttcttggtggcagcagcaacaggtcgcccactcccaggttccaccgtggtgcagtctggagcgtgagtctgacgagacgccgtggggcctcgaggttgagtcggtcctcgtgctaggtcgtcgtttcgttacggttactactttccgttttaccacgttacggtatgtaagtttggtacgaacggtaccggccggcccggagggtcgggtcttagggtacggtggacggtgggtagtaggtactaccggtaacggtacccgttaaacggaaacgttaaaacgtggtaacgtaaggtaggaagtaaggtaacggtccggaaggtaccgagtacgtacataccacgtaccgaccggtacgaccaagtaccgtaccgaagtacgaacgtactacgtaacaggtacggaagtacgaacggtcgtacccgtagacgtacctcggtacgaaccgtaccgtaaccgtaccttaacgtttgaccgtcggaacgtacgtaagacgttatttacgcggtacttacggtcggttacgtaggttaccccaacggttaaccgtggtcgttaccggggtgtaacccggg

SEQ ID NO: 246014 - DNA, 672 bp, Homo sapiens
  misc_feature: GYAE6OF01BW5UL.42.49.E05.1.454.CMB.1.raw
  modified_base (254)..(254): a, c, t, g, unknown or other
  misc_feature (254)..(254): n is a, c, g, or t
  modified_base (375)..(375): a, c, t, g, unknown or other
  misc_feature (375)..(375): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtctggagctgagctgcagacgccgtgggcctcagtgatggtctccgtgcagtgcttcgtgttacnttctttccacgtacgtatgtattggttgacgacgaccgggtccccgggaggacggggtcttggtaggtgggagtgggagtggtacgtcgacgtcccgtaacggaaactaaacgagagtagnggagagagttcgagggacagagtacagtcactaccgaccggtacgacctacgacgtaccgacgtaacgtacaaccgtacctaagtacgtaacgggtaaccgttagggaacggtactacccgttaacgagtaacgtaccggaacggtaccggtaacccggacccgttaccgttaactttaccttacgtcggacgtacggtaagaacgtttacttacgtcgtacgttaccggttcggttacccgtacgggtaccttaaccggtaaccggttccggttagtttccgggtcggtaaccggg

SEQ ID NO: 246015 - DNA, 627 bp, Homo sapiens
  misc_feature: GYAE6OF01BG83S.42.49.E05.1.454.CMB.1.raw
  modified_base (252)..(252): a, c, t, g, unknown or other
  misc_feature (252)..(252): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcgaggtgagtcggtctcctgcgagtgtcttntggttactagttctttccaccgttacgtatgtaagttggtagagtacgacggacccccggaggacggggtcttggaggtggagtgggagtggatcgacgtacccgttaacggaaactaaacgagtaacggtagtaggagaaggtaacgtcgaggacgagacgtagactactacgtaccgacggaccggaaccacgtacgtacccgaacgtaacgtaacgacgtacctaacgtagtacggaacgtaggaggtacgcctacgacgacttcgacgacgaccgacgtacctacttactacgtcgacgacgtagtacgtagttacgtcgtatacggtcgtccgtacgacgttacgtaccgtagtcgttggcgggtaccgg

SEQ ID NO: 246016 - DNA, 1031 bp, Homo sapiens
  misc_feature: GYAE6OF01EIIXN.42.49.E05.1.454.CMB.1.raw
tcagtgacgtatgtcacgaccggtgctcgatttagagcgactagcaacacacaaaggggacccaaaaaccacacccctccttgggagaactccctagatcacagcctcctcaccagtcgggacgggacctggagcattccttttcgttgggtggcagcagacaacgaggtcgcccacctcccgtaggttccaccgtggtcgactagtcgtgggacgtcgtggacgtctggacgaacggacggccgggttcggggtccctaggtacggttaggtacggttcgggttccttccgtcggtaccgtaggtcgttacgtttacggttacggtttacctttaccgttttacccgtttaacccgtaacggtttaacggttaggttaacggtttacgggtttagggtacggaaccggtacccggggtacccgggggtacccgggggtaggggtaccggggtttaggttaagggtacggggttagggtacgggttacggggtacgttacgggtaccgttaaccggtaacccgggtttaaacccggtaaaacggtaaaacggttaacgggtaacggttaagggtaacgggtaaagggtaaacggtaaccgggttaaccgggtacgggtaacgggtacgtaacggttacgtaaccgtaacggttaaccgtaacccggtacccgggaacccgggtaacctaaccgtaaccggttaacccggtaaccggtaaaccggtaacggttacccgtaaaccgtaacggtaacgggtaaacggttaccgggtaacgggtaacgggaccgtaaccgtaccgtaacggtaacggtaccgtaaccggtaaccggaacccggtacccggttaaccgttaacgtttaaccggttacggtaccgggtacggtaaaccgggttagttaacggttaacgttacggtttaccgtaaccggttcccgggttaacggttcccggttccgggttaacgttaccggttaacccggttaaccggtttcggggtttaccgggtccggggtaaccgggtacccggg

SEQ ID NO: 246017 - DNA, 717 bp, Homo sapiens
  misc_feature: GYAE6OF01EV7RB.42.49.E05.1.454.CMB.1.raw
  modified_base (198)..(198): a, c, t, g, unknown or other
  misc_feature (198)..(198): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (354)..(354): a, c, t, g, unknown or other
  misc_feature (354)..(354): n is a, c, g, or t
tcagtgacgtatgtcacgaccggtgctcgatttagagcgactagcaacacacgaaaggggacccaaaaaccacacccctccttgggagaactcccctagatcacagctcctcaccagtcgggacgggacctggagcattccttttcgtggtggcagcagcgaacgaggtcgcccacgtcccgaggttccaccgtggtncgtagttcgtaggacgcgtgcgtctgaccaggacgccggtgggcctgagtgagttcgtctcgancgtagtctacttcggtntactacttcttaccacgttacgtatacgtagttggtcgacgacgtccggaccccggtaggtacggttcgtagggngtggtacggtagggtagtacgtacgtcgtaaccgttaccggtaaacgtaaaacgtaacgtagtaacggtaacgaggtaacggaacgttaacggtccgaggaccgtagacttacgacgtacgtacgtacccgaccggaccgaacctaccgaaccgtcgtaacgactaaccgtaaccctcgttaaaccggagttaccgtaagacggaccgtaccgtacgtacggtaactgtacccgagtaaccggacgtaccgtacttaacgttcgtaacgcggtaacgagagttacgtacgttggttacccgagtcccggtcttaacggtcgttaacccgtaggtacctacgttcgggttaggccgtaccgggg

SEQ ID NO: 246018 - DNA, 720 bp, Homo sapiens
  misc_feature: GYAE6OF01C91K1.42.49.E05.1.454.CMB.1.raw
tcagtgacgtatgtcacgaccggtgctcgatttagagcgactagcaacacacaaaggggacccaaaaccacacccctcctgggagaatcccctagatcacagctcctcaccatggacgggacctggagcatccttttctgggtggcagcagcaacaggtcgcccactcccaggttcacctggtgcagtctggagctgagctgcagagccgtgggcctcagtgatggtcctcctgctaggtgctttcgttggttactactttccttttacccgtaaccgttacggttataggttagttggttaggacgtacgaccggggcccccgggaggtacggggtcgtaggtcggtagggtaggtagggtagtgggtactaccggtacggtacccgttaaaccggaaaaccgtaaaacgaggtaaggtagtagggaagtaacgtaacggttacggaacgggtacgaggtacgtactacgtacgaacgtaccgaccggtacggaaccacctacgtaacccgaacggtaacgtaaccgacgtaaccgtacgaacgtacgggtaacgtacgggacggtaccgtacccgtagaccgtactacggacgtaccgaccgaccgttacctaacttactacgtgaccggtagaactaggtacttacgtacgtaccgtacggttcggtaccgtaggtacctacggaacccgttggttaccgtgggtacgggtcccggg

SEQ ID NO: 246019 - DNA, 722 bp, Homo sapiens
  misc_feature: GYAE6OF01C8IX3.42.49.E05.1.454.CMB.1.raw
  modified_base (235)..(235): a, c, t, g, unknown or other
  misc_feature (235)..(235): n is a, c, g, or t
  modified_base (529)..(529): a, c, t, g, unknown or other
  misc_feature (529)..(529): n is a, c, g, or t
tcagtgacgtatgtcacgaccggtgctcgatttagagcgactagcaacacacaaaggggacccaaaaccacacccctccttgggagaatcccctagatcacagctcctcaccatgggacgggacctggagcatccttttcttggtggcagcagcaacaggtgcccactcccaggttcacctggtgcagtctggagctgagctgcagagccgtggggcctcagtgatggtctccgngctagtgcttcgtggttactattccttttaccaccgttacggttatagtaagttggttgacgtacgacgggccccggagggtacggggtcttggaaggtggagtgggagtggactacgtacgacccgttaaacggaaacttaaaagacggtaaggtaacgtagggaaggtaagtaacggttaccggaagggtcgaaggaaggttacagtaccgaataccgacccggacggaccaacgtactaccgaacggtaactaacgacgtaccgtaactagtacgaacgtggacggtaccncgtacagactcgtagaccggtaccgacgggtacctaacgttacgttaccgtacggaccggtacgtaaagggtaccgtaagttttacgtaccggttacccgtacggttaccggggttcccgtacgggttacccggtttaaccggttaaaccccgtacccggggttcgtttacgggggttcccggggaacccggg

SEQ ID NO: 246020 - DNA, 759 bp, Homo sapiens
  misc_feature: GYAE6OF01ETPN0.42.49.E05.1.454.CMB.1.raw
  modified_base (237)..(237): a, c, t, g, unknown or other
  misc_feature (237)..(237): n is a, c, g, or t
  modified_base (554)..(554): a, c, t, g, unknown or other
  misc_feature (554)..(554): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtgcagcagcaacagtgcccactcccaggttcacctggtgcagtctggagctgagctgcagacgccgtggggcctcagtgagtggtctcctgcngtgtctttcgtggttactattccttttacccaccgttacggttatagtaagtttggtagagtacgaccgggcccccggaggaggggtcgttggtacggtggaggttgggagtggacgtaccgtaccggtacccgttaacggaaaaccgtaaaacgtaggtaaggttaagaggtaaggtaacggtaacggtttaccggacgggtacgaacgtacgtacctagtactacgtaccgtaacccggacggaccaaccgtaccacccgaacgtaaccgtacaacgtacctaacgacgttacggaacgttacgggaaggtaccnccgttacgacgtaactccggtaaccggaacgtaacccgtacccggtaacccgttaagttttaaccgtacccggtacggtcccggtaacggtaaaccggtagtttaaccgtttacggttcgtaaccggttaccgtcggtttaccggtccggttacgttaacccggttaaccggtccggtttagttcgggggtcggtaaccccgggg

SEQ ID NO: 246021 - DNA, 654 bp, Homo sapiens
  misc_feature: GYAE6OF01BGOI3.42.49.E05.1.454.CMB.1.raw
  modified_base (195)..(195): a, c, t, g, unknown or other
  misc_feature (195)..(195): n is a, c, g, or t
  modified_base (381)..(381): a, c, t, g, unknown or other
  misc_feature (381)..(381): n is a, c, g, or t
  modified_base (459)..(459): a, c, t, g, unknown or other
  misc_feature (459)..(459): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctgganctgagctgcagaacgccgtggggcctcagtgatggtctctggcagtcgcttcgtggttacattcctttaccaccttacggtatagtattggttagacgtacgacggtcccccggaggaggggtctaggaggtggagtgggtagtggactcgaccgtaccgtaacggtaaacgtaaacgagagtagnggaacgagtaacgttcgagggacaaggtacgtacacgtacacaccgacgacgacacctacgtaccgaacgagtaaccncgtaccgtaagtagtacggaacgtggaaacgtcgaccgtagaacgtactacggacgtaaccgacccggtacggtacctaacttacgtaccgacggtaacgaaccgaggtacttaagttacgtccggtacgtacgttcgggtaccgtggttaaccgttaccgtaaccgtccggttcggtttagggccggtaccggg

SEQ ID NO: 246022 - DNA, 796 bp, Homo sapiens
  misc_feature: GYAE6OF01DDHJL.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccacctggtgcagtctggagctgagctgcagaagcctggggcctcagtgatggtctcctgcagtgcttctggttactattctttccacctacggtatgtaattggttgagacgacggcccccggaggaggggtctggaggtggagtgggagtggatacgtacggtacccttacggaaaactaaaacgagtaagtagtaggaagtaacgtaacggttaccgaagggtacgaacggaagttaccgtaataccgtaaagttacccgaacccgggtaccgggaaacctaccgtaaccgttaccccgaacggaaacgttaaaccgtaccgtaacccgttaaacgtacggttacgggtaaaccgttacgggaaacgggtaccgacccgttaccgaacggttaaccgttaccgttaacggaacccggtaaacccggtaaaccccggggtaccttaaccgtttttaaacgttacccggttacggtacccgggaaacggtaaggaaacggtttaactttaacggtttacggtacccttaaccggtttcggggttacccgttcgggtaccggtttaccgttaaaacccggttccgggtttaccgtttcggggtcgggttaaaccccgggg

SEQ ID NO: 246023 - DNA, 639 bp, Homo sapiens
  misc_feature: GYAE6OF01ELG95.42.49.E05.1.454.CMB.1.raw
tcagtgacgtatgtcacgaccggtgctcgatttagagcgactagcaacacacaaaggggacccaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacagttcttttccacctacggtatgtaattggttgagacgaggcccccggagaggggcttggaggtggagtgggatggagtcgacgtacccttaacggaactaaaacgagacgtagtggaagaggaagttccgagggcagagtacatcatcgacgacgacacatccacgacgtacacgacctacatacggaactaggacggacgccgtacgaacggtactacgtagaacccggaccggaacccgggtacccttaacgttttaacttaccgtacggtccggaacggtagtaagttaacgtttagttacggacgttaccggttcgggttcccgttacgggtacccgttacggtaaaccccggtacggttcgtttacggggtggggtaaccccgg

SEQ ID NO: 246024 - DNA, 885 bp, Homo sapiens
  misc_feature: GYAE6OF01DUXFY.42.49.E05.1.454.CMB.1.raw
  modified_base (176)..(176): a, c, t, g, unknown or other
  misc_feature (176)..(176): n is a, c, g, or t
  modified_base (221)..(221): a, c, t, g, unknown or other
  misc_feature (221)..(221): n is a, c, g, or t
tcagtgacgtatgtcacgaccggtgctcgatttagagcgactagcaacacacaaaggggacccaaaaaccacacccctccttgggagaactcccctagatcacagctcctcaccagtgggaccgggacctggagctacttccctttttcgttgggtggcagcagacaacgaggtcnccctactcccgaggttccaccgtggtcgctagtcgtggagctagngctgacaaggacgtccggtagggtcctagtagtacgtgttcggtcctccgtgcgtacggttcgttccgtttacgttacggttaacttaccggtttcccttttacccgaccggtttaaggttaattacggtttaaggtttgggtaacggaaccgaccgggtaccccgggaccccggggtaaggggtaccgggtcggttagggacggttaggggtacgggtagggtagtacggtaacgtaccgtacccgttaaaccgtaaacggtaaacaaaacggtggtaacgtagggtacgaaggtacggtaaccggtcggaacggacgttacggacgtaacgtaacgtacgaccggtaccggacccgtaacgaacccgtccgtaaacctacccgggaacggttaacaaccgtaaccggtacccgttaaagaaccgggtacgggtaaaccgcgggtaaccggactaccccgtagtaaaccggttcgtaccggaaccggtaaccggtaccccgtacggttaaaccctttacgtaaacgggtttacccgggccggtaaacgacgggtaaggttacctttaaggttccgtaaccgtcgggtttaacgcccggttacgtaccggaacccgtttaaaccggacccgttcgggtacggttccggggaccgttacccgggg

SEQ ID NO: 246025 - DNA, 805 bp, Homo sapiens
  misc_feature: GYAE6OF01D6G7K.42.49.E05.1.454.CMB.1.raw
  modified_base (178)..(178): a, c, t, g, unknown or other
  misc_feature (178)..(178): n is a, c, g, or t
tcagtgacgtatgtcacgaccggtgctcgatttagagcgactagcaacacacaaagggacccaaaaccacacccctccttgggagaatcccctagatcacagctcctcaccatgggacgggacctggagcatccttttcttggtggcagcagcaacaggtgcccactcccgaggttcncctggtgcagtcgtggagctgagctgacagaagccgtggggcctcgagtgagtcggtctcctgctagtgtcttcgtggttactactttcctttaccaccgttacggttatagtaagtttggttagaaggaccgaccgggccccggtaggtacgggtcgttggacggtggagtagggagtcggacttcgaaccggtaccgttaaacggtaaaacctaaaagaggtaacggttagagggtaaagtaacggtaacggttaccgagggactaaggtactcgtaatcgtaacgtacccgaaccggaccggaactaacgtaccgtaccgacgtaaacggtactacgacctaagtacgtaacggtaactgggaacgtaccgtacctagtaaccgtatttacgaaccggacgtaaacccggtaacccgtaccgtttaaacggtttacgttaaccggtacggtacccgggaacggttaaagttacggggttaactttttaccgggtaaaccgttacccggttaccgggttttacccggggtaacgtttaccccgggttaacccgttttaaacggttaaacccccgttacccggggtttaccgttttaccggggggtaccgggggttaaaccccggg

SEQ ID NO: 246026 - DNA, 635 bp, Homo sapiens
  misc_feature: GYAE6OF01ARWH9.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattcttttccaccgtacggtatcgaattggttagtagacgagggccccccggaggacggggcttggacgtggagtgggatgggatcgagtcccgttacggaactaaacgagagtacgtggagagaagttcgaggcagagtcagtcagtcaccgcggacacacgtaccacgacgtacaggacctacgagtacggaacttggaacggacgtccctacgaacgtacgtacgtaggaaccgacgtaaccggtacccgtaaccgtttaacgttaccgtggaccgtacggtaagtacgtaacgtttaacgttcgtacttaaccggttcgggttacccgttcgggtaccttaccggtaacccgtacgttaccggtttgggtcgggtacccgg

SEQ ID NO: 246027 - DNA, 769 bp, Homo sapiens
  misc_feature: GYAE6OF01CUM05.42.49.E05.1.454.CMB.1.raw
  modified_base (247)..(247): a, c, t, g, unknown or other
  misc_feature (247)..(247): n is a, c, g, or t
tcagtgacgtatgtcacgaccggtgctcgatttagagcgactagcaacacacaaaggggacccaaaaaccacacccctccttgggagaatcccctagatcacagctcctcaccatgggacgggacctggagcattccttttctggtggcagcagcaacaggtcgcccactccccgaggtttccaccgtggtgcagttctgggagctgagctgcaggacgccgtgggcctacagtgagtcggtcctcngctaggttcgtcgtttcgtacggttactactttccttttaccaccgttacggttatagttaagttggttaggacggaccgaccggggacccccggtagggtacggggtccgttaggtaggtacgggaggtgggaggttaggacgtaccgtacgtaacccgttaacggaaacgtaaacgtagtaggtagtaggaagtaacggacggttacgagggtacgaggtacgtactacgtacgacgtaccggaccgggaccgaaccgtaacctaccgtaaccgtaaacggtaacggtaacccgaacgtaccgttaacgtaacggtacgggtaacgtacggggtacggtaccgtacccgtaacgtacgtacgtacgtaccgaacggaacccgtcggtaacccgttacttaacgttaccacgggtacggaccgtaaggtacgttagttacgtacgtaccgttaccggttcggtacccggttacggcgttaaccggtacccgtacggtcggttcgggtaccgggtacccggg

SEQ ID NO: 246028 - DNA, 712 bp, Homo sapiens
  misc_feature: GYAE6OF01A3AVS.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtggggcctcagtgagtggtctccgtgcagtgcttctggttactattcctttaccaccgttacggtattacgtaagtttggttagaacggaccgaccgggtacccccggaaggggacggggtccttagggacggttagggtacggtgggtaagttcgggtaactccgtaacggttaaccccgttaaacggaaaacgttaaaaccggaggttaaggtaaacggtagggtaaggtaacgtaacggttacgaggggtaccaaggacgttaccagtactacgtaccgaccggtacgaacgactactaccgaacgtacgtaactacgtaccctaacgaaggtacggaacgtggaacgtaccgcgtacgatacgtcgacgtaccgacgaccggtacttaacgtttacgtacctaggaccgacgtaagtacgttacttacgtgtaccgttaaggtccggttaccgtgtaccggtaactaaccgtacgttcggttggtacggtacccggg

SEQ ID NO: 246029 - DNA, 786 bp, Homo sapiens
  misc_feature: GYAE6OF01B00SX.42.49.E05.1.454.CMB.1.raw
tcagtgacgtatgtcacgaccggtgctcgatttagagcgactagcaacacacaaaggggacccaaaaaaccacacccctccttgggagaatcccctagatcacagctcctcaccatggacgggacctggagcatccttttcttggtggcagcagcaacaggtgcccactcccaggttcacctggtgcagtctggagctgagctgacagaagccgtggggcctcgagtgagtggtctctgctagtcgtcttctaggttactacttccttttccaccgttacggttactagttaagtttggttagacgtaccggaccggggacccccgggtaagggacgggggtcttagggacgggttgggtagtgggggtagtcgggtaataccggtaacggtaccccgttaaaaccggaaaaactaaaaaccgtaggtaaacggttaggtaacggggaaagtaaacgggtaacggttaccgggaaggggacgtaagggacgttacgacgtttacgaacgttacccgaccggaccggaacctaacgtaaccgtaccgaaccggtaacgtaacccaacgacccgtaacgaacggtacggtaacgtaggacggaaccggtccacgtacggtaactaccggtaacggaaccggacccgtaaccggtaccttaacttaccgtttaacgaccggtaccggaaggtaacggtagttagtttacgtacgttacctacgggttccggttccgtacgttccgtaaccggttacctaaccggtcggtttacggtacgggtacccggg

SEQ ID NO: 246030 - DNA, 696 bp, Homo sapiens
  misc_feature: GYAE6OF01AC4Z7.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgagtggtctccgtgctaggtgtcttcgtggttactagttcttttcccaccgtacggtatgtaatttggttggagacgaccgggtccccccggaggacgggggtacttggaggtaggtagtggggtagtggagtaccgtacgtacccgtttaacggaaaccgtaaaacgagtagttagacggtaagagtaacggtccgaagggcaaggacgtacacgtctaacgtccgtaccggacgaaccacaccgtaccgacggtacgtacgaacgtacctaacgagtaacggtaacgtaggacggacgtcctacgaagtacgtacgacgtaaccgaccgacccggtacctacgtttagtacgtcggacgtacgtacgaaacgttacgttacgttcgtacgttaaccggttcgggtacccgttacgggtaccgtttaacccggtaacccgtaccggtttcgtttccgggtggtaaccccgggg

SEQ ID NO: 246031 - DNA, 724 bp, Homo sapiens
  misc_feature: GYAE6OF01CMKQ5.42.49.E05.1.454.CMB.1.raw
  modified_base (249)..(249): a, c, t, g, unknown or other
  misc_feature (249)..(249): n is a, c, g, or t
  modified_base (398)..(398): a, c, t, g, unknown or other
  misc_feature (398)..(398): n is a, c, g, or t
tcagtgacgtatgtcacgaccggtgctcgatttagagcgactagcaacacacaaaggggaacccaaaaaccacacccctccttgggagaactcccctagatcacagctcctcaccagtggacgggacctggagctattccttttcttggtggcagcagcaacaggtcgcccacctcccgtaggttccaccgtggtgcagtcgtggagctgagctgcagacgccgtgggtcctgaggtgagtggtctcgngcgtgtcgtcttgtacgttactacttccgtttaccacgttagtagtagttagttggtcgaagaccggtccggacccgggtaggtacgggtcgtaggtaggtggtagtagggagtgacgtacgtacgttaaccgtaacgtaaacaaacgngtaagtacgtaggaacgtagtaacggtcggaggtacgaggtatacagtacgtactacggaccgacgacaaccgtccgacgaagtaactacacgtacgaacgtaggacgaaggtcgaaggtacctaccgtagtaacgtacgtaacgacggtaacccaaccgggtaaccgtacctttaaacggttactaacgggccgagaacgttaaagcgttttaaagtaaccggtccggtaacccgttaccggttcggggttaaaccgtccgggtttaaaccctaccggttaaaccccgtggggtttccgttaccgggggtcgggtaaacccccgg

SEQ ID NO: 246032 - DNA, 837 bp, Homo sapiens
  misc_feature: GYAE6OF01B9P6G.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacggggacctggagcatccttttcttggtggcagcagcaacaggtgcccactcccaggttcaccgtggtgcagtctggagctgagctgcagacgccgtggggcctgagtgtagtggtctcctgcgtagtcgtcgttgtggttactacttcttttacccgtaccgtacggttagtagttaagttggttagacgaccgacgggcccccgggaggacggggtcgttggagggtggaggtgggtagtggtagtccgtacgtacccgttaaacggaaactaaaacgaggtaagtagtagggagtaaggtaacggttccggaacggggtacgaggtacgtacgtacgtacgtacgtacccgacccggtacggaacccgtaaccgtaaccggtacccgaaaccggtaaccggtaaccgaaccgtacccgtaacgtaacgggtaacgggtaaacggtacggggaaacgggtaaccggtaccggtaactaacggtacgttaccgtaaccgggaaccccggtaacccgggtaacccgggtaaccctttaaaccgtttaaccgtttaaccggtacggtaacccgggaacggtaacggttacggttaaacgttttaccgtacggttacccgttacggtttaccgggttacccgttcccgggtaaccggtttaccccggttaaccgttaaccggggtttccggtttacggggtcccggggtaaaccccggggg

SEQ ID NO: 246033 - DNA, 797 bp, Homo sapiens
  misc_feature: GYAE6OF01CV3QV.42.49.E05.1.454.CMB.1.raw
tcagtgacgtatgtcacgaccggtgctcgatttagagcgactagcaacacacaaagggacccaaaaaccacacccctccttgggagaatcccctagatcacagctcctcaccagtggacgggacctggagcattccttttcgtggtgcagcaggcaacgtaggtcgacccactcccgtaggttccaccgtggtgctagtcgtaggacgtctgagctgacgaggacggccgtggggccctgagtacgtgttcggttacctcgtcgcgtaggttcgtcttcgttaggttaccttacgtttcccgttaccgtaccgttaggttagttacggttaggttcggtacgaacggtacccggacccgggtacccgggtaagggtcgggtttacgttagggtaggttacggtacgggtacgggtagtacggtaacgtacccgtaaccgttaacccggttaaaacgaaaacgttaaacggaggttacggtaaggtacggtaaagtacggtaaccggtacggacggacgtagtactacgtaccgtacgtacgtacccgacgtaacgtacctaaccgaccgttaacggacggtaactacccggtaaccgttaacaacggtacgttacgtaacgtaggtaaccgtcgtaccgtacggagtacgtacccggaacgtaccgtaacccgtaccgtaccttaacgttaccggtacgacggtaccgtaagtaggttactagttaccggacgtaccgttacggttcctaccggttacggtaactcgtaacggtgttaccggtggtacccggtacgg

SEQ ID NO: 246034 - DNA, 804 bp, Homo sapiens
  misc_feature: GYAE6OF01EZNGJ.42.49.E05.1.454.CMB.1.raw
  modified_base (130)..(130): a, c, t, g, unknown or other
  misc_feature (130)..(130): n is a, c, g, or t
  modified_base (149)..(149): a, c, t, g, unknown or other
  misc_feature (149)..(149): n is a, c, g, or t
  modified_base (229)..(229): a, c, t, g, unknown or other
  misc_feature (229)..(229): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggancattccttttctggtgcancagcaacaggtgcccactcccgaggtttccacctggtgccagtcctggagtctggagcctgcaagtaagccgtgggcctnagtgtagtggtctccgtgctagtgctttcgtagttactagttccttttaccacctacggtatagtaagttggttagaagacgaccggaccccggaggtacgggtcgttggagtcggagtgggagtggatcgtacgtaccgttaacgaaataaaacgagtagtaacgtggaagtagtaacggtacgagggtacgaacgagtacgtaatacgtactaccgaaccgggtacgaaaccgtacaaaccgttccaaacggtacgtaaccgacgtaacccgtaacgtaaacgtacgggtaaacgtacgggtaacggaaccgtaccgtacgtaacgggtaacttaaccgtaacccggaaacccggtaacccggtaacccgggtaccccgtttaaaaccgtttaaccgttaaccgggttaacccggaacccgggttaaggtaaccggtaaaagggttaactttaacggttaccggttacttaaccgggtcccggtttacccggttaccgggttaccgttaaaacccgggttaaccctttaaacccggggttaccggttttgggggtacggttaaacccccgggg

SEQ ID NO: 246035 - DNA, 927 bp, Homo sapiens
  misc_feature: GYAE6OF01BRPFX.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcaggcaacaggtcgcccactcccgaaggttccaccgttggtgccgtagtcgtggagcctgagctgcgaaggaacgccgtggggcctacgagtggtacgtcggtcctccgtgtacgagtcgtacgtttcgtacggttaccgtactttccgtttacccgtacgttaacggttagttacggtaacgttttcggtaggacggtaaccggaccgggtacccccgggtaggggtacgggtcggttaggtaacggttaggtacggtagggtacgtacggacgttacgtaaccggtacccgttaaacggtaaacgtaaaccggtaggtaacggttacgtacgggaacggtaacggtaacggttaccggagggtaactaaggtacggttaccgaagttaccgtacgtaacccgggaccggttaccgaaccgtaccgtaaccgtaaccgtaacggtaaccggtaaaccgtaacggtaacccgtaaggtaaacggttacgggtaaaaccggttacgggaacggtaccgtaccgttaacggtaacgtaccgttaaccggtaaccggtaaaccggtaccccgtaacccggttaccgtttaaacgtttaacccgttaccggtaccgttaaccgggaccggttaaacggttaaccgttaacggtttaccggtttacggaccccggttttacgggtacccgggttttccgggtaacggtttacccggttaacccgttaaaccccgggttacggtttaccccggttaaagggggttccccgtaaaccccgggg

SEQ ID NO: 246036 - DNA, 684 bp, Homo sapiens
  misc_feature: GYAE6OF01DQQRB.42.49.E05.1.454.CMB.1.raw
  modified_base (186)..(186): a, c, t, g, unknown or other
  misc_feature (186)..(186): n is a, c, g, or t
  modified_base (545)..(545): a, c, t, g, unknown or other
  misc_feature (545)..(545): n is a, c, g, or t
  modified_base (592)..(592): a, c, t, g, unknown or other
  misc_feature (592)..(592): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcattccttttcttggtggcagcagcaacaggtgcccactcccaggttcactggtgcngtctggagctgagctgcagaagccgtggggcctgagttcgagtggtctcctgcagtgtccttcgttggttactactttcccgttttccctaccgttaacggttattagtaagtttgggttaggtacgacgacccggaccccccgggagggaacgggggtccttaggacggtgggtaggtgggagttacgggattcgaaccgtacccgttaacggaaaaacctaaagagtaaggtagtagggaacgtaaagtaacggtacgaaggcgaggtacgtcatctaacgtaccgacggacgtacacacgtaccgacgtaagaccctacgaccttaagacgtaacggactagggacgacgacctanacgtatcgtacggaaccaccggaaccgtcctaacggttaacttcggngaccgtaccgaaggaccgttagtacgtttacgccgttcggtaccgttcggtacgtcgtaccgttaaacgcgttagttcggggtcggtaccgg

SEQ ID NO: 246037 - DNA, 715 bp, Homo sapiens
  misc_feature: GYAE6OF01ENFWK.42.49.E05.1.454.CMB.1.raw
  modified_base (283)..(283): a, c, t, g, unknown or other
  misc_feature (283)..(283): n is a, c, g, or t
  modified_base (618)..(618): a, c, t, g, unknown or other
  misc_feature (618)..(618): n is a, c, g, or t
  modified_base (637)..(637): a, c, t, g, unknown or other
  misc_feature (637)..(637): n is a, c, g, or t
  modified_base (641)..(641): a, c, t, g, unknown or other
  misc_feature (641)..(641): n is a, c, g, or t
tcagtgacgtatgtcacgaccggtgctcgatttagagcgactagcaacacacaaaggggacccaaaaaccacacccctccttgggagaactcccctagatcacagctcctcaccagtgggacgggacctggagctattccttttcttgggtggcagcagacaacgaggtcgccctactccctaggttccaccgtggtgcagtcgtaggagtctagagctcgacgaagagccgtgggcctgagtgagttcgtcctacgtgacgtgtcgtctttacgtagttacnctttccgtttaccaacggtttaggtatagttaagtttgtacgaacggtaccggaccgggtccccgggtaaggggtacgggtacgttagggtacgggtaggtaggttacggggagttaacgggtactacccgtaaaccggttaaccccgtttaaaacgggtaaaaacaaaaccggtaggttaaggttaaacggtaacggaaggtaacgttaaacggtccgggaagacgtaagacgttactaagtacgactacggaccgaacgtacaacgtacgacgaagttacgacactacgtacagtagaacctggagacctcgaatgaactgaacgaccgtacncgtacagttaactcgacgngtanagttactagttacccgtgacttaccggttgttaccgagttaccaaccgggtcaaccgtttgacggttcggaacg

SEQ ID NO: 246038 - DNA, 853 bp, Homo sapiens
  misc_feature: GYAE6OF01B3WBS.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtgcccactcccaggttcacctggtacagtctggagctgagctgcagaacgccgtgggcctgacgtgactggtctcctgcagtcgtcgttcgtggttacacttcttttacccaccgttaacggttattaggtaacgttttggttagaacggtaccgtaccggggaccccccgggtaggggtaacgggggtcctttaggggtaggttacggggaacggtttagggggacgtttacgggtaacgttacggtaacccgggttaaccccggttaaaacgggtaaaaacccttaaaaacggaaggtaacgtttaaggagggaaaggtaacggtaaccgggttaaccgggtaagggtacggtaggtaacggttcctaacgttaccgaacgtcccggaaccgtaccgggaacctaaccgtaccgtaccgaaccggtacgtaaacgtccgtaacccgtaacgtaaggtaaccggggtaaactcgggtaaacgggtacccgtacccgttaacggaaccggttaacgttaccccgtagtaaaccccggtaacggtaaccccggtaccgttaaccttaactttaaccgggtacgtccggtaacggtaagtaccgggttattttacgtacggtccgtacgttcgggtccctgggttaactaccggtacgtacccgttgggttacgtcgggtaaggtaccccgggg

SEQ ID NO: 246039 - DNA, 702 bp, Homo sapiens
  misc_feature: GYAE6OF01C3YED.42.49.E05.1.454.CMB.1.raw
  modified_base (393)..(393): a, c, t, g, unknown or other
  misc_feature (393)..(393): n is a, c, g, or t
  modified_base (652)..(652): a, c, t, g, unknown or other
  misc_feature (652)..(652): n is a, c, g, or t
  modified_base (670)..(670): a, c, t, g, unknown or other
  misc_feature (670)..(670): n is a, c, g, or t
  modified_base (684)..(684): a, c, t, g, unknown or other
  misc_feature (684)..(684): n is a, c, g, or t
  modified_base (692)..(692): a, c, t, g, unknown or other
  misc_feature (692)..(692): n is a, c, g, or t
tcagtgacgtatgtcacgaccggtgctcgatttagagcgactagcaacacaacgaaaacggggaacccaaaaaccaccacccctccgttgggagaactcccctagatcacagcctccctcaccagtcgggacgggaccgtggagctacttccttttcgttgggtggcagcagacaacgaggtcgacccctacctacccgtacggttaccaccgtggtcgacgtaggtcgtagggatcgtcggacggtcctaggacgaacggacggtccgtcggggcctagaggtgtagtcgtctccgtgacgtgtcgtcttcgtgttactcttccgttacgtacgtaagtgtagtagttggtacgagaccggccggaccggaggtaggtcgtaggaggtaggnggtacggatacgagtacgaccggtaaccgtaagaaaacgtaaagagtaggtagaggtaacgtaacggtacgtacggacggagtagtacgacgtacacgtacgaaccgacggtaacgaacaacgacgtaaccgaatacggtaacgaaccgtaacaggtaacggaacgtagggaaccgtaggcccttaaggactaggtacgacgtaaccgacgaacccgtaacgtacttaccttagtagaccagtaggaatgtagtaccgngtagtactcggtaacggntacggtacgtaacngttacggngacggtaccg

SEQ ID NO: 246040 - DNA, 620 bp, Homo sapiens
  misc_feature: GYAE6OF01AVHFV.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcagtgatggtctctgcagtgtcttctggttacattccttttccacttacggtatgtaagttggttgacgacgaccggccccggaggaggggtcgttggaggtggagtgggagtgggactcgacggtaccccgttaacggtaaaactaaaacgaggtaagtaagtaggaagaaggtaacggttaccggagggacaggtagtacatcgactaccgacgacgacacgactaccgacgagtaacacggtacctaacgaacgtaggactacggaggacgccacgacgtactacgtacgaccgtacgaccgtaacctactttaacgtcgtcgacggtacgaggacgttattagtcgtacctcggtcggtcgtcggtactacggtaccctaggtcgttggcggtacgg

SEQ ID NO: 246041 - DNA, 568 bp, Homo sapiens
  misc_feature: GYAE6OF01AUAGC.42.49.E05.1.454.CMB.1.raw
  modified_base (453)..(453): a, c, t, g, unknown or other
  misc_feature (453)..(453): n is a, c, g, or t
  modified_base (487)..(487): a, c, t, g, unknown or other
  misc_feature (487)..(487): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgaactgcagaagcctggggcctcagtgatggtctcctgcagtgcttctggttacatcctttccacctacggtatgtaattggttgagacacggcccccggaggacggggcttggagtggagtgggatggatcagtcccgttaacggaaactaaacgagagtataggagagtaacgttcgagggcaggagtcatcagtccaccggcgacacactaccagacgtacacgacctacagtacgaacgtggagacgcctanagtactcgagaccgaacgcggacctacttatacngacgagacgtagtattacgtgcgtacgtcggtccgtggtccttacgtaaccgacggttagttcggtcggtccgtaccgggg

SEQ ID NO: 246042 - DNA, 771 bp, Homo sapiens
  misc_feature: GYAE6OF01A0ERQ.42.49.E05.1.454.CMB.1.raw
  modified_base (728)..(728): a, c, t, g, unknown or other
  misc_feature (728)..(728): n is a, c, g, or t
tcagtgacgtatgtcacgaccggtgctcgatttagagcgactagcaacacacaaaggggacccaaaaaccacacccctccttgggagaatcccctagatcacagcctcctcaccagtggacgggacctggagcattccttttcgttggtggccagcagcaacgaggtcgccccacctcccgtaggttccaccgtggtgcagttcgtggagcgtggagcgtgcgaagacggccggtggggccctgagtcgagttcggtcctccgtgctagtcgtctttcgttgttactctttcctttaccacgttacgtagtagttagttggttagacggtaccggaccgggaccccggagggacgggtcggttgggaggtaggtaggtagggtagtcggtaacgtaccgtaccggttaacccggttaaacggaaaaccttaaaacggaggtaaggtaaggaagggtaaaggtaacgtaacggtacggagggacgaaggttacgtactaatcgacgtaccgaccggtaccgaacgacctacgaaccgacgtaacgacgaaccgtaccgaagtaacgtacgggaacgtacgggaccgaaccgtccgtacgtaacgtacgacgtaccggaaacccggacccggtaaccgtaccctttaaacggtttactaccggtacccggacgtaacggtaaagtacgttacgttaacgttccgaccggttacggttcggtaccggttanacccgtttacgaacccgttcggtggttacgggccgtaaccggg

SEQ ID NO: 246043 - DNA, 634 bp, Homo sapiens
  misc_feature: GYAE6OF01B2O67.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttcgtggttacattcttttccacctacggtatgtaattggttgagacgacgggcccccggaggacggggtcttggaggtggagtgggagtgggatcgacggtacccgttaacggaaactaaaacgagaagtagtagggaagaggtaagttaccgagggacaaggagtacagtcactccgaccgcggaccacactccaacgacgtacacgacctacgacgtaggaaccgtaggacggacgaccctacgacgtacgtcgtacggaaccgacgtacccgggtacccttaacgtttacgttacgtcgaccggacgaggacgtaagtttacgtcggactacggtcggttcccgtaggtacttaccggttaaccacggtcgtttgggtcgggtacccgg

SEQ ID NO: 246044 - DNA, 681 bp, Homo sapiens
  misc_feature: GYAE6OF01BL2IU.42.49.E05.1.454.CMB.1.raw
tcagtgacgtatgtcacgaccggtgctcgatttagagcgactagcaacacacaaaggggacccaaaaaccacacccctccttgggagaatcccctagatcacagctccctcaccatggacgggacctggagcatcctttcttgggtggcagcagcaacgaggtcgcccacctcccgaggttccaccgtggtgcagtctggagctgagctgcagacgccgtgggcctcgtagtgtagtcggtcctacgcgtctagtcgtctttacgtcggttaacctacgttccgttttaccgtaaccgttacggttacgtaggttaagttggttacgaaggacccggaccgggccccggtagggtacggggttcgttagggtaggtggtaggtacgggagtacggatccgtacgtaccgtaacggaaactaaacgagtaacgtagaggtaagaggtacgtacgaggagtagacgtacgctagaaccgtccgacggtaccggaataccgacgtacgacggtaacgtaacacaccgtaatacggacgtacgtaagggcgaacgtcacgaacgtactcgagacgtacccgacggtcccttaaagtctacggcacgtacgaaggttctaattacggcttacggcgttacgcgttaacgtccgtacgttaaccgcgttacgggtcgtgggtacccg

SEQ ID NO: 246045 - DNA, 680 bp, Homo sapiens
  misc_feature: GYAE6OF01DWMRC.42.49.E05.1.454.CMB.1.raw
  modified_base (353)..(353): a, c, t, g, unknown or other
  misc_feature (353)..(353): n is a, c, g, or t
  modified_base (609)..(609): a, c, t, g, unknown or other
  misc_feature (609)..(609): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtcgccctactcccgaggttcaccgtggtgcgagtcgtggagcgtgagctagcaggtacgccgttggggccctgagtgtagtggtcctctgctagttcgtcttcgtggttactacttcctttaccgacgtacgtagtagtagttggtagacgacgaccgggcccggtggacggtcgttaggaggtcggagtgggngtacggacgtaccgaccggtaacccgtaacggtaaaactaaacgtaggagttagagggtaagtaacggtacggtaccggaggtaacgaggtacgactacgtacgtacgtcccggaaccgccgtaacaccgtaccgaaccggtaacgaacgtaacctacgaacccgtaaagtacgtaccgggaacgttacggaccggtacgaccgtagtacgtacgtccgaacggaccgaacgtaccgtacttaacgttactaccgngtaccgacgttagacttcgttaagcgtagtccggtcgtcggtctacgtcgaccgttgcgttggcgtacggg

SEQ ID NO: 246046 - DNA, 720 bp, Homo sapiens
  misc_feature: GYAE6OF01BM1MI.42.49.E05.1.454.CMB.1.raw
  modified_base (429)..(429): a, c, t, g, unknown or other
  misc_feature (429)..(429): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtgcagcagcaacaggtcgcccactcccaggttcaccgtggtgcagtctggagctgagctgcaggagccgtgggcctgagtgagtggtcctccgtgctaggtcgtcctttcgtacggtttactactttccgtttaccctaccgttaccggttaagttacggttaagtttggttcgtaacggaccggtaccgggaccccccgggtaagggacggggtccgttaggagggtacgggtaggttgggaagtgggacgtcgtaacggtacccgtaacggaaactaaaacgnggtaacgtagacggagtacgtaagtacgaggcacgatcagtctactacgacgacgacgtaccatccgaacgtaacgcaacggtactacgaagtacggacgtaggacggacgtacctacgagtactagacgacggtacaccgtacctacgttacgaccgtacgacgtacggtaagtacgttacgtttacggtcggtacccgttacggtttccggtacccggtttaccggtacgttaacccggttaacgggttaacccgttcggggttaaccggtccgggggtaaaccccggg

SEQ ID NO: 246047 - DNA, 774 bp, Homo sapiens
  misc_feature: GYAE6OF01CJPUW.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccagtggacgggacctggagcattccttttcttggtggcagcagcaacaggtcgcccactcccaggttcaccgtggtgcagtcgtggagctgagctgcagacgccgtggggcctcgagtgagtggtctcctgctagtcgtcttcgttaggttactactttccttttaccgaaccgttacggtattaggtaagtttgggttagacgtaccggaccgggtcccccgggagggacggggtacgttaggacggttagggaggtggggagttacggacttaccggtaacggtaccccgtttaaacggaaaaccgtaaaaacggtaaggtaacggttaaggtaagggtaacgtaagggtaaacgttaccggaagggtacgaagtaacgtacgtaagtaccgtaacgtacccggaacccggtacggaacccaaccgtaaccgtacccgtaaacggtaaccggtaccgtaacggaacccgttaaacgacggttaacgggaacgttacgggaacgggtaccgtacccgtagaacgttacgtacggtacgaaccggaaccgtaccgtaccttaacgttactacgcgtacggacgtaagacgttagttacgtcgacctacggttccgtcgttcggtaccttacgtaaacccgcggttacgttggccgggtaccg

SEQ ID NO: 246048 - DNA, 821 bp, Homo sapiens
  misc_feature: GYAE6OF01CEQXX.42.49.E05.1.454.CMB.1.raw
tcagtgacgtatgtcacgaccggtgctcgatttagagcgactagcaacacacaaaggggacccaaaaaccacacccctccttgggagaactcccctagatcacagctcctcaccatggacgggacctggagcattccttttcttggtggcagcagcaacaggtcgcccactcccgaggttccaccgtggtgcagtcgtggagcgtgagctgcgagacgccggtcggggcctcgtagtgatcggtcctccgtgctagttgtccttcgttacggttactacttttcccttttacccgtaaccgttacggttagtagttaaggtttacggtaggtaacggtacccggacccggggtacccccggggagggtacggggtcgttagggtacgggttagggtaagggtgggacgttacgggtacgtaccggaacccggttaaccccggttaaaacggtaaaaccgtaaaaacggtaaggtaacggttaagtaacggggtaaacggtaacggtaaaccggttaccggaacgggtacggtaacggtacgtaacgtaccgtacgtaaccggtacccggaacccggtaccggaaccgtaacccgaaccgtaacccggtaacggtacgtaacccgtaacgtaccgtaacgtacggtacggtaaccgtgggaaccggactaccgacgtagtacgttacgacgaacccgacggtaacccgttacgtaacgttaacgttcggacggaccgacgtaggtacgttacgttacgtccggtactacgggtcgtccgtacgtccgtaaacgaccgttcgtacggttcgggtcggtaccgg

SEQ ID NO: 246049 - DNA, 618 bp, Homo sapiens
  misc_feature: GYAE6OF01B2X79.42.49.E05.1.454.CMB.1.raw
  modified_base (253)..(253): a, c, t, g, unknown or other
  misc_feature (253)..(253): n is a, c, g, or t
  modified_base (524)..(524): a, c, t, g, unknown or other
  misc_feature (524)..(524): n is a, c, g, or t
  modified_base (568)..(568): a, c, t, g, unknown or other
  misc_feature (568)..(568): n is a, c, g, or t
  modified_base (609)..(609): a, c, t, g, unknown or other
  misc_feature (609)..(609): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccacctggtgcagtctggagctgacgctgcagaagccgtggggcctcgagtgatggtcctcctggctagtgccgttntggttacattcgtttccaccgtagtactagtagttggttgagtacacggcccccggaggaggggtcttaggaggtggagtgggagtggacgtacgtacgtacccgttaacggaaactaaacgaacgtaggtaacgtaggaaggtagtacgtacggagggctaaggtagtacagtacacgtaccgaccgacgacgacgaacgtaccgacggaagtaacccgacggtacctaacgaacgtacggaacgtacggacgtacggccctacggaacncgtcgacgaccgaccggacccgtactacttcttagcgacgcganaagtgtactcggactcgtgccgtagcgttacgacgtacgtntggcggacg

SEQ ID NO: 246050 - DNA, 922 bp, Homo sapiens
  misc_feature: GYAE6OF01BIQL2.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgccactcccaggttcacctggtgcagtctggagctgagctgcagaacgccgtgggcctcagtgagttggtctctagcaggtgtcttctcggttacagttcttttccaccgtacgttataggtaatttgggttagacggtaccgaccgggacccccgggtaagggacgggggtaccgtttagggaacgggttgggtaaggttaggggtagttacgggtaacttccgtaaccggttaaccccggttaaaccgggtaaaaaccgttaaaaaccggaggtaaacggttaacggttagggaaaggtaaacgggttaaaccggtaccggtaaggggtaacggtaaccggtaaggtacctaaacgtacccgtaaacgttaccccgggaacccgggtaccgggaaaccttacccgtaaccgtaccccgtaaaccgggtaaaccggttaaaccgaaccgttaacccggttaaacgtaacggtttaaccggggaaaccggttgggaaaccgggtaacgtacccccgttaacggtaaacggtaaccggttaacgtaacccgggtaaaccggaaacccgggaccccggggtttaaaccctaacccggtttttaacgttacccggttaccggaacgggtaccggtaaagggtaactttaacgtttacggttaccggaccttaacccgggtttcggttaacccggttcggtaaacccgtttaccggttaacccggaaccggttttcggttacggggggtccgttaaacccggggg

SEQ ID NO: 246051 - DNA, 650 bp, Homo sapiens
  misc_feature: GYAE6OF01A7VO9.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactccccaggttcacctggtgcagtctggagctgagctgcagaagccgtggggcctcgagtgagtggtctccgtgcagtgtcttctggttacattcctttccaccttacggtatagtaattggttagagtacgacgggcccccggaggacggggtcgttacggtaggtggtagtgggagtaggacgtcgacgtacccgttaacggaaactaaacgagagtagtaggaagaggtaacgtcgtaggacagtacgctaagtacacgtaccgaccggacgacctactaccgtaccgacgtaacgtaaccacgacctaacgtacgtacgtaacgtagggacgacgacctacgacgtactcgtacggaacgacccgacggtacctaacttacttaccgcgtaccgagtacggtagtactttacgtacgtaccgtacgtccggttacgtcggtacctacggtaccgtacgttccggttggtcgggtacccgg

SEQ ID NO: 246052 - DNA, 742 bp, Homo sapiens
  misc_feature: GYAE6OF01EPYII.42.49.E05.1.454.CMB.1.raw
tcagtgacgtatgtcacgaccggtgctcgatttagagcgactagcaacacacaaaggggacccaaaaaccacaccctctgggagaatcccctagatcacagctcctcaccatggacgggacctggagcattccttttcttggtggcagcagcaacaggtcgcccacctcccaggttccaccgtggtgcagtcgtgggagctgagctgcgaaggacgccgtggggccttgagtgagtcggtcctccgtgctgtcgtcttcgtcgttactactttcctttaccaaccgttacggtacttaggttaagtttggttacgacgtaccggaccgggacccccgggtagggtacgggtccgttaggacggttggaacggtgggtagtaggtacgtacgaccgtacccggttaaacgtaaaactaaacgtagtaagtacgtagggaaggtaacggtaacgtcggaacgggacaggtacgtcgtaactcgaaccgtacccggaaccggaccggtaacaacgtacctaaccgaacggtacgtaacgaacgtaccctaacgtaaccggtacggaaccggtaggtaacggtaccgtaccgtacgtaacgtcgtaccgtaacggacccggtaaccgtaccgttacctaacgttttctaccggtacggaccgtagaacgtaagttacgttagtccgacgttaacggttcggtaccgtccgtacgtccgtaaacctggtacgttggcgggtacccgg

SEQ ID NO: 246053 - DNA, 724 bp, Homo sapiens
  misc_feature: GYAE6OF01BZ0SA.42.49.E05.1.454.CMB.1.raw
  modified_base (418)..(418): a, c, t, g, unknown or other
  misc_feature (418)..(418): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgctagtgtcttcgtggttactactttctttacccgtaaccttacggttatagtaagtttgggttacgacggacgtaccgggccccggtagggacggggtcgttaggaggtggaggtgggagtgggatcgacgtaccgttaacggaaactaaagagtagtacgtaggagagtacgtacgacgganaggtacgtcagtacactcgaaccgtcggaaacacgtaacgtcccgaagtacgtacgaacggtacctaacgtaagacgggtaagttaagggaaccggtacgaccgtacgtaacgtaggtaacccttacgggaacgtaacccgtacccgggtaaccttaacgttttaactaaccggtacggaccgaacggtaacggtacgttaacgtttacgtcgtacccgttaacggttccgggttaacccgtgggtaccctttaaaccgggtaacccgtacggttacccgggttacggggtacggtaacccccggg

SEQ ID NO: 246054 - DNA, 603 bp, Homo sapiens
  misc_feature: GYAE6OF01BZ307.42.49.E05.1.454.CMB.1.raw
  modified_base (224)..(224): a, c, t, g, unknown or other
  misc_feature (224)..(224): n is a, c, g, or t
  modified_base (309)..(309): a, c, t, g, unknown or other
  misc_feature (309)..(309): n is a, c, g, or t
  modified_base (439)..(439): a, c, t, g, unknown or other
  misc_feature (439)..(439): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactccccaggttcacctggtgcagtctggagctgagctgcagaagcctggggcctcagtnatggtactcctgcagtgacttctggttacatcttttccacctacggtatgaatggttgtagacagcccccggagagggcttgagnggatgggatggatcagccttaggaactaaaacagagtatggagagaagttccagggcaggatcgatcgaatcgaccgcgggacaacgatccacgaagtactaagccttaacatcggaacttgagggtacnctacagtaactcttagacgtacgaaccggtccgaaccttagtttaacccgtggtaccgacggtaaccgtaggtaacctttaagtttacggacgtaaccgttccgggtacccgtttacgggactttacgggaaacccctaccgtacgtttaggtggggtaacccg

SEQ ID NO: 246055 - DNA, 625 bp, Homo sapiens
  misc_feature: GYAE6OF01AW117.42.49.E05.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
  modified_base (560)..(560): a, c, t, g, unknown or other
  misc_feature (560)..(560): n is a, c, g, or t
tcagtgacgtatgtcacgaccggtgctcgatttagagcgactagcaacacacgaaaggggacccaaaaaccacacccctccttgggagaatcccctagatcacagctcctcaccagtgggacgggacctggagcattccttttcgtgggtgcagcagcaacaggtacccactcccgagttcaccgtggtgcngtcgnggagctgcgctgcagacgccggtcgggcctgacgtgtacgtgtccctcgagcgtagtctcttcgtcgttactctttccttaccgacgttaggtatgttagttgtagacggacgcccgggtccggaggtcggtctggagtgagtggatcggactcgacgtacgtaagtaaacagtgagtagaggagtaagtcgtacggagtacgaatgactacgtactacgccgacgaaccgactctacgacgagtaccgacacgtacctgtagacggtagcggacaccgtacgtagagcgtaagtacccggagtaaccccggtattacccgttaagttcgtcggtaccgacgagtaccgttatacgttaccgntaccgtagggttcgccgtgttaaccctgggtacccttggaaccggtttgccgggctacccggggg

SEQ ID NO: 246056 - DNA, 704 bp, Homo sapiens
  misc_feature: GYAE6OF01DPD05.42.49.E05.1.454.CMB.1.raw
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
  modified_base (343)..(343): a, c, t, g, unknown or other
  misc_feature (343)..(343): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttctggtggcagcagcaacaggtgcccactccccgaggttcacctggtgcagtctggagctgagctgcagagcgngggcctnagtgatggtctctgcaggtgcttcgtggttactacgttcttttccgacgttacgtatgtaagttggttgacgtacgaccggccccggaggtaggggcttggaggtggagtgggatggatacgngtacccgttaacggaaactaaacgagagtagtaggagtagaacggttcgaggtcagatactatcacgtcgaccgggacacacacgtccccgaagtactaacgcaacctacgagtacggaagtgggaacgacgtcccgtacgaacggtactacgtaccgaacggaccgtacccgggtaccttaaaccggttactttaaccggaccggtaacgggtaaccggtaacggttaaacggttaacgtttaacgttaccggtaacccggttacggttcccgggttaccgggtacccggtttaaacccggttacgggttaaacccccgtaggtttacccgggggtttgggtaccggggtaaccccgggg

SEQ ID NO: 246057 - DNA, 779 bp, Homo sapiens
  misc_feature: GYAE6OF01BRPOX.42.49.E05.1.454.CMB.1.raw
tcagtgacgtatgtcacgaccggtgctcgatttagagcgactagcaacacacaaaggggacccaaaaccacacccctccttgggagaatcccctagatcacagctcctcaccatggacgggacctggagcatccttttcttggtggcagcagcaacaggtgcccactccccaggttcacctggtgcagtcgtggagctgagctgcagagcctgggcctcgagtgattggtctccgtgcagtgtcttctggttactacttcttttccaccgttacggtatgtaagttggttgagacgacgggcccccggaggcggggtcttggaggtgggagtggggatgggtatcgtacggtaccccgttaacggaaaacctaaaacgacggtaaggttaacgtagggaaaggtaacggtaaacggtttaccgaaggggtacaacggtaacgtacgaacgtacgtaacgttaaccgaaccccgggacggtaaccaccgtaccgttaccccgaacggtaacgttaacccgaaacgtaccccgttaacgaacggttaccgggtaaacgtacgggaaacgggtaccgtacccgttaccggtaaaggtaccttaccggaacggtaaccccggaacgaacccgggtacccttaaacctttttaaacgttaccggttacggaccgtaaccggtaaggtaaccgtaagttttaccgtggacccttaccggttggttacccgtcgggtacttaccggtaaccccgtacggttccggttaggggtcgggtaaccccgg

SEQ ID NO: 246058 - DNA, 695 bp, Homo sapiens
  misc_feature: GYAE6OF01A7CV1.42.49.E05.1.454.CMB.1.raw
  modified_base (257)..(257): a, c, t, g, unknown or other
  misc_feature (257)..(257): n is a, c, g, or t
tcagtgacgtatgtcacgaccggtgctcgatttagagcgactagcaacacacaaaggggacccaaaaaccacacccctccttgggagaatcccctagatcacagctccctcaccatggacgggacctggagcattccttttcttggtggcagcagcaacaggtgcccactcccaggttcacctggtgcagtctggagctgagctgcagaagccgtggggcctcgagtgagtggtctcctgcagtgcttctggttacnttctttcctacctacggtatgtattggtgagacgaccgggcccccggtaggacggggtcgttagaggttaggagtcggggtagtgggtactcgaacggtacccgttaaacggaaacgtaaaaacgagacggtaagtaggaaggtagtaaacggttccgaagggtcaaggtaacgtcgaatcgaacgtccgaacccgacggaaccaaccacgttacccgaacggtaacgtaaccacgtaccctaaacgtagtacgggaacgtacgggaacggacgtacccgtacgacgtaacgtcgaacgaaccggaaccgtaccccggtaccttaactttacgttaccgtaggcccggagtaagtacgtatttacggtcgacgttccggtacggttcccgtcgggtaccttacggtaaacccctgggtttcgtcgggtcgggtaccgg

SEQ ID NO: 246059 - DNA, 692 bp, Homo sapiens
  misc_feature: GYAE6OF01CWY3U.42.49.E05.1.454.CMB.1.raw
  modified_base (195)..(195): a, c, t, g, unknown or other
  misc_feature (195)..(195): n is a, c, g, or t
  modified_base (668)..(668): a, c, t, g, unknown or other
  misc_feature (668)..(668): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctgganctgagctgcagaagccgtggggcctcgagtgagtggtctcctgcagtgcttctgtacattcctttccaccttacggtatcgtaattggttgagacgcggtcccccggaggacgggggtcttggagtcggagtagggagtggatacgacgtacccttacggaaactaaaacgacgaagtagtaggaacggtaaggtaaggttccgaacgggtcgaaggtacgtactataccgtaacgtaccgaacccgcgggaaaccaaccgtacgttaccccaaacgtaacgtaacccaacggtacctaaacctaggtacggaaacgtggaaccgggaagtcccctaacgaggtaacttcgtaacgaaccggacccgaaccgggtccctaactttaacgttaccgttcggacggtacggtaaggtagttaacttagttcggaccttaccggtcggttcccgtaggtccgttaacgtaaacccncggttcgtcgggtcggtacccggg

SEQ ID NO: 246060 - DNA, 889 bp, Homo sapiens
  misc_feature: GYAE6OF01BC678.42.49.E05.1.454.CMB.1.raw
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
tcagtgacgtatgtcacgaccggtgctcgatttagagcgactagcaacacacaaaggggacccaaaaaccacacccctccttgggagaatcccctagatcacagctcctcaccagtggacggacctggagcatccttttctggtggcagcagcaacaggtcgcccactcccgaggttcaccgtggtgacngtcngganctgngctgcagagccgtgggcctcgagtcgtagttcggtctccgtgcgtagtcgtcttcgttggttactcgtttccgttacctaccgtagttacgtagttaagttgttaggacgaccggtccgggaccccggtagggtacggggtcgttacgggaggttacgggaggttaggggtactagggtaccgtacggtacccggttaaccccggttaaaacggaaaacccgttaaaagtacgggtaaacgtaggtaaggggaacggtaaccggttaacgggttaccgggaaccggtaaggtaacgggtaataccgaagtttccggaacgttaccccggaacgggaccggaaccgtaacggtacccgtaaccgtaacggtaaacgttaaccgtaaccggtaacgtaaccggtacggtaacgggtaacggtacggtaaaacgggtccgacccgtagtacccgaagttacccggaaccgggtaacctaaccccggtacccgtaaccgtttaaccggtttaaccgttaacgggcccggttaacgggtaaccggtaaggtttaacccgggttaaccgttttaaggtcccggttaacccgttccgggtttccgggtttaccccggttacgggtaccgtttacccgggtaacccggttaaggttttcccccggggttaagggttcccgggtaaaccccggggg

SEQ ID NO: 246061 - DNA, 917 bp, Homo sapiens
  misc_feature: GYAE6OF01CH5TC.42.49.E05.1.454.CMB.1.raw
tcagtgacgtatgtcacgaccggtgctcgatttagagcgactagcaacacacaaaggggacccaaaaaccacacccctccttggggagaactcccctagatcacagctcctcaccagtgggacggacctggagcattccttttcgttgggtggcgagcagctaacgaggtcgccctacctcccgtaggttaccaccgttggtcgctagtcgtaggagtctgagctgacgagacgtccggtcgggacctcgagtgtagtcggttcctccgtagcgtaggttcgtcctttcgttacggttactacgtttccgttttacccaaccggttacggtagtacgttaaggtttggtacgaaccggtaccggacccggggtacccccgggaggggtacgggggtctttagggtacgggttacggtagggttagggtaacggtacggtacgtaccggtaaccggttaaaccccggtaaaccgggtaaaaaccgtaaaacgtagggtaaacgttaaggtacggggtaaacggtaaacggttaaccggttccgggaagggtaccgtaaggtaacgtacctaaacgtaccgtaccgtaacccggacccgggtaccggaaccctaactaaccggtacccgaaacggtaaccgtaaaccgtaccggtaaccctaaacgggtacgttaaccgggaaagggttcggaaacgggtaccgtaccccgtacgtaacggtaccgttaccggaacgggaaccccgtaaccgtaacccgggttaccgttaacgttttacgttaccggaccggtaccgtaaccgggtaaagtacgttaaacgttaccgtttacggacccttaccgggtttcgtacccggtaggttaccccgtaaccggttacccggtacgggtttccgtcggggtaaccgggtacccggg

SEQ ID NO: 246062 - DNA, 705 bp, Homo sapiens
  misc_feature: GYAE6OF01CSKG4.42.49.E05.1.454.CMB.1.raw
  modified_base (128)..(128): a, c, t, g, unknown or other
  misc_feature (128)..(128): n is a, c, g, or t
  modified_base (161)..(161): a, c, t, g, unknown or other
  misc_feature (161)..(161): n is a, c, g, or t
tcagtgacgtatgtcacgaccggtgctcgatttagagcgactagcaacacacaaaggggacccaaaaccacacccctcattgggagaatcccctagatcacagctcctcaccatggacggacctggancattccttttctggtggcagcagcaacaggtcncccactcccaggttccaccgtggtagcagtcgtaggatcgtgagctgacaggacgtccgtggggcctacgagtgtactcggtcctccgtcgacttaggtctcttcgtagttacctacgttcctttaccgacgttacgttagttacggtaagtttggtacgacgacggaccggggacccggtagggtacggtgtcggaggttaggaggttgggtactggactacgtacgtacccgtaagaaacgtaagacgtagttagaggtaagacgttaacgtacggtaggagagtacgacgtagttaccgaacgtaccgaaccggactaaccgacgtaaccgttaccgaacggtaacgaaccgacgtacctaacggacgtttaaggacgacgggtaacgtcgtaaccggtacacggtactcgtaacggaacccgaccggttccgaacttacttacgtagtcgaacgttacggaagttacgtagttaccgttacgtacgtacggttccgggtctacggtaccttacgggaccttggttcggtggtaacccggg

SEQ ID NO: 246063 - DNA, 663 bp, Homo sapiens
  misc_feature: GYAE6OF01B0U4T.42.49.E05.1.454.CMB.1.raw
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtncagtctgganctgagctgcagaagccgtgggcctcgagtgatggtctcctgcagtgcttctgttactnttctttaccaccgtacgtatgtaagttggttgacgacgacggaccccggagacgggtcttggagtggagtggagtgactcgacgtacccgtaacgaaactaaaacgagagtaagaggtaagaggtaacgttacgaggacagtagactagtctacgacctaccgacggaaccaacgtactaccgaacgaacgtacgaacgacctaacgaacgtacggaaccgtggaacggtacgacccgttaacgaacgttacctacgtaacgtaacccgaacccgaaccggtaccttaaaccgtttaacttacggtccgaacgtaccggaaaggttactaaagtttacgtacgtacgttaccggttcgtacgtcggtaccttaccgaacccgttaacggtccgtttgggcggtaacccgg

SEQ ID NO: 246064 - DNA, 727 bp, Homo sapiens
  misc_feature: GYAE6OF01BB9RS.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctcgagtgagtggtctcctgcagtgtctttcgtggttacctactttccttttaccaccgttacggtatagtaagtttggttagacgacgccgggacccccggaggaggggtgttggtaggtggtagtgggatgggtactccgacgtacccgttaaaggaaactaaaacgagtaagtaagtacgggagtaacggtaacgttcggaacggacgtaggacgtacgtatacgaaccgtaccgaccggacggaacctacgaaccgtaccgaaaccggaagttaacccgacggttaacccaaacgtacggtaacgggtaaaccgtaggggaccggtaccgtcctacggaacgtacgtacgtacggaaccccggtaacgtacccggttaacccttaacttttaacgccggtacggacgtaccgtaagtagttaacgtttaacgttcggaaccttccggttggtacccggttgtaaccgtaccgtaaccgtaggttccgttaggggtgggtacccggg

SEQ ID NO: 246065 - DNA, 809 bp, Homo sapiens
  misc_feature: GYAE6OF01ERUCR.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttccaccgtggtgcagtcgtggagctggagctgcaggacgccgtggggcctcgagtgagtcggtcctccgtgcgtagtcgtcttcgtggttactattccttttccaccgttacggtatagtaattggtagacgtaccgacgggtcccccggaagggtacgggggtccgttggtaagggttcgggtaaggttacggggtagttacggggtacttaccgaaccggttaccccggtttaaaacgggtaaaaaccgttaaaaaccgtaggtaaggtttaacggtaaggggtaaacggtaacgggtaacggttaccggaacgggtacgaacggtaacggtaactaaccgtacgtaaccgtaccggaacccgggacggtaaccgaccgtaaccgtacccgaacggtaacgtaacccacgtacctaagaacgtacgggtaaacgtagggacggtacccgtaccgtacgtaacgtacgtcgtaacggaaccggtaccgtaaccgggtaccttaacgtttaactaccggtacggtaccgaacggtacggtaacggttaacgttaggttccggattaccggttccggttaccgtcggtacgttaacccgtacgtaccggttcggtttgggccggttaacccggg

SEQ ID NO: 246066 - DNA, 729 bp, Homo sapiens
  misc_feature: GYAE6OF01CX8E0.42.49.E05.1.454.CMB.1.raw
tcagtgacgtatgtcacgaccggtgctcgatttagagcgactagcaacacacaaaaggggacccaaaaaccacacccctccttgggagaatcccctagatcacagctcctcaccatggacgggacctggagcatccttttctggtggcagcagtcaacaggtcgccctactcccgaggttccaccgtggtgcagtctggagctgagcgtgcaggacgccgtcggggcctcgagtgatcggtctcctgctagtcgcttcgtggttactacttccttttccaaccgttacggttatcggtaagttgggttacgacgacgacgggcccccggaggacggggtcttaggaggtacgggagtgggagtggactacgacgtaccgttaacggaaactaaacgagagtagtaggagtaaggtaagttccgaggcgaagtacgtcacgtcgacgtacgacggtcgaacacacgtaccaacggacgtaccgacgtacctaagacgtacggaacgttacgggaacggtaccgtacctacgaacgtacgtaccgtaaccggaaccgaaccggtaaccgggtacccttaacgtttaacgttaccgtacggtaccggtacggtaacggtaaacgttaaggttacgttacgggaccgttaccggttaccggttaccggttagggtacccgtttaacgggtaaccccgtaggtttcccgggttagggtccgggttaaccccggg

SEQ ID NO: 246067 - DNA, 759 bp, Homo sapiens
  misc_feature: GYAE6OF01C9P54.42.49.E05.1.454.CMB.1.raw
tcagtgacgtatgtcacgaccggtgctcgatttagagcgactagcaacacacaaaggggacctaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtcctcctgcaggtgtcgttcttcggttactactttccttttacccaccgttacggttatacgtaagtttggttagacgacgtaccgggcccccggtaggacgggggtcttaggagggtggaggtagggagtgggactacgtacggtacccgttaaacggaaaacctaaaacgaggtaacgttagtagggaagaacggtaacggttaccggagggtcaacggtagtctatacgtactaccgaaccggtccggaacaacctaccgtacccgaacggaacgttaacccacgttaaccctaacggtaacgtacgggtaaacgtgggtaaccggacgtacccgtcgtaacgtacgttcggtaacgaacccggtaacccgtaccgggtaccttaaacgtttaccgttaacggtcgacggttacggaacggtaagttactttaacggttccggtacgttaccggttcggttacccgttgggtaaccttaccgggttaaaccctcgggtttaaccgttggggtaccgggtaacccggg

SEQ ID NO: 246068 - DNA, 829 bp, Homo sapiens
  misc_feature: GYAE6OF01CUWUG.42.49.E05.1.454.CMB.1.raw
tcagtgacgtatgtcacgaccggtgctcgatttagagcgactagcaacacacaaaggggacccaaaaaccacacccctccttgggagaactcccctagatcacagctcctcaccagtggacgggacctggacgcatccttttcgtggtcggcagcagcaacaggtcgcccactcccgaggttcaccgtgtgcagtcgtggagtccgtgagcgtgacgaggacgccgtggggaccctgagtgtacgtcggtcctcgtagactagtcgtcgtttcgtacggttactacgttcccgtttaccgaccgttaggtcgttaagttacgttgggtagtaaccgaccggaacgggtaccccgggtagggtacgggtccttagggaaggtggaggttacggggagttaccggacgtaccgtaaccggtacccggtttaaacggaaaacctaaacggtaggaccggttaacggtaaggggaacggtaacggtaaaccggttaccggaacgggtaaccgtaggtaacgtacgtaacgtacgtaaaccgtacccggaacggtacgtaaaccgaaccgtaacgtaccggaaacgtaaccgtaaccggtacgttaacccgaaagtaacgggtaacggtaaccggaagggaccgtaccgtaccgtagaaccggtacggtacgtaaccgggaaccgtacccggaccgtttaccgtaacgtttaccgttaccggacggttaccggaacgttaacggtaaacgttagtaccggtaccgttacgtaccgttacggtccgtacggaccttaacccggtagttaccggcgtttcggggcgttaacccggg

SEQ ID NO: 246069 - DNA, 819 bp, Homo sapiens
  misc_feature: GYAE6OF01CDKHF.42.49.E05.1.454.CMB.1.raw
  modified_base (261)..(261): a, c, t, g, unknown or other
  misc_feature (261)..(261): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcgtggtggcagcagcaacaggtgcccactcccaggttccacgtggtgcagtctggagctgagctgcagagccgtgggcctcgagtgagtcggtctcgtgcgtagtgcttcgtaggttaactnttccttttacccaccgttacggtagtagtaatttgggttcgaacggtaccgtaccggggaccccccgggaggtaacgggggtccttaggtacggtggtaacggtgggtacgtagggtactaccgtacggtaccccgttaaacgggaaaactaaacgaggtaagtagtaggaacgtaaggtaacgttcgaagggaccgtaagacggtacgtatacgtacgtacggaacccgacggtaaccacgtacgtacccgaacggtacgttaacccgacgtaaccccttaagaaccgggtttacggggaaacctttacgggaacgggtaacccgtacccccggtaggttaaacggtacccgttaccggtaacgggtaaaaccccggaccgggttaaaccccgggtcctttaaacccgttacggtttaaacccggcgggtccgtaaccgggtaagttaggtaaccctttttacgggtccgaaccgtttacccgggtcggggtttaccctggttaaacccgtcccgttaaacccgcggtttttaacggccggggtacggtacccgggg

SEQ ID NO: 246070 - DNA, 953 bp, Homo sapiens
  misc_feature: GYAE6OF01A0IGM.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatgggacgggacctggagcattccttttcttggtggcagcagcaacaggtgcccactcccaggttccaccgtggtgcagtcgtggagctgagctgcagacgccgtggggcctcgagtgatcggtcctccgtgcaggttcgtcctttcgttggttaacctactttcccttttacccgaacccgttaacggttattaggttaacgtttgggtttacggaacggaccggaaccggggtacccccccgggggtaagggtaggggggtacctttaggggtaacgggttagggtaggttaggggtaagtacgggttaactaccggtaaccggttaccccggtttaaaaccggaaaacgttaaaaaccggaggtaacgttaaacgggtacgggtaaacggtaaggtaaaccgggtttaccggaacggggtactaacggtacggtaaactaacgtacctaacgttacccggaacccggtacccggggtaacaaccgttaaccgtacccgggtaaacgtaaccggttaaccgtaaaccggtaacccttaaaccggtaacggttaacggggtaaaccttaggggaaacccggttacggacccttaacggtaaccggtaacgttaccgtaacggaacccggaacccgtaacccggggtaaccctttaacggtttaaccgtttaaccggcgggtaaccggtacgggtaaacgtaacggttaaacgtttcggtttaacggtaaccgtttaccgggttaaccgggtttaccccgggttagggttaacccgtttaaacccgggtaacccggttacccgtttaccgggttacggggttacgggggtaacccccggg

SEQ ID NO: 246071 - DNA, 820 bp, Homo sapiens
  misc_feature: GYAE6OF01D3QSM.42.49.E05.1.454.CMB.1.raw
  modified_base (200)..(200): a, c, t, g, unknown or other
  misc_feature (200)..(200): n is a, c, g, or t
  modified_base (811)..(811): a, c, t, g, unknown or other
  misc_feature (811)..(811): n is a, c, g, or t
tcagtgacgtatgtcacgaccggtgctcgatttagagcgactagcaacacacaaagggacccaaaaaccacacccctcctgggagaatcccctagatcacagctcctcaccatggacgggacctggagcatccttttcttggtggcagcagcaacgaggtcgcccactcccaggttccacctggtgcagtctggagctgngctgcagaagtccgtgggcctcgagtgtacgtcggtcctccgtgcgagtcgtcttcgttggttacctactttcctttaccctaccggttacggttacgttagtaacgtttggttacgaacgtacggacccgggtcccccggggtaggtacgggggtcgttgggtaacggtggggtaggttagggtagttacgggtacgtaccgtaaccggttaaccccggttaaaacggtaaaaccgttaaaacgaaggtaaggttaaggtacgggtaaggtaacggtaaccggttacggacgggaacgtacggtacgtactacgtaccgtaaccgtcccgtaacccgggtcgaaccgtaacgtaccgtaacccggaacggtaaccgtacccgtaacgtaccccgtaacgtaacggtacggtaaaccggtaggaaccgggtacctaccggttacaacggttaaccgtcggaaccggaaccggtaccccgtacgttaacccgtttaacgttaccgtaccgtcgggtacccgtagggttaacgttagtacgtttaaggtccgtaccgtacgttcggttaccgtcggttaaccgtaccggttaccgtaccgttggttaccgggnggtacccgg

SEQ ID NO: 246072 - DNA, 661 bp, Homo sapiens
  misc_feature: GYAE6OF01BDBRZ.42.49.E05.1.454.CMB.1.raw
  modified_base (203)..(203): a, c, t, g, unknown or other
  misc_feature (203)..(203): n is a, c, g, or t
tcagtgacgtatgtcacgaccggtgctcgatttagagcgactagcaacgacacaaaggggacccaaaaaccacacccctccttgggagaatcccctagatcacagctcctcaccatggacgggacctggagcatcctttcttggtggcagcagcaacaggtcgcccactcccaggttccaccgtggtgcagtctggagctganctgcagaagcctgggcctcagtgatggtctcctagctagtgtcttcgtgttactattctttccaccgtacggtatagtaattggttagacgtaccgacgggtacccccggaggacgggtacgttggaggtggacgtgggagtggactcgtacgacccgttaacgaaactaaacgacgtacgtagtggaagagacgttccgaggacagacgtcactacactaccgaccgcgtacacgtacgtaccgagtacgtaaccacgtcgaactacgtaggaacgtaggaacggacgaccttacgaagttacgtacgtaaccggacggaaccgaccggtaccctaatttaccgtacgtaccggagtaccggaagtaagtaccgttaagtccgtaccgtacggttccggttaccgtagggtaccttaacccggtacccgacggttacccgttcgggtccggtaccgg

SEQ ID NO: 246073 - DNA, 773 bp, Homo sapiens
  misc_feature: GYAE6OF01CKOEY.42.49.E05.1.454.CMB.1.raw
  modified_base (346)..(346): a, c, t, g, unknown or other
  misc_feature (346)..(346): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccgaggttccaccgtggtgcagtctggagctgagctgcagagccgtggggcctcgagtgagtcggtctcctgcagtcgcgttcgtggttactactttccttttacccaccgttacggttataggttaagttggttagacgaccgaccgggccccggaggcggggtctggaggtggngtggagtggactacgacgtacccgtaacggaaactaaacgagtaagtagtaggagaggtaacgtacgaggtacgaagtacgtacagtactacgtaccgacggtaccgaacgtaccgacgtaccgtaacgaacgttaacgccgtaaccgttacgacgtacggaacgtagggaacggtaccgtaccgtacgtaacggtacttaccggtaacgtaacccgaacccgtaaccgggtacccctttaaacgttttaaccgttaccgtacgggacccggtaacggtaacggttaaacggttaacgttttacggtaaccgttacccggtaacccggttttacccggggtacccgtttaccgggtaaccgtttaacccggttaaacccgggttccgggttaccggggttttcccgggttccgggggaaaccccggg

SEQ ID NO: 246074 - DNA, 821 bp, Homo sapiens
  misc_feature: GYAE6OF01CWGNF.42.49.E05.1.454.CMB.1.raw
  modified_base (290)..(290): a, c, t, g, unknown or other
  misc_feature (290)..(290): n is a, c, g, or t
tcagtgacgtatgtcacgaccggtgctcgatttagagcgactagcaacacacaaaggggacccaaaaaccacacccctccttgggagaactcccctagatcacagcctcctcaccagtgggaccgggacctggagcattcctttttgttgggtggcagcagcaacgaggtcgccctacctcccgtaggttccaccgtgggtgctaggtcgtggagtcgtgacgtcgtagcgaaggaacggtccggtcggggcctacgtaggtgtagtcggttcctcgtgctaggttcgtnttcgttgttactcgtttccttacctaccgttagtataggttacgttggtacggacgtaccggcccggggtacccggaaggggtcggggttgttacggtgggtacgggtaggtcgggtaagtaggtaccgtaacggtacccggtaaaccgtttaaacggaaaacgtaaaaccggaggttaacgtaggggtaagtacgggtaaagtaaccgggttaccgggaaggacgtaaggtaaccggtctaacggtaacttaccgacgtaaccggaccggaactacgtaccgtaacgaacgtaacgtacgaaccgtaccgtaacgtaggtaacgggaccgttagggaaccgtacgtaccctagtaccgacgttccggaacgtaccgaaccggtaccttaccggttaacgttaacgtaccggagaccggtcgaaggttgttaaccgtttagggaccttacgggttaagttcccggttacgtccggttaaccgtaaccggtaccggttaccggttcggtaacggggtcccgggtaaccgggg

SEQ ID NO: 246075 - DNA, 796 bp, Homo sapiens
  misc_feature: GYAE6OF01ETC05.42.49.E05.1.454.CMB.1.raw
  modified_base (258)..(258): a, c, t, g, unknown or other
  misc_feature (258)..(258): n is a, c, g, or t
tcagtgacgtatgtcacgaccggtgctcgatttagagcgactagcaacacacaaaggggacccaaaaaccacacccctccttgggagaatcccctagatcacagctcctcaccatgggacgggacctggagcatccttttcttgggtggcagcagcaacaggtgcccactcccaggttccacctggtgcagtctggagctgagctgctagagccgtgggcctcagtgatggtctcctgcagtcgtcttcgtggttacncttcttaccacgtacggtactgtaattggttgagacgaccggcccggaggacgggtctgaggtggagtcgggtagtggactacgacgtaccgtaacggaaactaaacgagtacgtaggtagggaagtaacggtaacggttaccgagggacgtacggtaagtaccgaacgttacgaaccgttccggaacccggtaccgggtaaccaacccgttaccgaacccgtaaccggtaaccggttaaccgaaacccggttacccgtaaacgtaacggtaacgggtaaaccggtaacggtaaccggggaacctcccggttaaccggtaacggttaccgttaacggttaacccgggaaaccgggtaacccggtaaccccgggtaaccgtttaaccggttttacgttaacccgggtacggtacccggtaacgggtaacggtaaacgtttaccgtttagtaccggtaccgttacggtaccgggtaccgttacggttaacccgttacgtaccccggtagttaccgggtttggggtacccgggtacccggg

SEQ ID NO: 246076 - DNA, 713 bp, Homo sapiens
  misc_feature: GYAE6OF01BZWAL.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctccgtgcagtgtcttctggttacattccttttccaccgtacggtatagtaattggttgagacgacgggcccccggaggaggggcgttaggaggtgggagtgggagtggtatcgacggtaccccgttaacggaaactaaaacgaagaggtagtagggaaggaaggtaacggttaccgaacggggtcaaggacgtactatacacgtacccgaccggacggaaccacgtaccgacccgaacgtaacgtaccgaacgtacccgttaacgaagtacgggaacgttacggaacgggtaccgacccgtacgaacggtaaccgttcgtaacggaaccgaccgaacccggtacccttaactttaccgtaccgtacgggaccgaacgggtaacgtacgttaagtttagttcggtacccttacggttccgggtaccgttcgggacccgttacggtaacccttaccggttcgttacgggtcggggtaacccggg

SEQ ID NO: 246077 - DNA, 692 bp, Homo sapiens
  misc_feature: GYAE6OF01C8N3N.42.49.E05.1.454.CMB.1.raw
  modified_base (140)..(140): a, c, t, g, unknown or other
  misc_feature (140)..(140): n is a, c, g, or t
tcagtgacgtatgtcacgaccggtgctcgatttagagcgactagcaacacacaaaggggacccaaaaaccaccacccctcttgggagaatccctagatcacagctcctcaccatggacgggacctggagcattccttttnttgggtgcagcagcaacgaggtcgcccacctcccgaggttccaccgtggtgcagtcgtggagctggagctgacaaggacggccgtgggacctcgagtgagtcgtctccgtagcaggtcgtactttcggtagttactactttccgttttaccctaaccggttacggttacgttagttaacgtttgggttacgaacggtacggacccgggccccggtagggacggggtacttagggagtggagtgggcgtaggatacggaactaccgtaacgaaaactaagaggtagtaggtaggtaagtaacggtaacgtcggaaggtacaagtacgactagtacactaaccgaccggagaacctaaccgtcgaaccgtacgaacgtaacgccggtaactaacggacgtacggaagtacggaacgacgtaccaagactagtcgaacgaccgtaaccgacgtacttacttacgtacgcgacgagtaagagttgttacgcgtacgttaacggtccgtaaccggttgtaacgttaccgaacgtccgttacggtagggtcggtacgg

SEQ ID NO: 246078 - DNA, 751 bp, Homo sapiens
  misc_feature: GYAE6OF01BWICY.42.49.E05.1.454.CMB.1.raw
  modified_base (140)..(140): a, c, t, g, unknown or other
  misc_feature (140)..(140): n is a, c, g, or t
  modified_base (254)..(254): a, c, t, g, unknown or other
  misc_feature (254)..(254): n is a, c, g, or t
  modified_base (499)..(499): a, c, t, g, unknown or other
  misc_feature (499)..(499): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttnttgggtgcagcagcaacgaggtcgcccactcccgaggttcaccgtggtgcagtcgtggacgctgacgctcgacgagacgccgtcgggcctacgaggtgacgttcggtactccgngccgtagtcgtcgtttcgtacggttacctactttcctttaccgaaccgttacggtattagtaacgtttggttacgaacggtaccggacccggtaccccggggaaggtacggggtcgttaggaggtgggtaacggtagggtacgtagggactaccggtaaccgttaacccggttaaacggaaaactaaacgaggtaacgtaggtaggaagtaacggtaacgttacggacggtacgaaggtacgtanaacgtcgtaacgaccggtaccgacggtacaccgtactaccggaacgtaacacgacgtactaacgtaggtacgaactagggacgtaccgtaccgtaagacgtacgtcgtaaaccgccgaaccgtacccgtaccttaaacgtttaccgtacggacgaccgtaaggtaacgtaagtttactacggtcgtaccgtacggttccggtccgtacgtaccgttaccggtacctaggttccggtaagggtcgggtacccg

SEQ ID NO: 246079 - DNA, 728 bp, Homo sapiens
  misc_feature: GYAE6OF01A6YOF.42.49.E05.1.454.CMB.1.raw
  modified_base (602)..(602): a, c, t, g, unknown or other
  misc_feature (602)..(602): n is a, c, g, or t
tcagtgacgtatgtcacgaccggtgctcgatttagagcgactagcaacacacaaaggggacccaaaaaccacacccctcttgggagaatcccctagatcacagctcctcaccatggacgggacctggagcattccttttctggtggcagcagcaacgaggtcgccctactcccgtagggttccaccgtggtcgactagtcgtggagcgtgacgtctagaccgaaggtacggccggtcggggtccctcgtaaggttcgagttcggtcctccgtagccgtaggttcgtacctttcgttacggttacctacttttcccgttttaccgtaaccgttacggttattacgttaaggttggttacggaacgtaccggtaccgggtaccccggtagggtacgggtcgttaggaggtgggtacggtgggtagtacggtactcgtaaccggttaccgttaaacggaaaactaaacgagtaaggtagaggtaaggtaacggtacgtaccggaggatacggtacgtactacgtacgtactaccggacgacgaacctacgaccgtacgagtacgtacacgactagacgtacggtagtaggacgtacgcgtaacgngtactacgacgaactacggacctacctacttacgcgacgtaccggagtacgtagttacttcgacgtaccgttagtccggtaccgtgtaccgtaacgtacccgaggttcgtacgggtcggaaccggg

SEQ ID NO: 246080 - DNA, 717 bp, Homo sapiens
  misc_feature: GYAE6OF01AILAB.42.49.E05.1.454.CMB.1.raw
  modified_base (161)..(161): a, c, t, g, unknown or other
  misc_feature (161)..(161): n is a, c, g, or t
  modified_base (670)..(670): a, c, t, g, unknown or other
  misc_feature (670)..(670): n is a, c, g, or t
  modified_base (695)..(695): a, c, t, g, unknown or other
  misc_feature (695)..(695): n is a, c, g, or t
tcagtgacgtatgtcacgaccggtgctcgatttagagcgactagcaacacacaaaggggacccaaaaaccacacccctccttgggagaatcccctagatcacagctcctcaccatgggacgggacctggagcatcctttctggtggcagcagcaacaggtnccccactccccaggttccaccgtggtgcacgtctggagctgagctgcagacgccgtgggcctcagtgagtcggtctccgcgcgtagttcgtcctttcgttcggtttacctactttccttttacccctacccgttaaccggttattaggttaacgtttcggtttaggaacgtacccgtaccgggaccccccgggtaggggtacgggggtcggttggtaggtacgggtaggtagggtaggtacggtacgtaccgtaccgtaccccgtaaaccgggtaaaccgtaaaacgaggtaaggtaaggtaggaacgtaaggtaacggttccggaacgggacgaggtacgtaacgtacttaccgactaccgaccggtaaccgaccgtaacctacctacccgaacggtacgtaacaacgtcctaacgtacggtacgaacgaggtacgcgtacctacgactacgtacacgtacgaccgaccgtacttacgttagtacgtcgcgacgagcttatcgtcgtntcggttcgggtctacgtccgtaacnccgtacgtcgtcggtcgccggg

SEQ ID NO: 246081 - DNA, 840 bp, Homo sapiens
  misc_feature: GYAE6OF01BHIKM.42.49.E05.1.454.CMB.1.raw
  modified_base (168)..(168): a, c, t, g, unknown or other
  misc_feature (168)..(168): n is a, c, g, or t
tcagtgacgtatgtcacgaccggtgctcgatttagagcgactagcaacacacaaaggggacccaaaaaccacacccctccttgggagaatcccctagatcacagctcctcaccagtggacggacctggagctattccttttcgttggtggcagcagtcaacgaggtcnccctactcccgtaggttcctaccgtgggtgactagttcgtggacgtcgtagcgctgacaaggacgtcccggtgggcctagtaggtgtacgttcggtccttccgtggactacggttcgttacccgtttgttacggttacttaccgtttcccgttttaccggtaacccgttacggtagttacggttaaggtttgggttacggaaccggtaacccgggtaccccgggtacccccggggtagggtacggggttaccgttagggtagggttagggtaacggtggggtaacgttggtaaccgttaccggtaaccggtaacccggtttaaacggaaaacgttaaacggtacgaaaggttacggtaagggaacgtaggttaaccggtaccggagggacgtaaggtaccgtacgtagtaccgtacgtacccggaccggcgtaacctaacgtaccgtacggtaacgtaccgtaaccgtacgtaccgtaacgtaggaaccggtaagtacggtacggtactcgacgtacgaccgtacggtacgaacgtccgtaccggtacttacgttaacgtacggtcgaaacggcgtaaagtcgggttaattccgggttagtaccgtcggtaacggttccgttacgttacccggtaacgtcggttaccgtcgggttaacccggtcgggtccgg

SEQ ID NO: 246082 - DNA, 774 bp, Homo sapiens
  misc_feature: GYAE6OF01DU39Q.42.49.E05.1.454.CMB.1.raw
  modified_base (199)..(199): a, c, t, g, unknown or other
  misc_feature (199)..(199): n is a, c, g, or t
  modified_base (515)..(515): a, c, t, g, unknown or other
  misc_feature (515)..(515): n is a, c, g, or t
  modified_base (710)..(710): a, c, t, g, unknown or other
  misc_feature (710)..(710): n is a, c, g, or t
tcagtgacgtatgtcacgaccggtgctcgatttagagcgactagcaacacacaaagggacccaaaaccacacccctccttgggagaatcccctagatcacagcctcctcaccagtggacgggacctggagcattccttttcttggtggcagcagcaacaggtcgcccactcccgaggttccacctggtgcagtctgganctcgagcgtgacacgtagccgtggggaccttcgaaggtgtacgtcggtcctaccgtcgtcgtacggttcgtccgtttcgtaggttaccgttactttacccgtttttaccccgtaacccgttaacggttagttaggttaacgtttaggggttacggtacggtaacccggtaccggggtaccccccgggaaggggtaacggggtccgttaggtacgggttacgggtaggttacgggtagttacggactaccgtaaccgttacccgttaaaccgaaacgttaaaacagtagtacgtaggaacgtagtaacgtcggaggngagtacgtctatacgtaccgtaaccggacccgtacggaaccacccgtaacgtaccgaacgtaacgtacccctagtaaccttaacgaaggtacggtaacggacggacggtaccgtaccgttacacggtatacgtcgaacgaccgtacgttaccctaacggtttactacgtggtaccagggacttacgtagtacgtntacccggtcgttacggtccgtacggaccgttaacgtacccggtaagttcggtcgtagggtcccg

SEQ ID NO: 246083 - DNA, 850 bp, Homo sapiens
  misc_feature: GYAE6OF01CL23E.42.49.E05.1.454.CMB.1.raw
tcagtgacgtatgtcacgaccggtgctcgatttagagcgactagcaacacacaaaggggacccaaaaccacacccctctgggagaactccctagatcacagctcctacaccagtcgggaccggggacctgggagcactttcctttttcgtgggtggtagcagacaacgagggtcgccccactcccgtaggttccaccgtggtcgacgtaggttcgtagggacgctggagtcctagacgacggtaaccggcccgggtcggggccttacgaggtggtacgttccgggttcctccgtgacgtggttcgtccgtttcgttaggtttacctacttttcccgtttaccgtaccgttaggttattaggttaggttagggttacggaacgaccggtaccgggcccgggtagggacggggttacgttgggaggttgggtaggtcgggtagtcggtactacgtaccggtaaccgtttaaaacggaaacctaaaggagtaaggtaagggtacggaaacggttaaggtacgggttacggaacggtacgacggtacgtacgactaaacgtcccggaccggtaccgggaactaccaactaccggaaccgtactaaccggtacgaacgttaccgaacggttaagaccggttaacgacggtaaaccgggtcctaacgtacggtacgtacgtaccgggtaaccgtccgggaaccgttaaccccggtactacggttttacgaacggttaacggcggtaaacgtcggttaagtttaccgttagttaccgtcggtaaccggttcggtaccttacggtacccggttacgtaccggtaccggttgggacgggtccgggtcgggtaacccggg

SEQ ID NO: 246084 - DNA, 1009 bp, Homo sapiens
  misc_feature: GYAE6OF01CEAH1.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactccccaggttccaccttggtcgcagtcgtggagtctggagcctgcaaggaacgcccgtaggggcctacgaaggtggtagttcgggtctccgtaggcagttcgtcctttcgtggttaacctatttcccgttttccctaaccgttacggtagttagttaacgtttgggttagaacggaaccgaccggggtacccccgggaaggtacggggggttaccttagggtaaggtcgggtaaggtacggggtagttagggtacgtaccgtaaccggtaacccgtttaaacggaaaaccgtaaaaacgtacggtaaggttacgtagggaaacggtaaggtaaccggttacggaacgggtacgtaaggtacgttaaccgacgttaactaaccggtacccgaacccgggtaccggtaaccgtaacccgtaaaccggttacccgaaaccggttaaccggtaaacccggtaacggttaaacccgttaacggtaacgggttaacggaaccgggttaacgggaacccgggtaaacgtcccccggtaaaaccttacggggtaaacccgtttaaccggtaaccgggtaaacccgggtaaaaccccggttacccggggttaaccccctttaaccgggttttttaaaacctaacccggggttaccggtaaccgggttaaaccggtaaaccgggtttaaaaccggttaacgttttaaacccggttaaccggttaacccgtttaaaccgggttttcggggtaacccccggtttttaacgggttaccccggttaaaccgttaaaccccggggttaacccgttttaccgggtttccgggggttaccgggttaaacccccggggg

SEQ ID NO: 246085 - DNA, 564 bp, Homo sapiens
  misc_feature: GYAE6OF01BE2EZ.42.49.E05.1.454.CMB.1.raw
  modified_base (303)..(303): a, c, t, g, unknown or other
  misc_feature (303)..(303): n is a, c, g, or t
  modified_base (358)..(358): a, c, t, g, unknown or other
  misc_feature (358)..(358): n is a, c, g, or t
  modified_base (420)..(420): a, c, t, g, unknown or other
  misc_feature (420)..(420): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcagtgatggtctcctgcagtgtcttctggttacattccttttccaccttacggtatgtattggttgagacgacggccccggnggagggcttggagtggagtggatggatcacgtcctaacggaactaaacagagtanggagagtacgtacgaggcagagtcatcatcgacgcgacacacaccgagtacgacacgactanagtcggaatggagacgctacagctcgacgacgaaccgccgaccttattacgttacgcgacgagagttactagtttacgtcgtacgtacgtcggtaccgtggtaccgttacggtacccgtacggttcgttgggtcggtacccggg

SEQ ID NO: 246086 - DNA, 719 bp, Homo sapiens
  misc_feature: GYAE6OF01A6Z2N.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctccgtgcagtgtcttcttggttacattctttccacgttacggtatgtattggtgagtacgacgggcccccggaggacggggtcttaggaggtacggtagtggggatgggacttcgacgtacccgttacggaaactaaacgagtacgtagtggagtaagacgttcgagggacagtacgtacagttacacgtccgtaaccggacggaacaccgtactacccgaacgtacgtaaccgacgtaccctaagtaacgtacggaacgtcggaagggaccgtccgtaacgacggacttacgtacgaacccggcggtaaccggtacccttaagtttaacccgtacgtacgggaccggtacggtaaacgtacggttaaccgttttacggtacgtacccggttacggttcccggggtttacccgttacgggttacccgtttaaccggttaaaccccggtcccggtaccgggttttcggggtccggggttaaaccccgggg

SEQ ID NO: 246087 - DNA, 616 bp, Homo sapiens
  misc_feature: GYAE6OF01BMFOH.42.49.E05.1.454.CMB.1.raw
  modified_base (235)..(235): a, c, t, g, unknown or other
  misc_feature (235)..(235): n is a, c, g, or t
  modified_base (397)..(397): a, c, t, g, unknown or other
  misc_feature (397)..(397): n is a, c, g, or t
tcagtgacgtatgtcacgaccggtgctcgatttagagcgactagcaacacacaaaggggacccaaaaaccacacccctccttgggagaatcccctagatcacagctcctcaccatggacggggacctggagcatccttttcttggtggcagcagcaacaggtgcccactccccaggttcacctggtgcagtctggagctgagctgcagaagccgtggggcctcagtgatcggtcncctgcagtgctttcgtggttactattcttttccaccgttacggtatagtaattggttgagaccgacggcccccggaggagggcttggacgtggagtgggacgtgatcgagacccgttaaggaaactaaacagagtagtggaagagtagtcgagggacagatnagtacatccgacgacgacacgtactaccgaacgacgttacacgtacctaacgtacgtagaaaccgtaggaacggtacacccgtagtacgaatcgtcgaacgtaccgaccgaccttaacttagtacctaggaccaggaagtataagttacgtcgtacgacggtcggttaccgtacggtacttacgtaaacccgtagttcggtttaggtcgggtaacccgg

SEQ ID NO: 246088 - DNA, 692 bp, Homo sapiens
  misc_feature: GYAE6OF01D82J9.42.49.E05.1.454.CMB.1.raw
  modified_base (167)..(167): a, c, t, g, unknown or other
  misc_feature (167)..(167): n is a, c, g, or t
tcagtgacgtatgtcacgaccggtgctcgatttagagcgactagcaacacacaaaggggacccaaaaaccacacccctccttgggagaatcccctagatcacagctcctcaccatgggacgggacctggagctattccttttcttgggtgacagcagcaacaggtcncccactcccaggttcaccgtggtgacagtcgtggacgcgtgacgctgacaggacgtccgtcgggtcctagagtgtactcggtcctccgtgactgtcgtacttcgttagttactctttacctttaccacgtagttagtagtagttggtagacggtaccgaccgggacccggtagggacgggtcttagggaggtggaggtggagtggactacgaccgtaccgttaacgaaacctaagagtagtacggtaggtaagaacgtacgtacggaggagtaacgctacagtaccgtaacgaccgtaccggacgacacgtacctacgagtaacgtacgactaccgtagaaccgtaggactacgggacgaccgtacacgtagacctacggacgaacgtacccgactaccgtttactaacgtgacgtacgtaccggtatacgttaacgtgttccgtaggttaccggttccggtaccgtacggttacccgtaaccggttactaaccgggtttccggttgggtccgggtaacccgggg

SEQ ID NO: 246089 - DNA, 747 bp, Homo sapiens
  misc_feature: GYAE6OF01BWKR3.42.49.E05.1.454.CMB.1.raw
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgngggtcctcagtgagtggtcctcgtgactgtgcctttntggttactattccttttaccgaccgttaacggtntacgtaagttggttagacggacgtaccggggcccccggtaagggcgggggtacgttaggaggtaggtaggtgggtaacgtgggtacttacgaccggttaacccgttaaaccggggtaaaacctaaaacggtacggtaagtaaggtagggaacggtaaggtaacggttacggagggacgtaaggtacggtacacgtacgtaaccgtcgaccggtaccggaacaccgtacgtacccgaggtaacgtaaccgacgaccctaagtacggtaacggaacgtacggtaacgggtaccgaaccgtacgtacgtacgtacggtaacgaccggtaaccgaaccgggttacctaaccgtttacgtacggtccgaccggagggtaacctaggtaactttaacgggtctaccggtacggttcgggtcttacggtaccgtaacggttaccgaccgttcgtcgggttacgggtacccg

SEQ ID NO: 246090 - DNA, 672 bp, Homo sapiens
  misc_feature: GYAE6OF01EAYDB.42.49.E05.1.454.CMB.1.raw
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
  modified_base (604)..(604): a, c, t, g, unknown or other
  misc_feature (604)..(604): n is a, c, g, or t
tcagtgacgtatgtcacgaccggtgctcgatttagagcgactagcaacacacaaaggggacccaaaaccacaccctcctggagaatccctagatcacagctcctcaccatggacgggacctggagcatcctttcttggtggcagcagcaacaggtcgcccactcccaggttcacctggtgcagtctggagctgagcctgcagaagccgtgggcctcgagtgatggtctcctgctagtcgtcttacgtggttactatctttccacgtacgtntgtagttgttnagactacggcccccggaggacggggcttggtaggtcggtagtcggggtaatgggacgtacgacgtaccgttacggaaactaaaccgagtagtagtaggaagtaacggaagttccgaacgggtacgaacggtacgtacgagtcgtaagtccgaacgcgaacgaccgttaaccaccgaccgaacgtaccacgtaaccctaacgtatacgggaacttaggaacggccgtacggactacggtaactcgttaacgacggaaacccgtacgggtacccttaaggtttaactacggtaccgtcggacgtaaggtacgtaattaccggtntaccgttcgtacggtccgttacggacgttaccggttaaaccacccgtttacgtggtccggtaaccggg

SEQ ID NO: 246091 - DNA, 854 bp, Homo sapiens
  misc_feature: GYAE6OF01A9ZY2.42.49.E05.1.454.CMB.1.raw
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtcgcccactcccaggttcacctggtgcagtctggagctgagctgcagagccgtgggcctcagtgatggtctccgtgcnggtntcttctggttacatttccttttccaccgttacggtattagtaagtttggttacgacgtaccggaccgggcccccggtaagggacgggggttccgttaggacgggttcgggacggttagggggagttacgggtaacgtccggaaccggttaccccggttaaacggtaaaaccgttaaaaccggaaggtaacggttaaggtaaggggaaacgggtaaacggttaacggttcccgggaaaggggtacgtaacggtaacgttacgaacgtacctacgtacccgacccggtacggaacccaacgtaaccgttaccgaacggtaacgtaaccgaccgtaacctaacggtaacgtacgggtaacgtacgggacgggtaacccgtaccgtaacgaacgttaccttacggtaacggaaccggtaacccgaacccgggtacccttaaaccgttttaacggtaccgttaccgggacgtaacgggaacggtttacggtaaacgttttaacggtcggtaaccttaccggggtttcgggttaccccggttagggtaaccccgtttaacccgtaaacccgggttacccggtttaccgggttaacggggtacccgggtaaccccggggg

SEQ ID NO: 246092 - DNA, 799 bp, Homo sapiens
  misc_feature: GYAE6OF01E44FE.42.49.E05.1.454.CMB.1.raw
tcagtgacgtatgtcacgaccggtgctcgatttagagcgactagcaacgacgacgaaaggggacccaaaaaccacacccctccttgggagaatcccctagatcacagctcctcaccatcggacggacctggagcatccttttctggtggcagcagcaacaggtgcccactcccaggttcaccgtggtcgcagtctggagcctggacgctgccgaggacgccgtcggggcctcagtgagtggtctccgtgtacgacgtcgtctttcgttacggttaccttactttccgtttaccgtaccgttaacggttacgtaggtacggttcggtacggacgtaccggtaccggggtaccccgggtagggtacggggtacgttaggtaagggtacgggtaggtaggggtagtcggtacgtaccgtaaccggtaacccgttaaacggaaaacgtaaacgtaaggtaacgtaacggtacggtaacggtaacggtaaccggttacggaacgggtacgtaacggtacggtacgtacgttacgaccgtaccggaaccggtaccggaaccgtaccgtacggtaccgaacggtaaccgtaacgaccggtaaccgtaacgtacggtaacggtaacggtaggtaccggtaccgtaccgtaacgacgtacgtacgtaaccggaaccggaccgtaccgttaccttaacgtttacgtacggtacggtacgtacgtaagtacgttaacgttacgtccgtacggtacggttcgtaccgtacggtaacgtacccgtaccgtacgttcggtcgggtcggtaccg

SEQ ID NO: 246093 - DNA, 735 bp, Homo sapiens
  misc_feature: GYAE6OF01AWYHQ.42.49.E05.1.454.CMB.1.raw
  modified_base (89)..(89): a, c, t, g, unknown or other
  misc_feature (89)..(89): n is a, c, g, or t
  modified_base (160)..(160): a, c, t, g, unknown or other
  misc_feature (160)..(160): n is a, c, g, or t
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (660)..(660): a, c, t, g, unknown or other
  misc_feature (660)..(660): n is a, c, g, or t
  modified_base (666)..(666): a, c, t, g, unknown or other
  misc_feature (666)..(666): n is a, c, g, or t
  modified_base (721)..(721): a, c, t, g, unknown or other
  misc_feature (721)..(721): n is a, c, g, or t
tcagtgacgtatgtcccacgaccggtgctcgatttagagcgactagcaacacacaaaggggacccaaaaaccacacccctccttggganaatccctagatcacagctcctcaccatgggacgggacctggagcattccttttctgggtgcagcagcaacnggtcgcccactccaggttcaccgtggtnctagtcgtggagtntgagtctggcagacgcgtcgggctcgagtcgtagtcggtctccgtgacgtacgttcggttccgtttacgttcggttaacctacttttcccgtttaccgtaaccgtttacgggtacttaggttaacgtttggttacgacgtaccggaccgggaccccgggtagggtacgggtcggtttacgggtacggtacgggtaggtagggtaacgtagggtacctacggtaaccggttaaaccggttaaacggtaaacgttaaacgaacggttaacggttaggtaacgggtaaacggtacggtaacggttccggaaacgggtagtaacggtacgtactaacgttccgaacgtacggacccgtaggaacctactaacgtcccgaaagtacctaaacgctaaacgtagaacgttaggacgtcgaacgtacgcctagactgtacgacacgacgtcgaccgttatacgtntaccgntacgtatcgtatagctaggtacgttcggtcgacgtcgtaaccctaaggtccggtntaggtccgggtacg

SEQ ID NO: 246094 - DNA, 717 bp, Homo sapiens
  misc_feature: GYAE6OF01BVTVU.42.49.E05.1.454.CMB.1.raw
  modified_base (198)..(198): a, c, t, g, unknown or other
  misc_feature (198)..(198): n is a, c, g, or t
  modified_base (544)..(544): a, c, t, g, unknown or other
  misc_feature (544)..(544): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
  modified_base (611)..(611): a, c, t, g, unknown or other
  misc_feature (611)..(611): n is a, c, g, or t
  modified_base (697)..(697): a, c, t, g, unknown or other
  misc_feature (697)..(697): n is a, c, g, or t
  modified_base (708)..(708): a, c, t, g, unknown or other
  misc_feature (708)..(708): n is a, c, g, or t
tcagtgacgtatgtcacgaccggtgctcgatttagagcgactagcaacacacaaaggggacccaaaaaccacacccctcttgggagaatccctagatcacagctcctcaccagtcggacgggacctggagcatcctttcttggtgcagcagcaacaggtcacccactcccgaggttccaccgtggtgcagtcgtaggntctgagctgcagtaacgccgtgggcctgagtgacgttggtctcctggctagtgtcttcgtaggtacttacttcctttacccgtaccgttagtatacggttaattggttaggacgaccggacccgggacccgggtacgggtacgggtgttacggtaggtaccgggaaggttcggggtatacggttaccgaaacgttaccggtaaccccggttaaaggtaaaaaacccgttaaagtaggtaaaccggttacggtaagggaacggttaaacggaaaccggttccgggaacggtaagtaacggacttacgacttacacgacgaccggacacgtacgactacgaacggtanacctacgtaccgtaacgtagttacgaacgtaggacggactaccgtntaacncgttacgacgacgacnccgtacttacgtactacgtgacgtacaagttccgtatagtaacccgtgtaccggtcgacgttagaccgtttaacgaccgtttaggngtttacccggngttaccggg

SEQ ID NO: 246095 - DNA, 754 bp, Homo sapiens
  misc_feature: GYAE6OF01EIHJX.42.49.E05.1.454.CMB.1.raw
  modified_base (186)..(186): a, c, t, g, unknown or other
  misc_feature (186)..(186): n is a, c, g, or t
  modified_base (197)..(197): a, c, t, g, unknown or other
  misc_feature (197)..(197): n is a, c, g, or t
  modified_base (244)..(244): a, c, t, g, unknown or other
  misc_feature (244)..(244): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtncagtctggacnctgagctgcagacgccgtgggcctcagtgatggtctcctgctaggtntacttcgtaggttactactttccttttccaaccgttacgtatagtaagtttcggttagacgacgtaccggccccggtaggcggggtcgttggaggtggacgtgggatcggatcgacgtacccgtaacgaactaaacgagagtagaggagagtacgtcgaggcagtagtcgactcgactacgaccgtacgaaccacgactccgaacgaacgtaccacgtacctaacgtagtacggtaaccgtaggaacggacgtacccgtacgtacgtaaccgttcgttaacgggaaacccgtaccggtaaacccgggtaccccttttaaaccggtttacccggttaacccgtaccggggaaccggtaccggtaaaacgggttacgggtttaaactttaacgggttaaccgttacccggttaaccggtttccgggttaccccgttacgggttacccgttaacccggtttaaccccgggaccggttttacggtttacggggtcccggggttaaaccccgggg

SEQ ID NO: 246096 - DNA, 992 bp, Homo sapiens
  misc_feature: GYAE6OF01CRGW8.42.49.E05.1.454.CMB.1.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
tcagtgacgtatgtcacgaccggtgctcgatttagagcgactagcaacacacgaaaggggacccaaaaaccacacccctcttgggagaatcccctagatcacagctcctcaccagtggacgggacctggagcattcctttttcgtggtggcagcagcaacgaggtcgcccacctcccgtaggttccaccgtggtancgagtcgnggagctggagcgtgcgagacggtcggtacgggtcctgaggtcgtagttccggtcctaccgtggtaccgtagttcgttccgtttcggtttacggttaccttacctttttcccgttttaacccgtaccggtttaacggttacgttaagggtttacgttttacggggttaacgtaaccggttacccggggacccggggtacccccgggtaaggggttaccgggggtccgtttaagggtcgggtaagggttacgggtaggggtacggtaaggtaccgttaaccgttaacccgggtaacccggtttaaaacggaaaccgttaaaagagggtaacgttagtaacggggtaaacgaacggtaaccggttacggaagggtaccgtaaggtaacgtacgtaacgtaacccgtaccgtacccggaacccgggttacggtaacctaacgtaaccgtaaccggtaaaccggtaccgtaaccgtaccgtaaacccgttaacgtaaccgggtaaccggtaaacgggtccggtaaacggtaccgtacccgttaacgagttacccggttaacggaacccggtaacccggtaacccggtacccgttacctttaaaccggttacgtttaaccgggaccgggtaacggttaaacggtaggttaaaccgtttacgtttaaccggttcccggttaacgtttacccgggtttaaccgggttccccgttaaagggtttaccccgtaaacggttaacccccgggttgggtttaacccgggtttcggggtaaccgggggttaaacccccgggg

SEQ ID NO: 246097 - DNA, 795 bp, Homo sapiens
  misc_feature: GYAE6OF01A9NNZ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtctggagctgacgctgacagaacgccgtcggggcctgagtgagtggtctctgccagtgtcttcgtggttacagtttcctttacctaccgttacggtatagtaaggtttggttcgaacgaccggtaccggggcccccggtagggtacgggggtcgttacggtagggtacggtacgggtggggtaacgtcgggtaactccggtaaccggttaccccggttaaaacgggtaaaaccttaaaaccggtaaggtacggttaaggtacgggaacggtaacggtaaccgttaccgggaggacgtaaggtacgtaccgtagtaccgtaacgacccgtaccgggtaccgggaacctaccgtacctaaccggtaacgtaaccggtaacctaaccggtaccttaaccgggtaacgtaccgggtaaacgttacgggaaacggttaccgtaccgtaccgtagtaaccgtttcgaacgggtaaacccggaccggtaaccgtaccccgttaagtttacgtaccgttcggacccgagtaacgtagttacgttacgtcgtccgtacggttggccgttacggtacgtaacccgtaccgtaggtccgttaggggtcggtaccggg

SEQ ID NO: 246098 - DNA, 693 bp, Homo sapiens
  misc_feature: GYAE6OF01B474C.42.49.E05.1.454.CMB.1.raw
  modified_base (164)..(164): a, c, t, g, unknown or other
  misc_feature (164)..(164): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (494)..(494): a, c, t, g, unknown or other
  misc_feature (494)..(494): n is a, c, g, or t
  modified_base (517)..(517): a, c, t, g, unknown or other
  misc_feature (517)..(517): n is a, c, g, or t
tcagtgacgtatgtcacgaccggtgctcgatttagagcgactagcaacacacaaaggggacccaaaaaccacacccctcttgggagaactcccctagatcacagctcctcaccatggacgggacctggagcattccttttctggtggcagcagcaacagggtcncccactcccgaggttccaccgtgggtncagtctggnctgagctgcagacgccgtgggcctgagtgacgttggtcctcgtgctagtcgtccttgttacggtacacttccgttttacccaccgttacggtattacggtagttggttaggagaccgtaacggggcccccggaggacgggtcgttagggaggttacggagggttagggtactagggacctacggaccgttaacccggttaaacggaaaaccgttaaaagaggtacgtaggaacggtaagaacggtacgtacggaggtacgaggtatacgatccgagtacccacgggacgtaacncgtacctaccgaacgtaacgtanaaccgtacctagtacgaggtaaccgtacggagtaccgacctagactagacgtcgaccggtacccacgtaccgttagttactcgtacggaacgcggataagtagtacgttaccgtagaccgtttcggaccgttggaaccgtttacgaacccgtccggttggtccggtcggtaccggg

SEQ ID NO: 246099 - DNA, 976 bp, Homo sapiens
  misc_feature: GYAE6OF01BOKP3.42.49.E05.1.454.CMB.1.raw
  modified_base (50)..(50): a, c, t, g, unknown or other
  misc_feature (50)..(50): n is a, c, g, or t
tcagtgacgtatgtcacgaccggtgctcgatttagagcgactagcaacanaccaaaggggacccaaaaaccacacccctcctggagaatccctagatcacagctcctcaccatggacgggacctggagcagtccttttctggtggcagcaggctaagaaggttgccctacctccgtaggttaccaacctcggtgcaggtccgtaggagctagagctgcagaacgccgtggggcctcgaggtcgagttgtcctccgtgccgtagtcgtaccttcggtcggttaactactttacctttacccgtaaccgttacgggttacttaggttaaaccgtttggggtttacgaaccggaaccgggtccccggggtaccccccggggtaggggtacgggggtttccgttaggggacgggttagggaagggttggggaacgtttagggtaaccttacggaaccggtttaaccccggttaaaacggaaaccgttaaaaaccggttaggtacggttaaacgggttagggaaaccggtaacgggttaaaaccggtttcggaaacggggtaaccgtaaggtaccggtaccgtaacgtaacgtaacccggtaaccggacccgggaacgtaccctaaacgtcccgtaaacccgggtaactaaacgggtaaccgtaacccggaccgttaaccctaacggggttaccggtaaccgttagggaaacggggttcccctcctaaccgtacgtaacccggttacgtacccggaaccgggttaccccggaacgtttaaacccccgttaacggtttcgttaaccgggaccggtaccggggaaacccggtttaaggaaaacgtttttaacccgggttagttaccccggaaggttcccgggttacggttccccgggttaaaggttacccccgtaaccgggttttaaaacccggcgggtttttacccgggttccggggggtaccgggtttaaacccccggggg

SEQ ID NO: 246100 - DNA, 749 bp, Homo sapiens
  misc_feature: GYAE6OF01BLQO6.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccctactccccgaggttccacctggtgcagtcgtggagctgagctgcgagacgccgtgggcctgagtgagtcggtctcctgctagtcgtcttcgttaggttactcttccttaccgtaccgttacgtagtagtagttggtacgacgaccggtacccgggaccccggtagggacgggtcggttaggtaggtagggtaggtgggtaggtacggtacgtaccgtaaccggttaacccggttaaacggtaaaacgtaaaggtaaggtaacggtaaggtaagggtaaggtaacggttaaccggtacggaaggacgtagtacgtacgtacgtaccgtacgtacccggaaccgaccgaaccgtaccgtaccgtaccgaacggtaacgtacccgtaaccgtaccgtaacgtacgtaacgggtaacgtacgggaacgtccgtaccgtacgtaacgtaccgtacgtaaccgaaccggtaccgtaccgtaccttaacgttacgtacggtccgacggagtagtacgttacgttacgtcgtacgtacggttcggtaccgtagtaccgtaccgtacggtacggttcggtcggtccggacg

SEQ ID NO: 246101 - DNA, 826 bp, Homo sapiens
  misc_feature: GYAE6OF01BJ6HH.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatgggacgggacctggagcacttccttttcttggtggcagcagcaacgaggtcgcccactcccgaggtttccaccgtggtgcagtctggatctgagctgacgaggaacgccgtggggcctcaggtcgagttcggtcctccgtgccgtgttgtcctttcgtaggttactactttccttttcccaaccgttacggttataggtaacgtttggtacgaggaccgaccggggcccccggtagggcgggggtacgttggtagggtaggtaggtaggggatagggtactacggtaaccggttaccccgttaaacggaaaaaccgttaaaacgacgggttaaacggttaaggtacggggtaaaggtaacggttaaacggttacccgggtaaggggaccgtaagggtaccgtaacgtacgtaccgttaaccgtacccgggaacccgtcggggaaaccctaaccgtaaccgtaacccggaacggtaacgttacccgaacgtaaccgttaacgtaacggtacggtaacgcgggtaacgccgtaccgtacgtaacggcgtacgaacggtaccgaaccggtaaccgtcccgttaaacgttacgttaccggaggaccggtacgaaagttacgtaacggtttacgtcgttacgtacccggtttggtccccgttagggtacttacccgggtaacgttaccgtaccggggtttcgccggggtacccggg

SEQ ID NO: 246102 - DNA, 864 bp, Homo sapiens
  misc_feature: GYAE6OF01A6VIW.42.49.E05.1.454.CMB.1.raw
  modified_base (169)..(169): a, c, t, g, unknown or other
  misc_feature (169)..(169): n is a, c, g, or t
  modified_base (200)..(200): a, c, t, g, unknown or other
  misc_feature (200)..(200): n is a, c, g, or t
tcagtgacgtatgtcacgaccggtgctcgatttagagcgactagcaacacacaaaggggacccaaaaaccacacccctccttgggagaactcccctagatcacagctcctcaccagtgggacggacctggagcattccttttcgttggtggcagcagacaacgaggtcnccctactcccgtagggtttccaccgtgggtnacgtagtcgtgggagcctggacgtctagaccgaaggtacggcccggtcggggtaccttacgaggtaggtaacgttcggtaccgtccctggtacgacgttcggtactttcggttacggttaaccttacttttaccgttttacccgtacgttacggttaacgttgttaaacggtttcgggttacgaacggtaccggaccccggggtaccccggggtaggacggggttcgtaggggtacgtgggtagggtagggtagtacggtacgttccgtaaccggttaaccgtttaaacgaaaacgtaaaccggtagtaacggttacgaagggacgtaacggtaaaggttccgggaacggaacgtaaggttacgacgtaacgtaaccgttaccgaaaccggtacggaaccggtacctacgtaccgtaaccggacgttaaccgtacccgtaaccacgtaaccgtaagtaacccggggaacttaaagggccgggtacctaccgggttacacggttagaccgtaccgtaacgacccggaacttcccggttaacttacggttacgtacggtacggaactaacgttgttaaccgttaggttccgtaccaacgggttcccgcggtttaccggtaaccttcggtaacccgttacgggttcttcggggggtacgtacccggg

SEQ ID NO: 246103 - DNA, 600 bp, Homo sapiens
  misc_feature: GYAE6OF01BU01P.42.49.E05.1.454.CMB.1.raw
  modified_base (361)..(361): a, c, t, g, unknown or other
  misc_feature (361)..(361): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
  modified_base (565)..(565): a, c, t, g, unknown or other
  misc_feature (565)..(565): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctgggcctcagtgatggtctccgtgcagtgcttcgtggttacattcgttttccacctaacggtatgtaattggttgagacgacggcccccggaggtaggggcttggaggtcggatgggatggatcacggtcccttaacggaactaaaaacgngtagtaagtggaacgaagaagttccgagggacaggacgtacataccgataccgaccgaggtacactacgtaccacgagtaacacgtacctaacgagtcggaacttgaaggacncctacganacgtcgtagacgtacgaccggtacctactttacgtaaccgtaggcgacggtagaacgtattagtacgctaacgtggttacccnggtactacgtaaccgacgtcgtagggtcggtaccg

SEQ ID NO: 246104 - DNA, 785 bp, Homo sapiens
  misc_feature: GYAE6OF01A6QTX.42.49.E05.1.454.CMB.1.raw
tcagtgacgtatgtcacgaccggtgctcgatttagagcgactagcaacacacaaaggggacccaaaaaccacacccctcttgggagaatcccctagatcacagctcctcaccatgggacgggacctggagcattccttttcttggtggcagcagcaacgaggtcgacccacctccccaaggtttccaccgttggtgcagttcgtggagctgacgctaggtaacgaacgccgtcggggtcctcgaggtgagttcggtcctccgtgaccgtagttcgtctttacgttaggttaactactttcctttaccgaccgttaggtataggtagtttcggtagacggtaccgccgggaccccggagggacgggtcgtaggacggttaggacggtagggactaggtacgtacgaccgtacccgttaaacggaaactaaacgtaggtacgtaaggacgggtaagtaacggtacggtaccggagggtacgaggtaacgtacacgtaccgtaacgaccgtaacccggaccggtaacaaccgtacgtaacccgacgtaaccgtacgaaccgtactaacgtaacgtacggtaaagtcggaacggtaccgtaccgtacgaacgtacgtaccggtaacgaccgtaaccgtaacccggtacttaaaccgtttacgttacgaccggacgttacgggaagttaacgtaggttaccgttacgtaccgttaggttaccggtcggtaccggtaaccgttaacgtaacccgttcgggttacgttcgggtcgggtaccggtaccggggg

SEQ ID NO: 246105 - DNA, 649 bp, Homo sapiens
  misc_feature: GYAE6OF01B1ZLT.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtcgcccactcccaggttcacctggtgcagtctggagctgagctgcagaacgccgtgggcctcgagtgatggtcctccgtgcgtagtgtcttcgtggttactattccttttaccacgttacggtacgtagtaagtttggtagacgtaccgaccggccccggaggtagggtcttggaggtggagtgggagtggactacgacgtacccgttaacggaaactaaacgaggtagtagtaggagagtacgtcgaggcagtacgactagtcagtccgaccgacgacactacaccgtaacacgtacacgtacctaagtagacggtaacgaggacgtacgctacgacgtactaccgtacgaacgtaccgaccgttacctaacgtttacgtaccggagccggacgtaggacttacgttagttcgtaccgttaggtcccggttcgtacggtaccttaaccggtacccgtaccggtaggttccggggacggtacccgggg

SEQ ID NO: 246106 - DNA, 842 bp, Homo sapiens
  misc_feature: GYAE6OF01B3I1Z.42.49.E05.1.454.CMB.1.raw
  modified_base (72)..(72): a, c, t, g, unknown or other
  misc_feature (72)..(72): n is a, c, g, or t
  modified_base (158)..(158): a, c, t, g, unknown or other
  misc_feature (158)..(158): n is a, c, g, or t
  modified_base (170)..(170): a, c, t, g, unknown or other
  misc_feature (170)..(170): n is a, c, g, or t
  modified_base (176)..(176): a, c, t, g, unknown or other
  misc_feature (176)..(176): n is a, c, g, or t
  modified_base (236)..(236): a, c, t, g, unknown or other
  misc_feature (236)..(236): n is a, c, g, or t
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (449)..(449): a, c, t, g, unknown or other
  misc_feature (449)..(449): n is a, c, g, or t
tcagtgacgtatgtcacgaccggtgctcgatttagagcgactagcaacgacacaaaggggacccaaaaaccncacccctcttgggagaatcccctagatcacagctcctcaccgatgggaccggggtacctgggactcattccttttgtgggtggcancgagactaacgngggtcnccccaaccttcccagggtttccaccgtggtgacctagttcgaggagcctggaggctcganaggtacgcggtagggcctagagtgtcgtcggtctcgtggaatggtctctttgtacggtatctttcttcccaggttactanacgttagttgacgtaanccggtaccggccggggtaggaccggtgtaggtagggacggtaggtagggttacgacgggttacacccggggttaactacccccgggtttaaaaaggaaaacccggtttaaaagggngggttaacgtaacgggtaaggggtaaacccggttaaggggttaacccggttaccgggaaaggggtacgtaacggtaccggtactaccgttaccggaaccgtaccgggaacccgggaccgtaacgaccgtaacccgtacggtaaacggtaccgtaaccgtacgtaacccgtaagtaacgggtaacgtacggtaaggaacccggtacgacccgttaagtacgtaacccggtacgtaccgggtaaccgtacccgtacccgttacctttaacgttacccgtacgggtaccggacggtaaggtaacggtacggttaagttcggtacgtaaccgttcccggtagtccccggttaagtaccgttacggtaaccgtcggttacggtacggggtccgtccgg

SEQ ID NO: 246107 - DNA, 899 bp, Homo sapiens
  misc_feature: GYAE6OF01AEW45.42.49.E05.1.454.CMB.1.raw
tcagtgacgtatgtcacgaccggtgctcgatttagagcgactagcaacacacgaaacggggacccaaaaaccaccacccctccttgggagaactcccctagatccacagctccctcaccagtcgggacgggacctggacgctactttcctttttcgttgggtggcagcgaggaccaaacgtagggtcacccctacctacccgtacgggttccaccgttgggtcgacctacgttcggtggacgcgtaggacgctggacgaagtacggtccggttacgggcccttgaaggttggtaagttcggttacccttccgtaggtactggttcgttcgtttacgttacggttaccttacgttttcccctttacgtaccccgttaaggttagttagttaggttcggtaggacggtaccggacccgggggtaccccggtaggggtaagggtccggttaggaagggttagggtaacggtaggggtaggtacggactaccggtaaccggtaacccggttaagtaaaaactaacggtaagttaacgggtagtaggggtaaacgtaaggtaccggtacggagacgaggtcaacgtactacgtacgacccggtacggaaccggaactaaccgtaacgaccgtaacgtaccgtaactacgtaacgtaacgtaacgtaaccggtaacggtacggaacggaccgtacccggtaacgtacgttaccgaacggttaccgaacccggtaaccggtacccgtaaccgttaacgttacccgttacgaccgggaacgtaccggtaaaggttacgtaacgttcgttacggtacccgttacgggtcccgttaccgggtttaacgtaacccgttaacccggttacccgggtaggtttacccgggttcgttcgggggtaacccgggg

SEQ ID NO: 246108 - DNA, 677 bp, Homo sapiens
  misc_feature: GYAE6OF01AYA5E.42.49.E05.1.454.CMB.1.raw
  modified_base (315)..(315): a, c, t, g, unknown or other
  misc_feature (315)..(315): n is a, c, g, or t
  modified_base (467)..(467): a, c, t, g, unknown or other
  misc_feature (467)..(467): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtgaagcagcaacgaggtcgcccactcccaggttccacctggtgcagtctggagctgagctgcacgacgccgtgggcctcgagtgatggtcctaccgtgctagtcgctttcgtgtactactctttccaccgtacgtatgtattggtgacgacgacggccccggagcgggtntcggaggtgggatcgggtgtagggactcgtaacggtacccgtacgggaaaactaacgagtagtagtacggaagtacgtaacggttcgaggaccgtagcgtagtactacgtaacggtaccgaccggcggtaacaccgtacacccgaacggtanacccgtactaacctacgtacgtaggaacgtgaccggacgtccgacgaacttcgaccgtaggacccgaaggtccccgtactaacgtttaccgttacggtcggtacgacggtacgtaattagttaacttccggaacttccgggttcggaccgttcggtaccgttaccggtaccggtaccggtcggtttacgggcggtccgttaacccggggg

SEQ ID NO: 246109 - DNA, 637 bp, Homo sapiens
  misc_feature: GYAE6OF01ARMNM.42.49.E05.1.454.CMB.1.raw
  modified_base (266)..(266): a, c, t, g, unknown or other
  misc_feature (266)..(266): n is a, c, g, or t
  modified_base (439)..(439): a, c, t, g, unknown or other
  misc_feature (439)..(439): n is a, c, g, or t
  modified_base (517)..(517): a, c, t, g, unknown or other
  misc_feature (517)..(517): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttccacctggtgcagtctggagctgagctgacagacgccgtgggcctcagtgatcggtcctcgtgcgtagtcgtctttcgtacggttactnttcctttaccaccgttaacgtagtagtacgtttggttacgacgacgaccgggtccccggagggacggggtcttggagggtcggagtgggtagtggactaccgacgttaccgtaaacggaaactaaagacgtaagtagaggaagacgtaacgtcgagggactagacgtacatanacgtaccgaccgacgaacaccacgtccgaacgtactaccgacgtaccgtactaagtacgaacgttagggaacggtacnccgtaactaggtctacgacgaaccgacgtaccgtactaccgtttacacgacgacgagagtatacgttgtcgtactcggttcgacgtagtaccgtaaccgtcagtcggtcggcgggtacgg

SEQ ID NO: 246110 - DNA, 841 bp, Homo sapiens
  misc_feature: GYAE6OF01AYTLF.42.49.E05.1.454.CMB.1.raw
tcagtgacgtatgtcacgaccggtgctcgatttagagcgactagcaacacacaaaggggacccaaaaaccacaccctcttgggagaatccctagatcacagctcctcaccatgggacgggactggagctattccttttcttgggtgcagcagcaacgaggtcgcccactcccgtaggttccaccgtgggtgcgaggttcgtgggacgtctaggagtctggacgaaggaaccggcccggtgggggtacccttacgtagggtacgtacgtcggttcccttaccgtaggccgtaggttcggtccttttacggttacggttaacttcctttaccgttttaccccggaacggtttaacggttacgtttaggttaaggtttcgggttaggaaccggaccggtacccgggacccccggggtaaggggtacgggtcgttaggggtacgggtacggtagggtcggggtagtacgggtacgtaccggtacggtttaaaccccggtttaaacggaaaacgttaaaacggaggggttaaacggttaacggtaggggaaagtaacggggtaaccgtccggggaagggtactaaggggtactaactcgtacgtacgacgaccgtacgacgactaccgtacaacgtacgtacgaacgtacgacgtacgacggtacgtaggacgtcgaacgtacgtacgtacgttacggacgtaacccggacgtaccgtaccttaccgttaacgtcggtacggtccgaacggtaagttacggttagttacgttccggtacggttacggttaccgtccgggtacttccgttaaacgaccggttattcgggtcgggttcggaacccggg

SEQ ID NO: 246111 - DNA, 791 bp, Homo sapiens
  misc_feature: GYAE6OF01B6QDI.42.49.E05.1.454.CMB.1.raw
  modified_base (142)..(142): a, c, t, g, unknown or other
  misc_feature (142)..(142): n is a, c, g, or t
  modified_base (161)..(161): a, c, t, g, unknown or other
  misc_feature (161)..(161): n is a, c, g, or t
  modified_base (331)..(331): a, c, t, g, unknown or other
  misc_feature (331)..(331): n is a, c, g, or t
tcagtgacgtatgtcacgaccggtgctcgatttagagcgactagcaacacacaaaggggacccaaaaaccacacccctcttgggagaactccctagatcacagctcctcaccatgggacgggacctggagcacttccttttnttgggtggcagcagcaagnggtcgaccctactcccgaggttccaccgtggtcgcgtaggttcgtggacgtcgtaggacgctcggcgaacggtaacgccggtcggggcctcgaggtgtacgttcggtcctaccgtgtcgtagtcggttccgttcgtcgtttactctttacctttccgaacgttaacggtntacgttaagttcggtacgacgaccggtaccggggacccggtagggtacggggtacgttgggcggtacggggtagtagggggtagtcggaccgtacgtaaccggttaaccgtaaaaccgggtaaactaaaaccggaggttaacggtaagtacgggaacggtaacgtaccggttacgggagggactaggtacgttacgattaccgagtaccccgggacggtaccaacgacgtaccgtaaccgacgtacggaacgtaccgtaccgtaagtaacggtacgaacggtagggaaccggtacgacccgttaacggacgtacgttaccggacggacccgtacggaacccgttaccgtaacttttacggcgaccgtaggtaacggtaagtagtttacgtacggttccgaacgttcggttacgggccgttagaccggttactaccgggtgtcgggtacgtcgggtaccgg

SEQ ID NO: 246112 - DNA, 854 bp, Homo sapiens
  misc_feature: GYAE6OF01BY3VC.42.49.E05.1.454.CMB.1.raw
  modified_base (826)..(826): a, c, t, g, unknown or other
  misc_feature (826)..(826): n is a, c, g, or t
tcagtgacgtatgtcacgaccggtgctcgatttagagcgactagcaacacacaaaggggacccaaaaaccacacccctccttgggagaatcccctagatcacagctcctcaccatgggacgggacctggagcattccttttcttggtggcagcacgcaacaggtcgcccactcccgaggttcctacctggtgcagtccgtgggacgtctgagctcgaccgaggacgtccggtcggggtcctacgtaggtgtcggtcggttcctacgtcgactagtcgtctttcgttcggttacctcgtttcctttaccgtaaccgttacgggttattacggttaggtttacggtttggaacgtaccggaccccggggtacccccgggtagggtacggggttccggttagggacggttacgggtagggttacgggtagtcggttaacgtcccggtaaaccggtttacccccgggttaaaacggaaaaacccttaaaaggtaacggtaacgggtttaaggtaaaccggggtaaggtaaacgggttaaccgggtaccgggtaaccggtaggaaccgttggtaacctacgtacgttaacccgtacccggacccgggtaccgtaaccgtaccgtaacctaccggtaacgtaaacgggtacccaaccggtaccctagttaacggaaccggtacgtacggaagtccgtactaacggttacaccgtacgtaaccgaacgaaccccgggtcctaacgttacgtacgttaccgcgtacggtacggaaattccgtagtttcggtcgtactaccggttgacccggttctacccgtaacggttaacccnggtttccgggtggtaccggtaacccggg

SEQ ID NO: 246113 - DNA, 503 bp, Homo sapiens
  misc_feature: GYAE6OF02HBY26.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaacagagtatggagagaagttccagggcagagtcatcatcacgcggacacatccacgagtacagcctacatggaactgaggagcctcagatctgacgacacggccacttattactgcgcgagagattagtgcactggtcctggctgtaccacgcttggtggtccg

SEQ ID NO: 246114 - DNA, 558 bp, Homo sapiens
  misc_feature: GYAE6OF02IWP7V.42.49.E05.1.454.CMB.1.raw
  modified_base (279)..(279): a, c, t, g, unknown or other
  misc_feature (279)..(279): n is a, c, g, or t
  modified_base (347)..(347): a, c, t, g, unknown or other
  misc_feature (347)..(347): n is a, c, g, or t
  modified_base (392)..(392): a, c, t, g, unknown or other
  misc_feature (392)..(392): n is a, c, g, or t
  modified_base (500)..(500): a, c, t, g, unknown or other
  misc_feature (500)..(500): n is a, c, g, or t
tcagtgacgtatgtcacgaccggtgctcgatttagagcgactagcaacacacaaagggacccaaaaccaacacccctccttgggagaatcccctagatcacagctcctcaccatggacgggacctggagcatcctttcttggtggcagcagcaacaggtgcccactcccaggttcacctggtgcagtctggagctgagctgcagaagcctgggcctcagtgatggtctcctgcagtgcttctggttacattctttccacctacggtatgtaattggttnagacgaggcccccggagaggggcttgagtggatgggatggatcgacgcccttacggaacttaaaacgngtacgtagtggagagaagttccgagggcagagtcatcatcgacgnggacacataccacgagtacagcctacagtgaactgaggagcctgagatactgacggacaccggtcacttaattacgtcggacgtacgagtacgtattacgttcggacncggttacgtccgtaggtacttacggttaaacccacggttccttagggtcgggtaccgg

SEQ ID NO: 246115 - DNA, 512 bp, Homo sapiens
  misc_feature: GYAE6OF02HMNH5.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatggatcagcccttacggaactaaaacagagtatggagagaagttccagggcagagtcatcatcaccgcggacacatccacgagtacagcctacatggaactgaggagcctcagatctgacgacacggccacttattactgcgcgagagattagtgctactggtcctggctagtaaccacgtcttggtggtacgg

SEQ ID NO: 246116 - DNA, 515 bp, Homo sapiens
  misc_feature: GYAE6OF02IMAGU.42.49.E05.1.454.CMB.1.raw
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagtacaggcccccggagagggggcttggagtggatgggatggatcagcccttacgggaactaaacagagtatggagagaagttccagggcagagtcatcatcaccgcggacacatccacgagtacagcctacatggaactgaggagcctnagatcngacgacacgccacttatactgcgcgagagtattattgactacgtggtcctggtctagtaccacgtcttggtggtaccg

SEQ ID NO: 246117 - DNA, 507 bp, Homo sapiens
  misc_feature: GYAE6OF02HAYM7.42.49.E05.1.454.CMB.1.raw
  modified_base (422)..(422): a, c, t, g, unknown or other
  misc_feature (422)..(422): n is a, c, g, or t
  modified_base (500)..(500): a, c, t, g, unknown or other
  misc_feature (500)..(500): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccaggcagagtcatcatcacgcggacacatccacgagtacagcctacatggaactgaggancctcagatctgacacgacgccacttatactgcgcgagagattagtgcacgtggtcctggctcgtaaccacgtcttcgnggtaccg

SEQ ID NO: 246118 - DNA, 649 bp, Homo sapiens
  misc_feature: GYAE6OF02H4LCW.42.49.E05.1.454.CMB.1.raw
tcagtgacgtatgtcacgaccggtgctcgatttagagcgactagcaacgtacgacaaacggggacccaaaaaccacaccccctccttgggaggaatcccctagagtcacagtctcctcaccatggacgggacctgggagacatcttttcttggtcggcagcgagctaacaggtagcccactcccaggttccacctggtgcagtctggagctgaggctgcaggaagacctggggccgtcagtgatggtctcctgcaggttgcttctggttacattctttccacctacggtatgaattggttgagacgacggccccggagacggggcgttaggacggtgggagtggggatgggtactacgaccgtaccgtaacgtaaacctaacgtagagttagaggagtaacgtacgtacggacgacggacgtacgtactagtactacgaccgaccggacgacactaccaccgaacgtaaccgaagaccgtactaacacggtaaccgtacgacggagaccgtacgtagacgacgtcgtacggaaccgaccggacccgtaactaaccgttactacgacgtacgtacgaagtacgttaacgttaggtctacgttggtccgtacgtgtacgttaccgtacgtaccgttggttcggtgtacggg

SEQ ID NO: 246119 - DNA, 511 bp, Homo sapiens
  misc_feature: GYAE6OF02I5J9Q.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatgggatggatcagccttacggaactaaacagagtatggagagaagttccagggcagagtcatcatcaccgcggacacatccacgagtacagcctacatggaactgaggacgcctcagatctagacgacacggcctacttattactgcgcgagagattagtgctactggtcctggtctgtaaccacgcttggtggtacg

SEQ ID NO: 246120 - DNA, 514 bp, Homo sapiens
  misc_feature: GYAE6OF02HZ3SO.42.49.E05.1.454.CMB.1.raw
tcagtgacgtatgtcacgaccggtgctcgatttagagcgactagcaacacgcaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggagtgggatggatcagcccttacggaactaaaacagagtatggagagaagttcagggcagagtcatcatcaccgcggacacatccacgagtacagcctacatgaactgaggagcctcagatctgacgacacggccacttattactgcgcgagagattattgctacgtggtcctggcttcgtaaccacgtcttggtggtaccg

SEQ ID NO: 246121 - DNA, 613 bp, Homo sapiens
  misc_feature: GYAE6OF02I7FMA.42.49.E05.1.454.CMB.1.raw
  modified_base (359)..(359): a, c, t, g, unknown or other
  misc_feature (359)..(359): n is a, c, g, or t
  modified_base (423)..(423): a, c, t, g, unknown or other
  misc_feature (423)..(423): n is a, c, g, or t
  modified_base (588)..(588): a, c, t, g, unknown or other
  misc_feature (588)..(588): n is a, c, g, or t
tcagtgacgtatgtcacgaccggtgctcgatttagagcgactagcaacgacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacgacggccccgggaggtaggggcttggagtggagtgggatggatcgacgtcccgttaacggaactaaaacgngagtagaggagaagtacgtcgaggcagagtcagtcatccgacgcgacactataccgagagtacncgacctagatcggaatggacggactccgtacgagtacgtcgtacgaaccggacccgaacgggtccctaaccttttaagtaccgttacggacgtacgggtaagtacgtaagttttacgtcggtaacctaccggttcggtcccgtaggtaccgttacggtaaacccncgggttacttgggttacggacccgg

SEQ ID NO: 246122 - DNA, 514 bp, Homo sapiens
  misc_feature: GYAE6OF02GJBNM.42.49.E05.1.454.CMB.1.raw
  modified_base (456)..(456): a, c, t, g, unknown or other
  misc_feature (456)..(456): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcgagcccttacggaactaaaacagagtatggagagaagttccaggcagagtcatcatcaccgcggacacatccacgagtacagcctacatggaactgaggacgcctcagatctgacgacacggccacttattacngcgacgagagtatagttgctacgtgtcctggcttcgtaaccacgtcttggtggtaccg

SEQ ID NO: 246123 - DNA, 525 bp, Homo sapiens
  misc_feature: GYAE6OF02F6Y3W.42.49.E05.1.454.CMB.1.raw
  modified_base (346)..(346): a, c, t, g, unknown or other
  misc_feature (346)..(346): n is a, c, g, or t
  modified_base (437)..(437): a, c, t, g, unknown or other
  misc_feature (437)..(437): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggatgggatgggatcagcccttaggaactaaaacngagtatggagagaagttccagggcagagtcatcatcaccgcggacacataccacgagtacagcctacatggaactggagagcctcagatcngacgacacggccacttatactgcgcgagagtattagttgccaacgttcggtcctgggtcttaggtaacccacggtcttggtggtaccg

SEQ ID NO: 246124 - DNA, 516 bp, Homo sapiens
  misc_feature: GYAE6OF02H8C1G.42.49.E05.1.454.CMB.1.raw
  modified_base (451)..(451): a, c, t, g, unknown or other
  misc_feature (451)..(451): n is a, c, g, or t
  modified_base (463)..(463): a, c, t, g, unknown or other
  misc_feature (463)..(463): n is a, c, g, or t
  modified_base (509)..(509): a, c, t, g, unknown or other
  misc_feature (509)..(509): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccggagaggggcttggaggtggatgggatggatcagccttacgaataaaacagagtagtgagagaagtcaggcagagtcatcatcaccgcgacacatccacgagtacagcctacatagaactgaggagcctcagatcgtagacgacgacgccattattacngacgcgagagtnttaagtgcacgtggtcctggcgtcgtaacccgacgtcgtttacggnggtaccg

SEQ ID NO: 246125 - DNA, 527 bp, Homo sapiens
  misc_feature: GYAE6OF02G8IH5.42.49.E05.1.454.CMB.1.raw
  modified_base (353)..(353): a, c, t, g, unknown or other
  misc_feature (353)..(353): n is a, c, g, or t
  modified_base (432)..(432): a, c, t, g, unknown or other
  misc_feature (432)..(432): n is a, c, g, or t
  modified_base (521)..(521): a, c, t, g, unknown or other
  misc_feature (521)..(521): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatggggatggatcgagcccttacggaactaaaacagagtanggagagaagttcagggcagagtcatcatcaccgcggacacatccacgagtacagcctaacatggaactgaggacgcctnagatactggaccgacgaccggaccacgtttattacgtgacgcgagagtattatgctacgtggtacctggctcgtaaccacggtcttggnggtacg

SEQ ID NO: 246126 - DNA, 510 bp, Homo sapiens
  misc_feature: GYAE6OF02F0NSE.42.49.E05.1.454.CMB.1.raw
  modified_base (390)..(390): a, c, t, g, unknown or other
  misc_feature (390)..(390): n is a, c, g, or t
  modified_base (428)..(428): a, c, t, g, unknown or other
  misc_feature (428)..(428): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtccccccgccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatggatcagcccttacggaactaaaacagagtatggagagaagttccagggcagagtcatcatcacgnggacacatccacgagtacagcctacatggaactgaggngcctcagatctgacgacacgccacttatactgcgcgagagattagttgcactggtcctgggctgtaaccacgcttggtggcg

SEQ ID NO: 246127 - DNA, 522 bp, Homo sapiens
  misc_feature: GYAE6OF02IKP84.42.49.E05.1.454.CMB.1.raw
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (463)..(463): a, c, t, g, unknown or other
  misc_feature (463)..(463): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggaggtggatggggatgggatcagcccttacggaactaaacagagtatggagagaagttccaggcagagtcatcatcaccgcggacacatccaacgagtacagcctanatggaactgagngcctcagatctgaacgacgacggcctacttattacgtnccgacgagagattagtgacactggtacctggcctaggtaaccgacgtcttggtggtacg

SEQ ID NO: 246128 - DNA, 541 bp, Homo sapiens
  misc_feature: GYAE6OF02IXFFP.42.49.E05.1.454.CMB.1.raw
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagtacaggcccccggagaggggcttgagtggagtgggatggatcgagacccttacggaactaaacgagtacgtagtggagagaagttccgagggcagagtacatcatcgaccgcggacacataccagagtacagcctanatggaatgagacncctanagactcgtagacgacacggacctattacgttactcggcgagacgagtattagtcgactcgtcggtacctggactacggtaaccacggtcttcggtggtaccg

SEQ ID NO: 246129 - DNA, 512 bp, Homo sapiens
  misc_feature: GYAE6OF02GCE0E.42.49.E05.1.454.CMB.1.raw
  modified_base (426)..(426): a, c, t, g, unknown or other
  misc_feature (426)..(426): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccaggcagagtcatcatcacgcggacacatccacgagtacagcctacatggaactgaggagcctnagatctgacgacacggcctacttacttactgcgcgagagattagtgacacgtgtcctggcttcgtaaccacgtcttggtggtaccg

SEQ ID NO: 246130 - DNA, 514 bp, Homo sapiens
  misc_feature: GYAE6OF02I0KEO.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccactacggtatgaattggttgagacaggcccccggagaggggcttggagtggatgggatggatcagcccttacggaactaaaacagagtatggagagaagttccagggcagagtcatcatcaccgcggacacatccacgagtacagcctacatggaactgaggagcctcacgatctgaaccgacacggcctacttattactgcgcgagagattagtgacactggtcctggtcttcgtaaccacgcttggtggaccg

SEQ ID NO: 246131 - DNA, 524 bp, Homo sapiens
  misc_feature: GYAE6OF02GLRDY.42.49.E05.1.454.CMB.1.raw
  modified_base (421)..(421): a, c, t, g, unknown or other
  misc_feature (421)..(421): n is a, c, g, or t
  modified_base (507)..(507): a, c, t, g, unknown or other
  misc_feature (507)..(507): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgagtggatgggatggatcgagcccttaggaactaaaacagagtatggagagaagttccaggcagagtcatcatcacgcgacacatccacgagtacagcctacagtggaactgagganccgtcagactcgtgacgacacggaccacgttactactgcgacgagagtattagtgactacgtcggtccgttggcctacggtaaccncgtcgttggtggtaccg

SEQ ID NO: 246132 - DNA, 516 bp, Homo sapiens
  misc_feature: GYAE6OF02JXBTM.42.49.E05.1.454.CMB.1.raw
  modified_base (391)..(391): a, c, t, g, unknown or other
  misc_feature (391)..(391): n is a, c, g, or t
  modified_base (411)..(411): a, c, t, g, unknown or other
  misc_feature (411)..(411): n is a, c, g, or t
  modified_base (463)..(463): a, c, t, g, unknown or other
  misc_feature (463)..(463): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagactaggcccccggagaggggcttgagtggatgggatggatcagcccgttacggaactaaacagtagtatggagagagttcgagtcagagtcatcatcacgcggacacnctacacgagtacagacctanataggactagagacgctacagatctgacgacgacgcctacttatactgacgngagagtatgtagcagtcgtcctggtctcgtaacctccgtgttcggtggtaccg

SEQ ID NO: 246133 - DNA, 544 bp, Homo sapiens
  misc_feature: GYAE6OF02J1J1X.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagtacaggccccggagaggggcttgagtggatgggatggatcagcccttaggaactaaacagagtatggagagaagttccagggcagagtcatcatcacgcggacacatccaacgagtacagcctacatggaacttggaacggagccgtagagactcgtgaaccgacgaccggccctaacttacttacgtcgacgacgagagatttagtcgactactcggtcctaggtccttaggtaaccgacggtacttgggtacggtaccg

SEQ ID NO: 246134 - DNA, 577 bp, Homo sapiens
  misc_feature: GYAE6OF02GV4ZJ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttggagtggatgggatggatcgagcccttacggaactaaaacagagtatggagagagttccgaggcagagtcatcatcaccgcggacacataccacgacgtacagacctaacataggaacttggacggacgccttacgagactcgtagaccgacgaccggcctaactttagttaccgtacgacgacgaagtacgtaagtttagttcgacctaacgttcgggttaccctgggaccgttacggtaaaccctaccggtacgtttcggtacgggtaccg

SEQ ID NO: 246135 - DNA, 566 bp, Homo sapiens
  misc_feature: GYAE6OF02ITFDG.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttggaggtggagtgggatggatcagcccttacggaactaaaacagagtagtgagagaagttcaggcagagtcatcatcacgcgacacatccacgagtacagacctacagtggaactgaggagcctcgaagctctacgacgacacggacctaacgttaacttactgaccgacgaacggagtacttaagttcggactaaccggtcggttacccgtaggtaccgttacggtaaaccgtacggtaccgttttcggtacgggtacccgg

SEQ ID NO: 246136 - DNA, 511 bp, Homo sapiens
  misc_feature: GYAE6OF02FRFL9.42.49.E05.1.454.CMB.1.raw
  modified_base (428)..(428): a, c, t, g, unknown or other
  misc_feature (428)..(428): n is a, c, g, or t
  modified_base (504)..(504): a, c, t, g, unknown or other
  misc_feature (504)..(504): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcgagcccttacggaactaaaacagagtatggagagaagttccagggcagagtcatcatcacgcggacacatccacgagtacagcctacatggaactgaggagcctnagatctgacgacacggccacttactactgcgtcgagagattagtgactacgtgtcctggctgtaacccagcttggnggtaccg

SEQ ID NO: 246137 - DNA, 510 bp, Homo sapiens
  misc_feature: GYAE6OF02F0UPM.42.49.E05.1.454.CMB.1.raw
  modified_base (496)..(496): a, c, t, g, unknown or other
  misc_feature (496)..(496): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcacgcggacacatccacgagtacagcctacatggaactgaggagcctcagatctgacgacacggccacttattaactgcgcgagagattattgctactggtcctggcttcgtaaccncgcttggtggtccg

SEQ ID NO: 246138 - DNA, 534 bp, Homo sapiens
  misc_feature: GYAE6OF02IZRAE.42.49.E05.1.454.CMB.1.raw
  modified_base (428)..(428): a, c, t, g, unknown or other
  misc_feature (428)..(428): n is a, c, g, or t
  modified_base (462)..(462): a, c, t, g, unknown or other
  misc_feature (462)..(462): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggatggggatggatcagccttaggaactaaacagagtatggagagaagttcagggcagagtcatcatcacgcggacacatccacgagtacagcctacatggaactgaggagcctcagntctgaacgaccgacgggaccaacgttacttaacncggacgcgagagattagtgactacgtggtaccttgggacttacggtaaccacgtcgttacggtgggtaccgg

SEQ ID NO: 246139 - DNA, 553 bp, Homo sapiens
  misc_feature: GYAE6OF02HAW8G.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatgggatggatcagcccttacggaactaaaacagagtatggagagaagttccagggtcagagtcatcatcaccgcgacacataccacgagtacagcctacactggaactgaggacgcctcgagatctagaaccgacaccggacctacgttaacttacgtcgcgacgagagatttagttgcctaacgtcggttacccgtggaccttacggtaaccctacggtcgtttaggtcgggtacccgg

SEQ ID NO: 246140 - DNA, 506 bp, Homo sapiens
  misc_feature: GYAE6OF02FVXM7.42.49.E05.1.454.CMB.1.raw
  modified_base (499)..(499): a, c, t, g, unknown or other
  misc_feature (499)..(499): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcaccgcggacacatcacgagtacagcctacatggaactgaggagcctcagatctgacgacacggccacttatactgcgcgagagattattgcactggtcctggctgtaaccacgtcttgnggtaccg

SEQ ID NO: 246141 - DNA, 578 bp, Homo sapiens
  misc_feature: GYAE6OF02JV0DG.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaatggttgagacgacggccccggacggaggggcgttggtaggtggtagtagggagtgggtagtactacggacccgttaaccgggtaaacgtaaaacgaaggtaggtaagtaggaggaaggaagttaccgagggacgagagtacatcatcacgcggacacactcgacgagtacacgctacagtggaactagaggagcctcagactcgtgacgacacggactaacttatacgtgcgacgagagtattagttcgctaacgtcgggtaccgtggacgttacggtaacccgaggtccgttggtgggtaccg

SEQ ID NO: 246142 - DNA, 545 bp, Homo sapiens
  misc_feature: GYAE6OF02IW7NB.42.49.E05.1.454.CMB.1.raw
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggaggtgggagtggggatggatcgagcccttacggaactaaacagagtanggagagaagttcgaggcagagtanatcatcaccgcggacacatccacgagtacagacctacactggaactgaggagcctcagtatcgtgacgacacggcctaacttacttactcgcgcgtagagtagttattcgacttacgtggtcccgttggccttacggtaaccctcggtcgtttaggcggtaccgg

SEQ ID NO: 246143 - DNA, 513 bp, Homo sapiens
  misc_feature: GYAE6OF02G3824.42.49.E05.1.454.CMB.1.raw
  modified_base (429)..(429): a, c, t, g, unknown or other
  misc_feature (429)..(429): n is a, c, g, or t
  modified_base (461)..(461): a, c, t, g, unknown or other
  misc_feature (461)..(461): n is a, c, g, or t
  modified_base (495)..(495): a, c, t, g, unknown or other
  misc_feature (495)..(495): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttcagggcagagtcatcatcaccgcggacacatccacgagtaccggcctacgatggaactgaggagcctnagatctgacgacacggccacttattactgcgngagagattagtgctactggtcctggctgtaaccncgtcttggtggctacggg

SEQ ID NO: 246144 - DNA, 563 bp, Homo sapiens
  misc_feature: GYAE6OF02JX4N6.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagtacaggcccccggagaggggcttggagtggatgggatggatcgacgccttaacggaactaaacgagaacggtatggaagagaagttccgagggacaggagtcatcatcacgacgacacactccgaacgacgtacagacctacagtacggaacttgaggacgcctgagactcgtagacgaccgacggaccactttaagttaactcggaccgacgagagtactttagtcgtacacgttcggtacccgtggccgttacgtaacctacggtacttggtcggtacgg

SEQ ID NO: 246145 - DNA, 522 bp, Homo sapiens
  misc_feature: GYAE6OF02ICRIB.42.49.E05.1.454.CMB.1.raw
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
  modified_base (458)..(458): a, c, t, g, unknown or other
  misc_feature (458)..(458): n is a, c, g, or t
  modified_base (503)..(503): a, c, t, g, unknown or other
  misc_feature (503)..(503): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggaggtggatgggatggatcgagcccttaggaactaaacagagtatggagagaagttccagggcagagtcatcatcgaccgcggacacatccagagtacagcctanataggaactgaggagcctnagatctgacgacacggccattacttacngcgcgagagtattagtgctacgtggtcctggtctacggtaacccncggtcttaggtggtaccgg

SEQ ID NO: 246146 - DNA, 591 bp, Homo sapiens
  misc_feature: GYAE6OF02I90OK.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacgacggccccggagaggggcttggagtggagtgggatggatcgagcccgttaacggaactaaaacgagagtagtaggagagaagttcgagggcagagtcatcatcgacgcgacacactccacgagtacagacctacagtaggaactggaggacgcctacgagtactcgtagaccgaacgaccggacctaacgttacttaccgtggaccgacgaagtagtaactttagttacggacctacgttcggttacccgtcgggtaccttaccggttaaacccgaccggttcgtttacgggtcgggtacccgg

SEQ ID NO: 246147 - DNA, 587 bp, Homo sapiens
  misc_feature: GYAE6OF02GUP79.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtactgaattggttgagtacaggcccccggagagggggcttggagtgggagtggggatgggatcgagcccgttaacggaactaaaacacgagtaagtgggagagaagttccgaggcagagtcatcagtcaccgcggacacactccaacgacgtacacgacctacacgtacggaactggaacggacgacctcagtatacgtcggaaccgacaccgggaccctaacgttacttaacctcggacggacgagagtaactttagtacggacctacgttcggtccgttggccgtacgtaacccgacgtcgtttggcgggtaccgg

SEQ ID NO: 246148 - DNA, 571 bp, Homo sapiens
  misc_feature: GYAE6OF02H4G8D.42.49.E05.1.454.CMB.1.raw
  modified_base (491)..(491): a, c, t, g, unknown or other
  misc_feature (491)..(491): n is a, c, g, or t
  modified_base (561)..(561): a, c, t, g, unknown or other
  misc_feature (561)..(561): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgtagactaggcccccggagacgggggtcttggaggtggagtgggatggatcagacccgttaggaactaaaacgagtagtagtggagagaagttccgagggacagtagtcatcatcaccgcggacacactccacgagtacagactacatggaactggtaggacgcctacagatcgtaggaacgacgaccgggcctaacgtttaacttaccgngacgcgagagtatttacgtggacctacgttcggtccgtggtactacggttaaccgtacggtcgtttgggnggtacccggg

SEQ ID NO: 246149 - DNA, 788 bp, Homo sapiens
  misc_feature: GYAE6OF02IK1Z1.42.49.E05.1.454.CMB.1.raw
  modified_base (360)..(360): a, c, t, g, unknown or other
  misc_feature (360)..(360): n is a, c, g, or t
tcagtgacgtatgtcacgaccggtgctcgatttagagcgactagcaacacacaaagggaccaaaaccaacaccctcccttcgggagaatccctacgatcacagctcctcaccatggacgggacctggagcatccttttcttggtggcagcagcaacaggtgcccactcccaggttcacctggtgcagtctggagctgagctgcagaagcctggggcctacagtgatggtctctgcagtgcttctggttacattctttccaccttacggtatgaattggttgaagactacgggcccccggtagagggggcctttggacggtgggatgggatgggatcaggtcccttaacggaactaaaacngagtactagggagaggtaagttccgaagggctacggaagtccaaagttcacgttaccgaccggaccggaacgactaacgtacccgaaggtaaccggtaacgtaaccggtaccttaaaccgaagtttaacgggaaacccgtttaggggaaacgggaacggttaccccggttaacaaccgggttaagtccccggttaagggtaacccggaaacccgggtaacccggggtaaccccgtaaccgtttttaaaccgtttaaccccggttacgggaacccgggtacccggttaaaagggaccgggttaaagttttttaaccggtccggttacccgtaaaccgggtttccggggtttaaccccttggggtaccccgttaccggtttaaaacccccggacgggttccccgttttaaggggtcccggggtacccggg

SEQ ID NO: 246150 - DNA, 602 bp, Homo sapiens
  misc_feature: GYAE6OF02JXYSM.42.49.E05.1.454.CMB.1.raw
tcagtgacgtatgtcacgaccggtgctcgatttagagcgactagcaacacacaaagggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacgtacggcccccggaggaggggtcgttgaggtggagtggggtagtggtatcgagcccgttaacggaaacgtaaaacaggaagtacgtaggagtaaggaagttaccgagggtacgaggagtcatcgatccgacgcggaacacgactccacggagtacagacctacagtacgaagtcggagacgcctagacgtatcgtagaccgaaccgaccggtacctaagttacttacgcgaccgtacgacgtagtattacgttcgacgttacgtacggttccgtacggtacttacgtaaacccgcgtacggtttcggacggtacccgg

SEQ ID NO: 246151 - DNA, 630 bp, Homo sapiens
  misc_feature: GYAE6OF02H46PA.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagactaggcccccggagacggggcttggagtggagtgggatggatcagcccttacggaactaaacagagtatggagagtaagttcgagggcagagtcatcatcgaccgcggacacatcccgaagacgtaacacgacctaacagttacggaaacgttggaaggacgccctagacggacttacgacggaacgaccgaccgggacccttaacgtttaacttaccgtaggacccggtacggaagtacggtaacttttaaggttcggtaacccttacggttccgggttacccgtgggttaccgttaccgggtaaaccctaccgggttacgtttcgggttcggggtaacccggg

SEQ ID NO: 246152 - DNA, 727 bp, Homo sapiens
  misc_feature: GYAE6OF02GU8ZH.42.49.E05.1.454.CMB.1.raw
  modified_base (416)..(416): a, c, t, g, unknown or other
  misc_feature (416)..(416): n is a, c, g, or t
tcagtgacgtatgtcacgaccggtgctcgatttagagcgactagcgaacacgacaaagggacccaaaaaaccacacccctccttgggacgaatcccctagatccacagcctcctcaccatggaccggacctggagcgactccgttttcttggtcggctagtcgagcaacgaggtgccccaacgtcccgtaggttcccaccttcggtcgacgaagttcgtggagctgagcctgcgagaagccgtgggcctcagtcgatggtactccctgcagtgcttcgtggttacacttccttttccaaccttacggttatagtaagttcggttagaggacgtacggacccccggaggtaccggggtcgttaggcgtcgggagtgggaatgggactcgacgtcccgttaacggaaacttaaaacgngaagttaagtacgggaagtaagtacgttaccgagggactaggagtcgagtcacgtccgaccgtacggaaccacgaacctaccgaacggtaacgtaaccgacgtaccctaacgtaacgtacggaaacgttggaccggtacgacccgttacgaacgtcttacgtacgaaaccgtaccggaccggttacccttaacgtttaacttaccgacggtaccgacggtaagacggttacgttacgtcgtaccgttaacggtcgttaccgttcggacgttaccggtaaccgtacggttcgtttacgggcggtaacccggg

SEQ ID NO: 246153 - DNA, 545 bp, Homo sapiens
  misc_feature: GYAE6OF02IDPZZ.42.49.E05.1.454.CMB.1.raw
  modified_base (538)..(538): a, c, t, g, unknown or other
  misc_feature (538)..(538): n is a, c, g, or t
tcagtgacgtatgtcacgaccggtgctcgatttagagcgactagcaacgacacaaaggggacccaaaaaccacacccctccttgggagaatccctagatcacagctcctcaccatggacgggacctggagcatccttttcttggtggcagcagcaacaggtgcccactccccaggttcacctggtgcagtctggagctgagcctgcagaagcctggggcctcagtgatggtctcctgcagtgcttctggttacatcttttccacctacggtactgaattcggttgagtactagggcccccggaggacggggctttcggaggtgggatgggatggatcagcccttaacggaactaaaacgagagtagtggagagaagttccagggacagagtacatcatcaccgcggacacactaccacgagtacagcctaacataggaactgagagcctcagatcgtagacgacacggcctacgttagtacctgacgacgagagtattagtgctacgtggtcctggctacgtaacctcgtcgttcggnggtaccg

SEQ ID NO: 246154 - DNA, 513 bp, Homo sapiens
  misc_feature: GYAE6OF02GKAZI.42.49.E05.1.454.CMB.1.raw
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (496)..(496): a, c, t, g, unknown or other
  misc_feature (496)..(496): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccaccttacggtatcgaattggttgagtacaggcccccggagagggggcttggagtggatgggatggatcagcccttaacggaactaaaacagagtatggagagaagttcagggcagagtcatcatcacgcgacacatccacgagtacagcctacatggaacttgagncctnagatctgacgacacgccacttatactgcgcgagagattagtgacacgtggtcctggctcgtaaccncggtcttggtggtaccg

SEQ ID NO: 246155 - DNA, 513 bp, Homo sapiens
  misc_feature: GYAE6OF02F02IV.42.49.E05.1.454.CMB.1.raw
  modified_base (422)..(422): a, c, t, g, unknown or other
  misc_feature (422)..(422): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttaggaactaaacagagtatggagagaagttcgaggcagagtcatcatcacgcgacacatccacgagtacagcctacatggaactgaggagcctnagatctagacgacacggccacttatactgcgacgagagattagtgactacgtcggtcctggcttcgtaacccgacgtcgttggtggtaccg

SEQ ID NO: 246156 - DNA, 525 bp, Homo sapiens
  misc_feature: GYAE6OF02HCHOY.42.49.E05.1.454.CMB.1.raw
  modified_base (509)..(509): a, c, t, g, unknown or other
  misc_feature (509)..(509): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcgagccttacggaactaaaacagagtatggagagaagttccaggcagagtcatcatcacgcggacacatccacgagtacagacctacatggaactgaggacgcctcagactctagacgacgacggcctaacttattacgcgcgacgagagtatttagtgactacgtcggtcctggcttcggtaaccncgtcttggtggtaccg

SEQ ID NO: 246157 - DNA, 537 bp, Homo sapiens
  misc_feature: GYAE6OF02GB174.42.49.E05.1.454.CMB.1.raw
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgagtggatgggatggatcagcccgttacggaactaaaacagagtataggagagaagttccgagggcagagtcatcatcaccgcggacacatccacgagtacagcctacatggaactggaggagcctcagatctgaccgacgacggccaacttacttactgcgacgagagtattagttcgctaacgtcggttcctggtccttcggtaaacccncggtctttcgggnggtaccgg

SEQ ID NO: 246158 - DNA, 573 bp, Homo sapiens
  misc_feature: GYAE6OF02IZ3XZ.42.49.E05.1.454.CMB.1.raw
  modified_base (439)..(439): a, c, t, g, unknown or other
  misc_feature (439)..(439): n is a, c, g, or t
tcagtgacgtatgtcacgaccggtgctcgatttagagcgactagcaacacacaaaggggacccaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattcttttccacctacggtatcgaatttggttgagtacaggcccccggaggagggggcttggagtggatggggatggatcagcccttaggaactaaacgagagtataggagagaagttcaggcagagtcatcatcgacgcggacactactaccacgagtaccagtcctacgaatcggaactggacggacncctacgagacgtcctaggacgaccgaccggtacctaactttacttaacgcggtaccgcgagagtatttacgtggacctacgtacggtccttacggcttacggttaacccgacgtcgtttacggacggtacccgg

SEQ ID NO: 246159 - DNA, 543 bp, Homo sapiens
  misc_feature: GYAE6OF02GK9YK.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttggagtggatggggatggatcgagcccttacggaactaaaacagagtatggagagaagttcgagggcagagtcatcatcaccgcggacacatccgacgagtacacgacctacatacggaactaggacggacgcctacgagatcgtagaccgacgaccggcctaactttacttactcgacgacgagagtattatgactacgtcggtccgtggctcgtaaccacgcgttcggtggtaccg

SEQ ID NO: 246160 - DNA, 591 bp, Homo sapiens
  misc_feature: GYAE6OF02JHJ7T.42.49.E05.1.454.CMB.1.raw
  modified_base (397)..(397): a, c, t, g, unknown or other
  misc_feature (397)..(397): n is a, c, g, or t
  modified_base (434)..(434): a, c, t, g, unknown or other
  misc_feature (434)..(434): n is a, c, g, or t
tcagtgacgtatgtcacgaccggtgctcgatttagagcgactagctaacgacacgaaagggacccaaaaacctacacccctccttgggacgaatcccctagatcacaggctcctcaccgattggacggacctggagcatccttttctggtgcagcagtcaacagtgcccacttccagtcgacctgtgcgagtctggagctgagctgcagaagcctgggccttcagtcgtactggtctcctggacagtgcttctggttacagtcttttccgacctacggtacgtgaatttggttgagacaggcccccgaggagggcgttgagtggagtgggatggatcgacgcccttacggaactaaacgacgagtatggagagaagttccgagggcagagtcacgtnatcgaccgcggacacagtaccaacgctaacagcctanagtacggaacctggaaggacgcctacgacgactcgtagaccgaccgaccgggaccctacgttaagtttaccgtcgaccgtcgaggtagtaacttaggttacgctacgttcggtccgtaggtcttacggtaacccacggtcgtttcggtgggtacccg

SEQ ID NO: 246161 - DNA, 514 bp, Homo sapiens
  misc_feature: GYAE6OF02FVAGJ.42.49.E05.1.454.CMB.1.raw
  modified_base (376)..(376): a, c, t, g, unknown or other
  misc_feature (376)..(376): n is a, c, g, or t
  modified_base (507)..(507): a, c, t, g, unknown or other
  misc_feature (507)..(507): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatggggatggatcagcccttacggaactaaaacagagtatggagagaagttccagggcagagtnatcatcacgcggacacatccacgagtacagcctacatggaactgaggagcctcagatctgacgacaacggccacttattactgcgcgagagattagtgctactggtcctggctacgtaaccacgtcttggnggtaccg

SEQ ID NO: 246162 - DNA, 521 bp, Homo sapiens
  misc_feature: GYAE6OF02IOYP3.42.49.E05.1.454.CMB.1.raw
  modified_base (461)..(461): a, c, t, g, unknown or other
  misc_feature (461)..(461): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggagtgggatgggatcagcccttaacggaactaaaacagagtatggagagaagttccagggcagagtcatcatcacgcgacacatccacgagtacagcctacatggaactgaggacgcctcagatctgacgacaccggcctacttattacngacgacgagagattagtgacacgtcggtcctaggctacgtaaccacgtcttggtggtacg

SEQ ID NO: 246163 - DNA, 529 bp, Homo sapiens
  misc_feature: GYAE6OF02GSEKZ.42.49.E05.1.454.CMB.1.raw
  modified_base (345)..(345): a, c, t, g, unknown or other
  misc_feature (345)..(345): n is a, c, g, or t
  modified_base (411)..(411): a, c, t, g, unknown or other
  misc_feature (411)..(411): n is a, c, g, or t
  modified_base (510)..(510): a, c, t, g, unknown or other
  misc_feature (510)..(510): n is a, c, g, or t
  modified_base (521)..(521): a, c, t, g, unknown or other
  misc_feature (521)..(521): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactccccaggttcacctggtgcagtctggagctgagctgcagaagcctggggcctcagtgatggtctcctgcagtgcttctggttacatcttttccacctacgtatgaattggttgagacaggcccccgagaggggcttgagtggatgggatgggatcgagcccttaacggaactaaacngaagtatggagagaagtcagggcagagtcatcatcaccgcgacacactccgacgagtacagcctanactggaactgaggagcctagagatcagaccgacgacgacctacgttattacgcgcgacgagagtattagttcgactcgtgtcccgtgacctcgtaaccncgtcgttcggnggtaccgg

SEQ ID NO: 246164 - DNA, 519 bp, Homo sapiens
  misc_feature: GYAE6OF02I67O6.42.49.E05.1.454.CMB.1.raw
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (436)..(436): a, c, t, g, unknown or other
  misc_feature (436)..(436): n is a, c, g, or t
  modified_base (460)..(460): a, c, t, g, unknown or other
  misc_feature (460)..(460): n is a, c, g, or t
  modified_base (469)..(469): a, c, t, g, unknown or other
  misc_feature (469)..(469): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcgcctggtgcagtctggagctgagctgcagaagcctgggggcctcagtgatggtctcctgcagtgcttctggttacatcttttccacctacggtatgaattggttgagacagggcccccggagacgggggcttgagtggatgggatggatcagccttacggaactaaaacagatagtggagagaagttcagggcagagtcatcatcaccgngacacactccacgngtacngcctacatggaatgaggagcctacagactcngaccgacacggccacttacttacncgacgcganagtattagtgctacgtcggtcctggctagtaaccacgtcttggtggtccg

SEQ ID NO: 246165 - DNA, 590 bp, Homo sapiens
  misc_feature: GYAE6OF02JDMRI.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccaccttacggtatgaacttggttgagtacacggcccccggaggagggggtcttgaggtcggagtgggagtggatcgagcccttacggaactaaacgagagtacgtggagagaacgttccgagggcagagtcatcagtcaccgcggacacgactccacgagtacaagcctaacagtggaaccttggacggtacgccgtcagatcgtagaccgacgaccggtacctactttagttacctcggacgtccgaaggtagtaacgttagtcggacctaacgttcgggtacccgtggtaccttagtaacccgacggtccgtttacggtgggtacccgg

SEQ ID NO: 246166 - DNA, 659 bp, Homo sapiens
  misc_feature: GYAE6OF02J0LFB.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacatctttccacctacggtatgtaattggttgagacaggtccccggagtacggggcttgacgtggatggggatggatcgagtcccgttaacggaactaaacgagtagtacgtagggaagtacgaaggttccgagggtactaggagtacagtcagtcacgacggacacgatccgacgagtacacgtcctaacagtacggaaacttggaacggtacgcccgttaacgacggtaactttacggcggaaaccgaccgtaacccgggaaccttaaccgtttaacgttaacgttaccggacggtacccggaagtacgttaagtttacgttcggtaacccgttacgttaacccgggttccgttagggtacctttaacggtaaaccccgtacgttacgttacgggttcggggaacccgg

SEQ ID NO: 246167 - DNA, 722 bp, Homo sapiens
  misc_feature: GYAE6OF02GEJAL.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttcgtggttacattcttttccacctacggtactgaattggttgagacgtacggcccccggaggaggggtcttggagtggagtgggagtgggatcgacgcccgttaacggaactaaaaccgagaagtacgtaggaaggtaagtaaacggtttaccgaaggggtacgaacggtaacgtacaagttaccgaacgtacccgtacccgggaaccggaacccgaaaccgacgttaaccccgaaccgggtaacggtaaccgaacggtaccctaaaccgtaacgtacgggaaaccgttaaggaacgggacgtacccttacggaacgtacgttcccgtaaggaaccgaccgaaccgggtaccctaacgtttactttaaccggcggaccgacgtagtacgtagtttacggttactaccgttacgttccgttccggtacggtcgttaaccggtaaccccgtaacggtccggtttacgggtcggttaacccggg

SEQ ID NO: 246168 - DNA, 571 bp, Homo sapiens
  misc_feature: GYAE6OF02HWR22.42.49.E05.1.454.CMB.1.raw
  modified_base (354)..(354): a, c, t, g, unknown or other
  misc_feature (354)..(354): n is a, c, g, or t
  modified_base (411)..(411): a, c, t, g, unknown or other
  misc_feature (411)..(411): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacaggcccccggagagggggcttggaggtggagtgggatggatcagccttacggaactaaacgagagtanggagagagttcagggcagagtcatcatcaccgcggacacatccagagtacagcctanatggaactggaggacgcctacagtatcgtacggaccgaccgaccgggaccctaactttaagtttacctgccggacggagtagtatttaagttcgactaccggttcggtaccgttgggaccttcggttaaacccacggtacgtttgggtacgggtacccgg

SEQ ID NO: 246169 - DNA, 604 bp, Homo sapiens
  misc_feature: GYAE6OF02IPAT4.42.49.E05.1.454.CMB.1.raw
  modified_base (377)..(377): a, c, t, g, unknown or other
  misc_feature (377)..(377): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacaggcccccggagagggggcttggagtggagtgggatggatcgagccttacggaactaaacgagagtagtggagagagttcgaggcagagtnatcatcgacgcgacacatccagagtacacgactacagtggaactggacggacgtcctacgacgactcgacgaccgacaccgggacctaacgtttacttaccgtgaccggacgtaaggacgtagtttaacgttacggtacctacggttaccgggttcccgttacgggtaccgtttaccggttaaaccccggtaccggttaccggttttcgggtacggggttacccggg

SEQ ID NO: 246170 - DNA, 530 bp, Homo sapiens
  misc_feature: GYAE6OF02F29TC.42.49.E05.1.454.CMB.1.raw
  modified_base (513)..(513): a, c, t, g, unknown or other
  misc_feature (513)..(513): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaacagagtatggagagaagttccaggcagagtcatcatcacgcgacacatccacgagtacagcctacatggaactggacggagcctcgagactcgtagacgacgaccggcctactttattactcgacgcgagtagtattagttgactacgtcggtcctgggtctacggtaaccncggtcttggtggtaccg

SEQ ID NO: 246171 - DNA, 667 bp, Homo sapiens
  misc_feature: GYAE6OF02F6V1J.42.49.E05.1.454.CMB.1.raw
  modified_base (246)..(246): a, c, t, g, unknown or other
  misc_feature (246)..(246): n is a, c, g, or t
tcagtgacgtatgtcacgaccggtgctcgatttagagcgactagcaacacacaaaggggacccaaaaaccacacccctccttgggagaactcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttntggttactacttctttccaccttacggttatgtaattggttgagacgacgggcccccggaggacggggcttggaggtggagtggggatggactcgacgtcccgttaacggaaactaaaacgaggtacgtagtagggagtaaggtaacgttaccgagggacaaggtagtacagtacacgtaccgaaccggcggaacaaccgtactaccgaacgaagtaaccacggtaccctaacgacgtacggaaactggaaggacgtcctacgaagtactcgtacggaaccgaccgaaccgggtaccctaactttaacgttaccgtggaccgacggaagtacggtaatttacgtcgtaccgtacggttccggttaccgttcggtaccgttacggtaaccccgtacggtcggtttagggtacggtacccggg

SEQ ID NO: 246172 - DNA, 542 bp, Homo sapiens
  misc_feature: GYAE6OF02GICGC.42.49.E05.1.454.CMB.1.raw
  modified_base (419)..(419): a, c, t, g, unknown or other
  misc_feature (419)..(419): n is a, c, g, or t
  modified_base (524)..(524): a, c, t, g, unknown or other
  misc_feature (524)..(524): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacgacggcccccgggaggaggggcttggagtgggatgggatggatcgagcccttaacggaactaaaacagagtagtggagagaagttccgagggcagagtcatcatcacgcgacacatccacgagtacagcctanagtgaactgaggacgcctgagatcgtagacgacgaccggacctacgtttacttactgtaccgcgagagtattagtgactacgtcggtcctggcttacggtaaccncgtcgttggtcggtacgg

SEQ ID NO: 246173 - DNA, 582 bp, Homo sapiens
  misc_feature: GYAE6OF02J13GL.42.49.E05.1.454.CMB.1.raw
tcagtgacgtatgtcacgaccggtgctcgatttagagcgactagcaacacacaaagggacccaaaaccacaccctccttggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacacgggcccccggaggagggggcttggagtggagtgggatgggatcgaggtcccgttacggaaactaaaacacgtaggataggagagtaagttccgagggcagagtcatcatcaccgcggacacatccgacgatacgagtaccctaacacgtaggaacgttgaggacgcctacagctacgtggaccgacgaccggtcctaacgtttacttaccgtcggcgacgtaagacgtatttagttcgaccgtatccggttccgtggtacttaccggtaaccgtcggtacgtttacggtcggtaccgg

SEQ ID NO: 246174 - DNA, 570 bp, Homo sapiens
  misc_feature: GYAE6OF02GSRXJ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacagggcccccggagaggggcttgagtggatgggatggatcgagcccttaaggaactaaaacagagtatggagagaagttccagggcagagtcatcatcacgcggacacatccacgagtacagccctacactaggaactgaggacgcctcgagatctagacgaccgaccggcctaacgtttacttaacctcggaccgacgtaagaggtaactttagttcggacctaaccgtcggggttccctagggtccttacggtaaacccctacggctttacgggtggggtacccg

SEQ ID NO: 246175 - DNA, 528 bp, Homo sapiens
  misc_feature: GYAE6OF02JI8MG.42.49.E05.1.454.CMB.1.raw
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (444)..(444): a, c, t, g, unknown or other
  misc_feature (444)..(444): n is a, c, g, or t
  modified_base (468)..(468): a, c, t, g, unknown or other
  misc_feature (468)..(468): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggatgggatgggatcgagcccgttaacggaactaaaacagagtagtggagaggaagttccgagggacagagtcatcatccaccgcggacacatccacgagtacagcctanatggaatgaggancctnacgatcnggacacacggcctaacttattacngcgcgagagtatattggactacgtggtcctggcttcgtaaccacgtccgttagtgggacc

SEQ ID NO: 246176 - DNA, 523 bp, Homo sapiens
  misc_feature: GYAE6OF02IT0U3.42.49.E05.1.454.CMB.1.raw
  modified_base (430)..(430): a, c, t, g, unknown or other
  misc_feature (430)..(430): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcgagcccttacggaactaaaacagagtatggagagaagttccgagggcagagtcatcatcaccgcggacacatccacgagtacagcctacagtgaactgaggagcctnagatctgacgacacggccaacttattactgcgcgagagattagttgctacgtcggtcctggccttaggtaacccacgtcgttggcggtaccgg

SEQ ID NO: 246177 - DNA, 640 bp, Homo sapiens
  misc_feature: GYAE6OF02HCE44.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctgttacattcttttccaccttacggtatgaattggttgagacacggcccccggagaggggcttggagtggagtgggagtgggactcgacgtacccgttaacggaaactaaaacgagtagtagtaggaagaagtaagttaccgaggcagagtacatcatccacgcgaacacactacccgaagacgtaacacgtacctaacacgtacggaacgttaggaaggaccgaccttacgaacgtactacgtacgaacgaaccgaccgtaccctaacgtttacgttaacgtaccggcgtaccgtaaggacgttaagtttacgttacggaccgtaacggttccggttaccgtacggtacctttaacggtaacccgtaacggttcgtttacggggtcggtaacccgg

SEQ ID NO: 246178 - DNA, 525 bp, Homo sapiens
  misc_feature: GYAE6OF02FZCWJ.42.49.E05.1.454.CMB.1.raw
  modified_base (431)..(431): a, c, t, g, unknown or other
  misc_feature (431)..(431): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacaggccccggagaggggcttgagtggatgggatggatcagcccgttacggaactaaaacagagtagtggagagaagttcagggcagagtcatcatcacgcggacacatccacgagtacacgacctacatggaactgaggacgcctanagatcgtagacgacgacggacctacttatacgtcgcgacgagagtattattcgctacgtggtccgtggtctcgtaacctcgcgttggtggtacg

SEQ ID NO: 246179 - DNA, 786 bp, Homo sapiens
  misc_feature: GYAE6OF02IZVT1.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtctccgtgcgagtgtcttctggttacattccttttccaccgtacggtatcgtaagttggttgagacgtacggcccccggaggagggtccgttggacggtggtaagtgggacgtggacgtacgtacggacccgtttaacggaaaccgttaaaaccgaggtaaggtaagtacggggaataaggtaacgttacccggagggtaccgaaggtacggtacgtaacgtaccgaagtccgaaccggccgggtaacctaacgtaaacgtaccccgaaacgtacggtaaccgtaaccgggtaccttaaccgaacggtaacccgggtaaagttaccgggaaacggggtaaccgttaccccggacgtaaacggtaccgttacggtaaccggtaaccggacccggtacccggtaacccttaaccgttttacgtaaaccgttcggaaccgggtacggtagtaacggttaacttaaggttcgaaccgttacggttaccgggttacccgtagggttaccctaaccgggttaaacccgtcggtaccggtttaccgggtggtaaccccgggg

SEQ ID NO: 246180 - DNA, 651 bp, Homo sapiens
  misc_feature: GYAE6OF02H69ZE.42.49.E05.1.454.CMB.1.raw
  modified_base (381)..(381): a, c, t, g, unknown or other
  misc_feature (381)..(381): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctcagtgatggtctcctgcagtgcttctggttacatctttccacctacggtatgaattggttgagacgaggcccccggaggaggggcttggaggtggagtgggatgggatcgagcccgttaacggaaactaaaacgagagtatggagaggaagttcgagggcaggngtacatcatcaccgcgacacactccaacgacgtacagaccctaacagtaggaaactaggacggacgaccgtacgacgaacttcgtacggaaccggacccgaaccgggtaccctaaccgttttaacttaccgtacggaacccggtacggtaacggaacgtaacgtttttaacggtcggtaacccgttaacggttccgggttacccgtacgggttaccgttacggttaaaccccgtacgggtttaccgttttacgggtcggggttacccggg

SEQ ID NO: 246181 - DNA, 515 bp, Homo sapiens
  misc_feature: GYAE6OF02FFI5C.42.49.E05.1.454.CMB.1.raw
  modified_base (500)..(500): a, c, t, g, unknown or other
  misc_feature (500)..(500): n is a, c, g, or t
tcagtgacgtatgtcacgaccggtgctcgatttagagcgactagcaacacacaaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggatgggatggatcagcccttacggaactaaaacagagtatggagagaagttccagggcagagtcatcatcaccgcggacacatccacgagtacagcctacatggaactgaggagcctcagatctgacgacgacggacctacttatactgcgcgagagattattgcacgtcggtcctggctgtaacccngtccttggtggtacg

SEQ ID NO: 246182 - DNA, 627 bp, Homo sapiens
  misc_feature: GYAE6OF02GR2QD.42.49.E05.1.454.CMB.1.raw
  modified_base (389)..(389): a, c, t, g, unknown or other
  misc_feature (389)..(389): n is a, c, g, or t
  modified_base (468)..(468): a, c, t, g, unknown or other
  misc_feature (468)..(468): n is a, c, g, or t
tcagtgacgtatgtcacgaccggtgctcgatttagagcgactagcaacacacaaagggacccaaaaccaacaccctccttcggagaatcccctagatcacagctcctcaccatggacggacctggagcatctttttcttggtgcagcagcaacaggtgcccactcccaggttcacctggtgcagtctggagctgagctgacagaagcctggggcctcgagtgatggtctcctgcagtgcttctaggttacattctttccacctacggtatgtaattggttgagactacggccccggagagggtctgagtggatggactggatcgagcccgttaggaaacttaaaacgagtagtagtaggagtagaacgttacgagggacgaggaacgtnaacttacacgtccgaaccggcgaacaacgtacacccgaacgacggtacacgacctaacacgtaggaactgaagggtacnccgtacgatacgtacgtagaaccgacgtaccgaccgtactttaattaacgcggtaccgagtaacgacgttaagttaccggtacgtacgtaacccgttggtaacccggtttgaccgttacggtaaaccccgtagtccggttttacggccggttaacccgg

SEQ ID NO: 246183 - DNA, 685 bp, Homo sapiens
  misc_feature: GYAE6OF02IDH27.42.49.E05.1.454.CMB.1.raw
  modified_base (282)..(282): a, c, t, g, unknown or other
  misc_feature (282)..(282): n is a, c, g, or t
  modified_base (394)..(394): a, c, t, g, unknown or other
  misc_feature (394)..(394): n is a, c, g, or t
tcagtgacgtatgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtcgcccactcccaggttcacctggtgcagtctggagctgagctgcagagccgtgggcctgagtgatggtctctgcagtgtcttcgtggtacatctttccacgtacgtatagtaattgggttanacgacgacgggtcccccggaggtacggggtcttggaggtgggagttgggatgggattcgacgtccgtaacgaactaagagtagagtagagagagttcggaggacaggtgtanatacactcgaccgagtaaccacacgtacccgaacggtaacgtaccgaagtacccgtaacgacggtacgtaacgttaggaccggtaacgtcccgttacgaacgtccttaacggttaccgaaccggtaaccgtaaccgggtacccttaacgtttaacgttaccgtacggtaccggaggtaaccgagttaacggtaagtttaccgtacgtaccggtttaccggtacccggttaggttacccggtaccggttaaccctacccgggttaggttaccgggttacgggtaacccgggg

SEQ ID NO: 246184 - DNA, 590 bp, Homo sapiens
  misc_feature: GYAE6OF02IF7M0.42.49.E05.1.454.CMB.1.raw
  modified_base (350)..(350): a, c, t, g, unknown or other
  misc_feature (350)..(350): n is a, c, g, or t
  modified_base (391)..(391): a, c, t, g, unknown or other
  misc_feature (391)..(391): n is a, c, g, or t
  modified_base (406)..(406): a, c, t, g, unknown or other
  misc_feature (406)..(406): n is a, c, g, or t
tcagtgacgtatgtcacgaccggtgctcgatttagagcgactagcaacacacaaaggggacccaaaaaccacacccctccttgggagaatctcctagatcacagctcctcaccatggacgggacctggagcatccttttcttggtggcagcagcaacaggtgcccactcccaggttcacctggtgcagtctggagctgagctgcagaagcctggggcctcgagtggatggtctcctgcagtgcttctggttacatcttttccacctacggtatgaatttggttgagacaggccccggagagggcttgagtgatggagtggatcgagccttacggaactaaacagagtagngagagaagttcgaggctagagtcatgatcgacgcggactanacacccaagacgtanacgacctaacgagttacggaacgtaggaacggaagtccgtacaacgggacttaccgtagaccgaaaccgaaccgggaccctaacgtttaaacttacgtaccggtacgaccgtaggacgttaaagtttcgacgtacgtaaccgtggttccgtggaccgttgtaaaccgcgttcgtaggtaccggg

SEQ ID NO: 246185 - DNA, 528 bp, Homo sapiens
  misc_feature: GYAE6OF02GX3E3.42.49.E05.1.454.CMB.1.raw
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (521)..(521): a, c, t, g, unknown or other
  misc_feature (521)..(521): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttaggaactaaaacagagtatggagagaagttcagggcagagtcatcatcaccgcgacacatccacgagtacagcctacataggaactgaggancctnagatcgtgacgacgaccggccaacttacttactgcgacgagagattagttgactacgtcggtacgttggcttacgtaaccgtacggtcgttaggnggtaccg

SEQ ID NO: 246186 - DNA, 559 bp, Homo sapiens
  misc_feature: GYAE6OF02FGC90.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagagcctggggcctcagtgatggtctcctgcagtgcttctggttacatctttccaccttacggtatgtaattggttgagacaggcccccggaggaggggcttgagtggatgggatggatcagtacccttacggaactaaacagagtataggagagagttccgagggcagagtcatcatccgaccgcggacacataccacgacgtacacgcctaacagtacggaactgacggacgcctacagtactcgtacgacgaccgaccggtacctactttaactactcgcgacgagtagattagtcgcacgttcggtaccctggtacctacggtaacccgtcgtacgttcggtacggtaccgg

SEQ ID NO: 246187 - DNA, 572 bp, Homo sapiens
  misc_feature: GYAE6OF02H2V3T.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacattccttttccaccttacggtatgaattggttgagacacggtcccccggaggacggggtcttggacggtggagtgggatggatcgacgcccgttacggaactaaacagagtatggagagtagtcgaggacagagtcatacatcacgcggacacgactaccacgtaacgtacacgtacctacatacggaactggacggacgcctacgaagactcgtacggacgaccgacgggaccctaactttacttactcgccgcgagagtactttagtcgacctacgtggtaccctggacctagtaaccctacggtcttcggtggtaccgg

SEQ ID NO: 246188 - DNA, 748 bp, Homo sapiens
  misc_feature: GYAE6OF02I08CM.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctccgtgcagtgtcttcgtggttacattcttttaccaccttacggtatacgtaattggttagagacacggcccccggaggacgggggcttaggacggtggtaagtcggggtatgggatccgaacggtcccgttaacgggaaacctaaaacgaaggtaaggttaacgtaggaagtaacggtaacgtttaccggaaggggtaccgaagggtaacgtacgaacgttaccgtaacgttacccgaacccggacggaaccctaacgtaacctacccgaacggtaaacggtacccgaacggtacccctaacgaacgtacggtaaaccgtaggaacgggacgtacccttacgtacgtacttaccgtacggaccgtaaccggaccggtaccctaaccgtttaactttaaccggtcgaccggtacgtacggtaacgtacgtttacgtacggtaccgtaacggttccggttaccgtcggttaccgttacggttaaacccgtcgtaccggtttgggtaccgggtaacccggg

SEQ ID NO: 246189 - DNA, 601 bp, Homo sapiens
  misc_feature: GYAE6OF02IMGXR.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacattctttccactacggtatgtattggtgagacgacggccccggaggagggcttggaggtggagtgggatggatcgacgtcccgttaacggaactaaaacgaagtagtaagtagggaagagtaaacggttccgaagggacgaaggtagtacatacgactacgacccgcggaacactaactccgacgtaacgtacacacctaatagtagaacgtagacggacgtcctacgagactacgtacgaacgaccgacgacctacgttacttcgtacgacgacgagagtattagtacgccgtacgtcggttaccgtggtacttacggtaacccgacggtcggttcggtgggtaccgg

SEQ ID NO: 246190 - DNA, 566 bp, Homo sapiens
  misc_feature: GYAE6OF02G8T7Z.42.49.E05.1.454.CMB.1.raw
  modified_base (417)..(417): a, c, t, g, unknown or other
  misc_feature (417)..(417): n is a, c, g, or t
  modified_base (479)..(479): a, c, t, g, unknown or other
  misc_feature (479)..(479): n is a, c, g, or t
tcagtgacgtatgtcacgaccggtgctcgatttagagcgactagcaacacacaaaggggacccaaaaaccacacccctccttgggagaatcccctagatcacagctcctcaccatggacggggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacagggcccccggagaggggcttggagtggatgggatggatcagcccttacggaactaaacagagtatggagagagttcgagggcagagtcatcatccaccgcggacacactaccacgacgtacagaccctanactaggaactggaaggacgcctcagactcgtcgaacgaccgaccggcctaactttacttacnggccgcgagacgtatttacgttgaccacgttcgggttccgtggtaccttacggtaaaccctacggtcgtttgggtacgggtacccgg

SEQ ID NO: 246191 - DNA, 620 bp, Homo sapiens
  misc_feature: GYAE6OF02HBJUY.42.49.E05.1.454.CMB.1.raw
  modified_base (464)..(464): a, c, t, g, unknown or other
  misc_feature (464)..(464): n is a, c, g, or t
  modified_base (516)..(516): a, c, t, g, unknown or other
  misc_feature (516)..(516): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccaccgtacggtatgtaattggttgagtacacggcccccggaggacggggcttggagtggagtgggagtggatcgacgtcccgtaacggaaactaaaacgagagtagtggagagaagttacgagggcgagacgtacgatacagtaccgacgaccggacacgactccaacgacgtaccagacctacagtaggaacttcgacgggacnccgtacagtactcgtacgaacgaccgaccgtacctaacgtttacttaaccgnggtaccgcgtaacggtacgttaggttttacgtcgtaccgtacgttccggtccgttacggtccgttacggttaacccgtacgtccggttacggtcgggtacccgg

SEQ ID NO: 246192 - DNA, 668 bp, Homo sapiens
  misc_feature: GYAE6OF02ID02J.42.49.E05.1.454.CMB.1.raw
  modified_base (584)..(584): a, c, t, g, unknown or other
  misc_feature (584)..(584): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttactattcttttccacctacggtatcgaattggttgagacgaggcccccgggaggacgggtcttggacggttggagtgggatgggatcgagtcccgttaacgggaaaccttaaaacgagtaggtaagtgggaagtaacggtaaaggttcccgaaggggacctaagggacgttacgtaaacgttcgaacttaccgacccggaccgggaacctaacgtactcccgaacggtaacgttaacgaacgtacccgtaactaaggtacggaacgttagggacggaaccggtcctacgagacgttcgtacgaaccgacgacccgggtacaacctttagttaccgngtaccgacgagagtactttagtccgactacgtcggtttacccgtggtacctacggttacccacggtacttcgggtaggtcccgg

SEQ ID NO: 246193 - DNA, 534 bp, Homo sapiens
  misc_feature: GYAE6OF02HHVFF.42.49.E05.1.454.CMB.1.raw
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (473)..(473): a, c, t, g, unknown or other
  misc_feature (473)..(473): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggccccggagaggggcttgagtggatgggatgggatcgagcccttaacggaactaaaaacaggaagtagtgggaagaggaacgttaccaagggcagagtcatcatcaccgcggacacatccacgagtacacgacctacatggaactgagagcctnagatngacgacacggctacgttatacgtgcgngacgagattagtcgctacgtggtacctggaccgttagaacctacggcttacggtggtaccg

SEQ ID NO: 246194 - DNA, 629 bp, Homo sapiens
  misc_feature: GYAE6OF02G2DYO.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgaattggttgagacacgggcccccggaggaggggcttggaggtggagtggggagtgggatcgacgtacccgttaacggaaactaaaacgagagtaagtaggaagagaacggttaccgagggcaaggagtcatacactcgaccgcggacacactaccgacggataccagacctactaagtcggaacgtggaaggacgtacctacagtacgtcgtagaccgtaaccgaccgtacctaacctttacgttaccgtcgaccggtaccgtaaggacgtagtttaacgttcggaccttacggttccggtccgttacggtcctttaacggtaacccgtaccggtcgtttacgggtcggtaaccggg

SEQ ID NO: 246195 - DNA, 852 bp, Homo sapiens
  misc_feature: GYAE6OF02FWMXF.42.49.E05.1.454.CMB.1.raw
  modified_base (112)..(112): a, c, t, g, unknown or other
  misc_feature (112)..(112): n is a, c, g, or t
tcagtgacgtatgtcacgaccggtgctcgatttagagcgactagcaacacacaaaaggggacccaaaaaaccacacccctccttgggagaatcccctagatcacagcctccncacagtgggaccggacgtggacgacactttcctttttcgttgggtcggacgacgacgacgaccaaacggtagggtccgacccctaccctacccggtacggttaccctaccggttgggtcgacgtacgttcggtagggacgtcgtaggacgtcgtcgacgaaaggaaccggtccgggtccggggtccctaggtaggtgtaggttccggttcctccgtgacgtaggtcgttccttcggttacgtaacttacttttccctttacccctaaccgttaacggttagtagtttaaggtttggttacggaacgtaaccggaccccggggaccccggaaggggtacggggttcggttaggtacggggttaggtaggttacggggtagttaggtactacggacccgttaacccggtaaacggtaaaaacctaaacgagtaagtagagggtaagaaacgttacggtacggaggacgaggtacgtactacgacgtacgaccgacggaccgaacacgtacctaaccgaagtaaccgtacgacgtacctaacgacgtaacggtacgtaagggacggacctccgaagacgtacttcggaacgaccgaaccgggtacccaacctttactttaacgttacgacggtacgggaacgtaagtaactaagttttacgcggtaccttacgggttccggtccgttacgggtaccttaaccgttaaccggtccgtttacggttcggggtaccggtacccggg

SEQ ID NO: 246196 - DNA, 576 bp, Homo sapiens
  misc_feature: GYAE6OF02HBOVS.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacattcttttccaccttacggtatgaattggttgagacacgggcccccggagaggggcttggagtggagtgggatggatcgacgtcccgttaacggaactaaaacgagtagtagtggagagaagttccgagggcagagtcatcatcacgcgacacataccacgagtacacgacctacataggaacgtggaggacgcctacgagtatcgtagtaccgacgaccgcctactttacttacgtcgcgacgagagtatttaacgttcgacctacgttcggtccgtaggtaccgttacgtaacccgtacggtacgttcggtacggtacccgg

SEQ ID NO: 246197 - DNA, 751 bp, Homo sapiens
  misc_feature: GYAE6OF02GCM8B.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttagagacgtacggcccccggaggagggggtcttggagtgggtagtggggagtggatcgacggtcccgttaacggaaacctaaaaacaggaacgttaagtagggaaggtaacggtaacgtttaccgaaggggacaaggtaacggttaccaattccgaaacgttcccgaaccccgggacggggaaccctaaccgaactaccccgaacggtaacggtaacccgaacggacccttaacgaacgtacgggaaacgttgggaaagggtaccggaccctacgaaggtacgttccgtaacgggtaacccggaaccgtaacccgggtaccctaaacctttttaacgttaaccgtcggaccggtaaccggaaggttaacgtagtttttaaccgttggaccttaacggttccgggttaccgttgggtacccgttacggttaaacccgaccggttccgggttttacggcgggttaaccccgg

SEQ ID NO: 246198 - DNA, 735 bp, Homo sapiens
  misc_feature: GYAE6OF02JDBEJ.42.49.E05.1.454.CMB.1.raw
  modified_base (292)..(292): a, c, t, g, unknown or other
  misc_feature (292)..(292): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagaagcctggggcctcagtgagtggtctccgtgcgagtgcttcgtggttacattcctttccaccgttacgtatgtaagttggtgagacncggccccggaggtagggcttgaggtggagtgggatggatcgacgtaccgttacggaaaccgtaaaacgaggtagtaacgtagggaaggtaacgtaacggttaccggaagggacgaaggtacgttaaccgataccgtaagtacccgaacggtaccgggtacaacgtacgtacccgtaaacgggacgttaaccgaacggtacctaaacggtaacgttccgggaaacgttcgggaaacggtaccgtacctacgtaaggtacctacggtaccgaaccggtaccgtaaccggacccgttaacgtttacgttaccgtacggtaccgaccgttaaggtacgttacgttaacggtccggtaaccgttacgggtaccggtttacccggtcgggttacccgttaacgtaaccccggttagttaccccggtttaggggtaccggttaacccggg

SEQ ID NO: 246199 - DNA, 707 bp, Homo sapiens
  misc_feature: GYAE6OF02H9I8Z.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctccgtgcagtgcttcgtggttacattcttttccacctaccggttatgtaattgggttgacgtacacgggccccccgggaaggagggggtccttaggtacggtagggacgtggggtagtcgggatcgacgtacccgttaacggaaacgtaaaaaccgagaagtaacgttagggaagtaaggaacggtttaccgaagggacaggtaacgtacaagttcaagtccgaccggtacggaacaccaacttcccgaacggagtaaccgagaccctacaagtacggtaacgtacggaaggacgtacctacgagtaacgtcgtaggaccgacgaaaccgggccttaacttaaccgtttaacctaggtccgtacgtaagggacgttaacgttttaagttccggaacctacggtttccggtaccgtttaccggggactttaccggtaaacccgtacccggttcgtttacggggtacccgggtaacccgg

SEQ ID NO: 246200 - DNA, 508 bp, Homo sapiens
  misc_feature: GYAE6OF02GJI22.42.49.E05.1.454.CMB.1.raw
  modified_base (426)..(426): a, c, t, g, unknown or other
  misc_feature (426)..(426): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttaggaactaaaacagagtatggagagaagttccagggcagagtcatcatcacgcggacacatccacgagtacagcctacatggaactgaggagcctnagatctgacgacacggccacgttatactgcgcgagagattagtgacacgtggtcctggctgtaacccagcttggtggtaccg

SEQ ID NO: 246201 - DNA, 567 bp, Homo sapiens
  misc_feature: GYAE6OF02FK3CN.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatgtaattggttgagacacggcccccggaggacggggcttggagtggagtgggatggatcagccttacggaactaaacgagagtagtaggagagaagttcgagggcagagtcatcatcacgcggacacactccacgagtacagacctaacgagtacggaacttaggacggacgcctacgacgatcgtagaccgacgaccggacctaacgtttactacgtacgacgcgagagtacgttagttcgactacgtcggtaccgttggtacctacgtaacccgacggtcgtttcggtgggtaccg

SEQ ID NO: 246202 - DNA, 613 bp, Homo sapiens
  misc_feature: GYAE6OF02IEG3Q.42.49.E05.1.454.CMB.1.raw
  modified_base (220)..(220): a, c, t, g, unknown or other
  misc_feature (220)..(220): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtggggcctnagtgatggtctcgtgcaggtgcttcgtggttacattccttttccaccgtacgtatgtattggttgagacgcggccccggaggagggtcttggaggtgggagtgggagtggatcgacggtacccgttaacggaaactaaaacgaggtaagtagtaggagaagtaaggtaccgagggacgagagtacagtcatcgacgacgtacacactccacgagtacacgtactacgagaggtaacgtgacgacgtccagagactcgtacggacgaccgaccgaccttaactttacgtacctggccgtaaggacgtagtacgttacgttacggtacctacggtcggtaccgtaggtccgttaaccggtaacccgacggttacggtttcgggacgggtacccgg

SEQ ID NO: 246203 - DNA, 510 bp, Homo sapiens
  misc_feature: GYAE6OF02HOR11.42.49.E05.1.454.CMB.1.raw
  modified_base (416)..(416): a, c, t, g, unknown or other
  misc_feature (416)..(416): n is a, c, g, or t
  modified_base (441)..(441): a, c, t, g, unknown or other
  misc_feature (441)..(441): n is a, c, g, or t
  modified_base (464)..(464): a, c, t, g, unknown or other
  misc_feature (464)..(464): n is a, c, g, or t
  modified_base (498)..(498): a, c, t, g, unknown or other
  misc_feature (498)..(498): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttggagtggagtgggatggatcgagcccttaacggaactaaaacagagtatggagagaagttccgagggcagagtcatcatcaccgcggacacgatccacgagtacagacctanatggaactgagacgcctgagatcgngaccgacacggccacttattacngcgcgagagattagtgcacgtgtctgctcgaccncgcgttgtggcg

SEQ ID NO: 246204 - DNA, 673 bp, Homo sapiens
  misc_feature: GYAE6OF02ILQRD.42.49.E05.1.454.CMB.1.raw
  modified_base (218)..(218): a, c, t, g, unknown or other
  misc_feature (218)..(218): n is a, c, g, or t
  modified_base (434)..(434): a, c, t, g, unknown or other
  misc_feature (434)..(434): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctnagtgatggtctcctgcagtgcttcgtggttacattccttttaccaccgttacggtattggtaatttgggttgaacgacgacgggacccccgggaggtacggggtcgtttaggaggtggaaggttgggagtggtactcgacgtaccgttaacggaaactaaaacgaggtaagtaagtacggaagtagtaaggttaccgagggacgtaaggacgttanactacgtacgtaccgacggaccgaacgactaacgaccgaacgtacgtacgaacggtcctaacgagttacgggaaacttgggaacggacgtacccgtagaacgtacttcgacggaacggacccgacggtaccttaacgttaacgtttacgacgtccgagtaagacgtagtttacgtcgacgtacgttcggtacgtggtaccgttacgtaacccggtacgtaggttcggtaggtaaccggg

SEQ ID NO: 246205 - DNA, 623 bp, Homo sapiens
  misc_feature: GYAE6OF02I6E01.42.49.E05.1.454.CMB.1.raw
tcagtgacgtatgtcacgaccggtgctcgatttagagcgactagcaacacacaaaggggacccaaaaaccacacccctccttgggagaagtcccctagatcacagctcctcaccatggacgggacctggagcatccttttcttggtggcagcagcaacaggtgcccactcccaggttcacctggtgcagtctggagctgagctgcagaagcctgggggccttcgagtgatggtctccgtgcagtgcttctggttacatcttttccacctacggtatgaattggttgagacaggcccccggagaggggcttgagtggatgggatggatcgacgtcccgttacggaacttaaacgacgagtaagtcggaagagtaacgttcgagggacagagtcatcatcgaccgcggacacataccacgacgtacacgacctacatacggaacctaggacggtacgcccttacgagtaacttcgtacgtaaccgaccgaccgggtaccctaacgtttaagttaccgtacggtccgacggtaacgagttaacgtttacgttcgaccgttacgtacggttcccgttagggtaccgttacggtaaccctcggttaccgtttacggtcgggtacccgg

SEQ ID NO: 246206 - DNA, 627 bp, Homo sapiens
  misc_feature: GYAE6OF02H6PYV.42.49.E05.1.454.CMB.1.raw
  modified_base (417)..(417): a, c, t, g, unknown or other
  misc_feature (417)..(417): n is a, c, g, or t
  modified_base (618)..(618): a, c, t, g, unknown or other
  misc_feature (618)..(618): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtcgatggtctcgtgcagtgtcttctggttacattccttttccacctacggtatgaattggttgagacacgggcccccggaggacgggggtcttggaggtggagtggggatgggatcacggtcccgttaacgggaaactaaaacgaggtaacgtaatggggaagaagtaacggttccgaagggacgaagacgtnaatcatccgaccgacggacacgaactcccgaagacgtaacgacgtacctaacgacgtaggaaaccttgggaacgggacgccttacgaagtactacgtacggacgaaccgtcggacctactttatacgtcgcgacggagagtacttatacgacttaccgtcggtccttacggcgttacgtaaccgtccggtacgtttcgggngtaacccgg

SEQ ID NO: 246207 - DNA, 549 bp, Homo sapiens
  misc_feature: GYAE6OF02GNYHD.42.49.E05.1.454.CMB.1.raw
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagactaggcccccggagagggggcttggacgtggatgggatggatcgagccctaggaacctaaaacagagtatggagagaagttcagggtcaggatcatcatcaccgcggacacactcaacgagtacagcctacatcggaacttgaggagcctacgagntcngaacgaccgacggcctaacttattaacctggtaccgacgtagagaacttagttcggactacgtcggtcctaggctacggtaaccgacggtcttcggagggtaccg

SEQ ID NO: 246208 - DNA, 578 bp, Homo sapiens
  misc_feature: GYAE6OF02IPEZ4.42.49.E05.1.454.CMB.1.raw
  modified_base (416)..(416): a, c, t, g, unknown or other
  misc_feature (416)..(416): n is a, c, g, or t
tcagtgacgtatgtcacgaccggtgctcgatttagagcgactagcaacacacaaaggggacccaaaaaccacacccctccttgggagaatcccctagatcacagctcctcaccatggacggggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagtacaggccccggagaggggcttggagtggagtgggatggatcagtcccttacggaactaaaacgagagtatggagagaagttccgaggcgagagtacatcatcacgcggacacatccacgatacagcctanactaggaactggaggacgccgtacagatctagaaccgacgaaccggcctaacttaagtttacctacggtccgacggtaacggacgtactttaagttcggacctacgttcggtccgttgggaccttacggttaaacccgtcgtcgtttcggtagggtacccgg

SEQ ID NO: 246209 - DNA, 726 bp, Homo sapiens
  misc_feature: GYAE6OF02F37QV.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacgacgggcccccggaggacggggtcttggaggttgggagtggggattgggatcgacggtccccgttaacgggaaactaaaacgaggaaggtacgtagggaggaacggtaacggtttaccggaaggggaccgaaggaacggtacgtaagttaccgaacgtaccgaacccggtaccggaacctaaccgtaacgtacccgaacggtaaacgttaccgaaacgtaccctaaacctaacggtacggaaaccgttaggaacgggtacgacccgttacgacgtaccgtaccgtacggaacccggaccggaacccgggtacccttaacgtttaacttaaccgtcggtaccggacggaagtacgtaatttacggtttcgaacctacggttcggttccgttagggtaccgttagtaacccgtacgtaccggtttcgggtacggtacccggg

SEQ ID NO: 246210 - DNA, 518 bp, Homo sapiens
  misc_feature: GYAE6OF02GBTFH.42.49.E05.1.454.CMB.1.raw
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagagggggcttgagtggagtgggatggatcagcccttaggaactaaaacagagtatggagagaagttcagggacagagtcatcatcacgcggacacatccacgagtacagcctanatggaactgagacgcctanagatctgacgacacggcctacttatacngcgcaganatttacgtnactactggtcctggtactcgtaaaccgcgtcgtttggcggtacc

SEQ ID NO: 246211 - DNA, 520 bp, Homo sapiens
  misc_feature: GYAE6OF02FQP33.42.49.E05.1.454.CMB.1.raw
  modified_base (457)..(457): a, c, t, g, unknown or other
  misc_feature (457)..(457): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttcgaggcagagtcatcatcacgcggacacatccacgagtacagcctacatgaactgagagcctcagatcgtagacgacaccggcctacgttattacncgcgcgagagattatgactacgtcggtcctaggtctacgtaaccctacgtcttggtggtaccg

SEQ ID NO: 246212 - DNA, 550 bp, Homo sapiens
  misc_feature: GYAE6OF02G851N.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggttatgaattggttgagacaggcccccggagaggggcttgagtggatgggatggatcagcccttacggaactaaaacagagtataggagagaagttccgagggcaggagtcatacatcacgcggacacatccagagtacagcctacatggaactggaaggagcctacagatcagacgacaacggcctaacgtttattacgtcgacgacgagtacgtattagttgacctacgtcgggttacctggtacgttacgtaacccgacggtcttaggtcgggtaccgg

SEQ ID NO: 246213 - DNA, 693 bp, Homo sapiens
  misc_feature: GYAE6OF02HC65G.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggtgacgacaggcccccggagacggggtcttggagtggagtgggagtggactcgacgcccgttaacggaaactaaacgagaagtagtagggaagaggtaacgttccgaagggacgaagtacgtactacgtacacgtccgacccggtacggaaccaaccactacccgacggaagtacccgagacctaacgaagtacggaacgtggaacggacgtacctcgaagtacgtactcggaaccggtaccgaaccggtccttaacgtttaacgtttaccggtacgaccggtacggtaacggtagtacgtttaacggttgtacccgttaacgggttcccgggttaccgtttaccggggttacccgttaaccggttaaaccccggtccgggtttacggtttaccgggtacggggtaaccccggg

SEQ ID NO: 246214 - DNA, 593 bp, Homo sapiens
  misc_feature: GYAE6OF02IO72A.42.49.E05.1.454.CMB.1.raw
  modified_base (401)..(401): a, c, t, g, unknown or other
  misc_feature (401)..(401): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacacggcccccggagacgggggcttggagtgggatggggatggatcacgccttaacggaactaaaacagagtagtaggagagagttacgagggcagagtcatcatcgacgcgacacacncacgagtacagcctagatggaactgacggacgcctacgagtactcgtacgaacggaccaccgggacctaacgtttacttaaccgtggaccgtacgggtaagagtacgtttaacgttggtaccgtaacggttcggttacccgtacggtcgttacggtaacccaccgggttacgtttcgggtacgggtacccgg

SEQ ID NO: 246215 - DNA, 521 bp, Homo sapiens
  misc_feature: GYAE6OF02JBXHJ.42.49.E05.1.454.CMB.1.raw
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (429)..(429): a, c, t, g, unknown or other
  misc_feature (429)..(429): n is a, c, g, or t
  modified_base (460)..(460): a, c, t, g, unknown or other
  misc_feature (460)..(460): n is a, c, g, or t
  modified_base (505)..(505): a, c, t, g, unknown or other
  misc_feature (505)..(505): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagtacaggcccccggagaggggcgttgaggtggagtgggatggatcgagcccttacggaactaaaacagagtatggagagaagttaccgagggcagagtnatcatcacgcgganacatcacganacagctanatggaactgagagccncagatctagacgacgacgactacttatacgngcgcgagatattagtgactacgtgttccgtaggtctacgtaaccncgtcttcgtggtaccg

SEQ ID NO: 246216 - DNA, 785 bp, Homo sapiens
  misc_feature: GYAE6OF02I7NAU.42.49.E05.1.454.CMB.1.raw
  modified_base (195)..(195): a, c, t, g, unknown or other
  misc_feature (195)..(195): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctgganctgagctgcagaagccgtggggcctcgagtgatggtctccgtgctagtgtcttctcggttactattcctttaccctaaccgttacggttatagtaagtttggttagacgaccggaccgggacccccggtagggtacgggggtccgttaggagggtagggtaggtagggtagtagggtacgtccgtacggtacccgttaaacggaaacgtaaacaggtaagtagtagggaagtaacggtaacggttaccggagggacgtaacggtacgtacgtacgtaccgtaacgtacccggaacccgggaccggtaacccaaccgtaacccgttaaccccgaacggtaaccgtaacccgtaacgtacccgttaacgaacggtaaccggtaacggttacgggaaccggtaccggtacctacgaacggtaccgtacgtaccggaaccgtacccgaacccgggtaccttaacgttaaccgttaccgtaacggccgtaaccggaagttaccgtagtttaacggtacgtaccgtaccggttccgtaccggttagttacccggtaaccgtaaccgtacggtttcggttacggtacggtacccggg

SEQ ID NO: 246217 - DNA, 632 bp, Homo sapiens
  misc_feature: GYAE6OF02GFK0H.42.49.E05.1.454.CMB.1.raw
  modified_base (318)..(318): a, c, t, g, unknown or other
  misc_feature (318)..(318): n is a, c, g, or t
  modified_base (492)..(492): a, c, t, g, unknown or other
  misc_feature (492)..(492): n is a, c, g, or t
  modified_base (609)..(609): a, c, t, g, unknown or other
  misc_feature (609)..(609): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtctcctgcagtgcttcgtggttacagttcctttccacctacggtatgtaagttggttgagtacgacggccccggaggagggcttggngtggagtgggagtggatcgacgtaccgtaacggtaacaaaacgagagtagtggagtaaggtaacgttacgagggacaggacgtacatacactaccgaaccggcggaccaacgtactacccgaacggacgtaaccacgtacctaacgtacgtacgggaacttacggagggtaacncctacgacgtacttcgtaacggaccgaccgaaccgtcctaacgtttactacgtcggacgagaacgtagtagttacgtcgaccgtacggtcggtccgttaggtcttacggtaacccgngttcggttgggtccgggtaccgg

SEQ ID NO: 246218 - DNA, 563 bp, Homo sapiens
  misc_feature: GYAE6OF02GJUOA.42.49.E05.1.454.CMB.1.raw
  modified_base (421)..(421): a, c, t, g, unknown or other
  misc_feature (421)..(421): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacatcttttccacctacggtatgaattggttgagacaggcccccggagagggggcttggagtggagtgggagtggatcacgtcccgttaacggaactaaaacagagtataggagaagaagttcgaggacagagtcatcatcgacgcgacacactccacgagtacagcctanataggaactggacgacgctacgagactcagacgacgaccggacctacgttacttacgtcgccgacgaagtacgtaattacgttgacgtacgtcggttccgtacggacttacgttaaccgcggtacttgggtcggtacccggg

SEQ ID NO: 246219 - DNA, 556 bp, Homo sapiens
  misc_feature: GYAE6OF02F7KGP.42.49.E05.1.454.CMB.1.raw
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacaggcccccggagaggggcttggagtggatgggatggatcgagtcccttacggaactaaaacgagagtatggagagaagttcagggcagagtcatcatcacgacgacacactccacgacgtacacgcctacagtaggaactgagagcctacganacgtcncgaacgacgaccggacctactttacttacgtcgcgacgagtagtatttagtcgactacgtcggtacctggtacctacggtaaccgacggtcgtttacgggtcgggtaccgg

SEQ ID NO: 246220 - DNA, 587 bp, Homo sapiens
  misc_feature: GYAE6OF02FND0R.42.49.E05.1.454.CMB.1.raw
  modified_base (561)..(561): a, c, t, g, unknown or other
  misc_feature (561)..(561): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacgtacggcccccggaggagggggcttggagtggatggggatggatcacgtacccttacggaactaaaacagagtagtaggagtagaagttccgagggcagagtcatacatcgacgcggacacgactccaacgagtacagacctaacacgtcggaactggaggacgtcctacgagtactcgtacgaccgacgacggacctaactttataccgtgcgacgagacgtaattagttcgaccgtacgttcggttccctgggtaccttaccggttaaacccncggttacggtttcggtagggtacccg

SEQ ID NO: 246221 - DNA, 834 bp, Homo sapiens
  misc_feature: GYAE6OF02GUZ53.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctgagtgatggtctcctgcagtgcttcgtgttactattcctttccaccgtacgtatgtaattggtgagtacgacggccccggaggaggggtcttggagtggagtgggatggactcgacgtcccgttaacggaaactaaacgagtaagtagtaggagtaacgtaacgttaccgaagggactaacgggaagttacagttaccgaacgttcccgaaccggtaccggaaccgtaaccctaacgtaccccgaaacggaacgttaaacccgaccggtaaccccgtaacgttacggtaaccgggtaaccggttagggaaacgggtaccggtcccgtaacgtaaccggtaccttacgtaaccgggtaaaccggtaacccggtaacccgggaacccctttaaacgggttttaaacccgtttaaccgggttacccggtaaccggggttaaaccgggtaacggttaaccggttaacgtttttaacggtttaacccggggtaccgtttaaaccccgggttccgggtttacccgggtttacggttaacccgggttttaacccgggaaaaccccccggtttcccgggtttaccgggtttttaccggggtacccgggggtttaaccccgggg

SEQ ID NO: 246222 - DNA, 529 bp, Homo sapiens
  misc_feature: GYAE6OF02HX6Q4.42.49.E05.1.454.CMB.1.raw
  modified_base (383)..(383): a, c, t, g, unknown or other
  misc_feature (383)..(383): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacgaggccccggaggaggggtcttggaggtggagtgggatggatcacgccttaacggaactaaacagagtatggagagtagttcgaggtcaggagtacancagtcaccgacgacacactccgagatacaactacatgactgacgncctnagactcngacgacgaccgacacgttatactgcgacganagtattntagctacgtcggtccgtgtctagtaccgtacgtcgttcggtcgggctacggg

SEQ ID NO: 246223 - DNA, 643 bp, Homo sapiens
  misc_feature: GYAE6OF02JF3KM.42.49.E05.1.454.CMB.1.raw
  modified_base (186)..(186): a, c, t, g, unknown or other
  misc_feature (186)..(186): n is a, c, g, or t
  modified_base (245)..(245): a, c, t, g, unknown or other
  misc_feature (245)..(245): n is a, c, g, or t
tcagtgacgtatgtcacgaccggtgctcgatttagagcgactagcaacacacaaaggggacccaaaaaccacacccctccttgggagaatccccctagatcacagctcctcaccatggacgggacctggagcatccttttcttggtggcagcagcaacaggtgcccactcccaggttcacctggtncagtctggagctgagctgcagaagcctggggcctcagtgatggtctcctgcagtgcttntggttacattcttttccacctacggtatgtaattggttgagtacgaggcccccggaggaggggcttgacgtggacgtggggtatggatccgacgtacccgttaacggaacttaaaacgagacgtagtaggagagtaacgttaccgagggctagagtcgaatcgatcacgcggtaacacacgtaccgaacgtagaactacgtacctaactagtacggaacgtagggaggtacgaccctcgaagattccgacgaaccggaccgtacccggtaaccgtaacctttagttaccaggacccgtagaacgtacgttaatttacgttcggtacctacggttaccggttcgttacggtacgttaacccgttaaaccgtcccggtaggttccggtacgggtaaccgg

SEQ ID NO: 246224 - DNA, 563 bp, Homo sapiens
  misc_feature: GYAE6OF02H8E8Q.42.49.E05.1.454.CMB.1.raw
  modified_base (250)..(250): a, c, t, g, unknown or other
  misc_feature (250)..(250): n is a, c, g, or t
  modified_base (392)..(392): a, c, t, g, unknown or other
  misc_feature (392)..(392): n is a, c, g, or t
  modified_base (505)..(505): a, c, t, g, unknown or other
  misc_feature (505)..(505): n is a, c, g, or t
  modified_base (557)..(557): a, c, t, g, unknown or other
  misc_feature (557)..(557): n is a, c, g, or t
tcagtgacgtatgtcacgaccggtgctcgatttagagcgactagcaacacacaaaggggacccaaaaaccacacccctcttgggagaatccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttactnttccttttcaccgttacggtatgtaattggttgagtacacgggcccccggtaggaggggtcttggaggtgggagtgggatggatcgacgaccgttaacggtaactaaaacgagagtagtggagagaagttccgagggacagngtacatcactcgaccgcgacacactaccaacgagtacagaccctacagtaggaactggacggagacctagagactcgtagacgaccaccggacctactttattacgtgaccgngagatattaagtgactctcggtctaggtctacgtaacctacggtcgtttggnggtccg

SEQ ID NO: 246225 - DNA, 617 bp, Homo sapiens
  misc_feature: GYAE6OF02F52ZJ.42.49.E05.1.454.CMB.1.raw
  modified_base (476)..(476): a, c, t, g, unknown or other
  misc_feature (476)..(476): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacacggcccccggagacggggtcttggaggtggagtgggagtggatcgacgtacccgttaacggaacttaaaacgagacgtaagttagggagaggtaacgttccgaagggtcaaggaggtacagtcactaccgaccgcggacaacgactcccgaacgagtacgacgacctacagtagaacgttggacggtancccgtagagactcgtagaccggacgaccggtacctaacgtttattaaccgtcggcgaccgagacgttaattacgtgacctacgtcgggtaccgttcggacgttaccggtaacccgtacggtcggttcgggtcggtacccgg

SEQ ID NO: 246226 - DNA, 549 bp, Homo sapiens
  misc_feature: GYAE6OF02IRUUT.42.49.E05.1.454.CMB.1.raw
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacacggtcccccggagacgggggcttggaggtgggagtggggatggatcgacgtcccttacggaactaaaacgagagtagtaggagagaagttccgagggcagagtcatcatcacgcgacacanccacgagtacagcctanagtggaactgaggacgcctcagntcgngacgacgacgccaattacttacgtgacgcgagtagatttagtcgactacgtggttacctggtacctacgtaacccgacggtctttgggcggtaccgg

SEQ ID NO: 246227 - DNA, 618 bp, Homo sapiens
  misc_feature: GYAE6OF02GUJSZ.42.49.E05.1.454.CMB.1.raw
  modified_base (473)..(473): a, c, t, g, unknown or other
  misc_feature (473)..(473): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttactattccttttccaccgttacggtatagtaacgttggttagagacgacggcccccggaggacggggtcgttggaggtggagtgggagtggatcgacgtccgttacggaactaaacgagagtacgaggagagtagtacgaggcgagatcagtcgagtccgaccgacggaccacgactaccgacgacgtacgacgacctacgagtacggaacgtaggacggacnccgtagacgtactcgtacggacgaccgaccgtacctacttacttactcggaccgacgtagtacgtactttacgtacgtacctaccggttcggtaccgttaggtaccttacggtaacccgtacggtcggttaggtccggtaccggg

SEQ ID NO: 246228 - DNA, 547 bp, Homo sapiens
  misc_feature: GYAE6OF02JOLTS.42.49.E05.1.454.CMB.1.raw
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
  modified_base (414)..(415): a, c, t, g, unknown or other
  misc_feature (414)..(415): n is a, c, g, or t
  modified_base (436)..(436): a, c, t, g, unknown or other
  misc_feature (436)..(436): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (538)..(538): a, c, t, g, unknown or other
  misc_feature (538)..(538): n is a, c, g, or t
tcagtgacgtatgtcacgaccggtgctcgatttagagcgactagcaacacacaaaggggacccaaaaaccacacccctcccttgggagaatcccctagatcacagctcctcaccatggacgggacctggagcatcctttcttggtggcagcagcaacaggtgcccactcccaggttcaccctggtgcagtctggagctgagctgcagaagcctggggcctcagtgatggtctcctgcagtgcttctgttacattctttccactacggtntgagttgtnagacncggccccgagagggctgagtgagtggntggatcgacgccgttacggaactaaacgacgtagtagtcggagagaacttcgaagggcagacgtcatcgatcgaccgcggacacactacacgagtacacgctannacggactggaggacctcctanacagtacctggacacggcgacctatttagtaccngaccgngacgataatcgttagcttaacgcggttacgacggtcgttacgaaccgttaccggcgttaggngggtacccg

SEQ ID NO: 246229 - DNA, 584 bp, Homo sapiens
  misc_feature: GYAE6OF02G5EV4.42.49.E05.1.454.CMB.1.raw
  modified_base (521)..(521): a, c, t, g, unknown or other
  misc_feature (521)..(521): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccaccttaggtactgaacttggttgagtacgacggccccccggaggaagggggccttggacgtgggatcggggatgggatcgacgtcccgttacgggaaactaaaaaccgagaacggtatgggaagtaggaacgttccgaggcagagttcactcatcaccggtcggacacatccgagagtacagtcctaacagtaggaacttggaggacgcctcgagactcgtggaaccgacgacgccctaagttacttacgtcgcgacgagngtaacttagtgactacgtggtccgtggccgttacgtaacccacggtccttggtggtaacccgg

SEQ ID NO: 246230 - DNA, 729 bp, Homo sapiens
  misc_feature: GYAE6OF02JKYIG.42.49.E05.1.454.CMB.1.raw
  modified_base (231)..(231): a, c, t, g, unknown or other
  misc_feature (231)..(231): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtcnctgcagtgcttctggttacattctttccaccgtacgtatcgtaattggttgagtacgacgggcccccggaggacggggtcttacggacggtggtaaggtgggagtggacgtcgacggtacccgtttaacggaaactaaaacgaggtaagttagtacgggaggtaacggtaacgttaccgaagggtacgaggtacggtacgtaacgtactacgttaccgaaccgggtacggtaacgaaccgacgtaacccgaacggaacgttacgaacgtaacccgtaacgtaacgtacgggaaacgttagggaccggtaacggtcccgtacgaacgtacgtccgtacggtaccgaaccggtaaccggtaccctaacgtttaacgttaccgtacggtaccgaccgggtacgtagtaagttacggttaacgaccgttaacggttcgggttacccgttagggtacccttacggtaaacccgttaggtcccgttttagggaccggttaccgg

SEQ ID NO: 246231 - DNA, 674 bp, Homo sapiens
  misc_feature: GYAE6OF02HQNCM.42.49.E05.1.454.CMB.1.raw
  modified_base (308)..(308): a, c, t, g, unknown or other
  misc_feature (308)..(308): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctctgcagtgcttcgtggttacatctttccactacggtatcgaattggttagagacacggccccgaggacgggcttgngtggagtgggatggatcgacgtaccgtaacgaaactaaacgagtagtagtggagagtaacgttcgaggcagagtcagtacagtacgaccgacggacactacgtacccgaacgtacgtacgacgtacctaagacgtacggaacgtaggacggacgtaccctagaacgtacgtcgtaggaaccgtaaccgaccgggtaccttaacgttttaaccgttaacgtcggaccggtaacgtaacggtacgttaacttttaagttccggtaaccgttaaccggttcggggttacccgttcgggtttacccgttaaccgggttaaaccccgtaccgggtttacccggttttacgggtaccgggttaaccccgggg

SEQ ID NO: 246232 - DNA, 604 bp, Homo sapiens
  misc_feature: GYAE6OF02IST99.42.49.E05.1.454.CMB.1.raw
  modified_base (377)..(377): a, c, t, g, unknown or other
  misc_feature (377)..(377): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcagtgcttcgtggttacattcttttccacctacggtatgtaattggttgagtacacggcccccggagaggggtcgttaggaggtaggagtgggtagtggtagtcgacgtacccgttaacggaaactaaaagagtagtagnggaagagtacgtacgaggcgagagtcactcganccgacgcgaacncactaccgacgtacgtacgacgacctaacgacgtacggaacgtacggacggaccgtcctacgaacgcgttcgtacggaacgaccgacggacctacgtttaacgttacgcgacgcgagagtaagttcgtgacctagttccggtcgtacgtcgttacgtacccgaggtcgttggtcggtaccgg

SEQ ID NO: 246233 - DNA, 908 bp, Homo sapiens
  misc_feature: GYAE6OF02GL9R8.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacattctttccactacggtatgtaattggttgagacacgggcccccggaggacggggcttggagtggagtgggagtggatcgacgtcccgttaacggaactaaaaccgagtacgtagtggagaaggtaacgttaccgagggacaaggacgtacatacgataccgaacccgggaccggaaccaaccaacgttaccccgaaaccggaacgttaaccgaacgtaccccgtaaacgtaacgttacggggtaaaccgttacgggaaacgggtaacccggtacccgttaacggtaaacggtaaccgtttaccgtaacgggggaaaaccccgggtaaacccgtaaaccccggggtaccccgttaaacccgttttttaaaccggttttaaacccgttaccggggtaacccccgggttacccgggggttaaaaccgggttaaaccggggtttaaaccggttttttttaaccggggtttaacccgggttaaccccgtttaaaccccggggttttaaccggggggtttaaccccccggtttttaccgggggggttaaccccgtttttaaacccgggggtttttaaaaccccccccgggtaaaccccgggggtttttaccccggggtttttttacggggggtccccgggggggttttaaaaccccccggggg

SEQ ID NO: 246234 - DNA, 679 bp, Homo sapiens
  misc_feature: GYAE6OF02HOSLH.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgaattggttgagacacgggcccccggaggacgggggtcttggaggtcgggagtggggatgggatcgagtcccttacgggaaactaaaacgaggtagtagtggaagagtaaggttaccgagggcaaggacgtacgatacgataccgacccggtacggacaacgactccgaacgacgtacaggtaccctaacacgttagggaaccttagggaacggacgtacctaccgaagtaacgttccgtaacggaccggaccgtaccgggacccgtaacctttttaacgtaaccggttacgccggtaccgggtaagacgttaagttttacttacggaccgttaaccggttcggtcccgttacggttcgttaaccggttaacccgtccgggtacgttttcgggtccgggttaaccgg

SEQ ID NO: 246235 - DNA, 617 bp, Homo sapiens
  misc_feature: GYAE6OF02GFFV7.42.49.E05.1.454.CMB.1.raw
  modified_base (195)..(195): a, c, t, g, unknown or other
  misc_feature (195)..(195): n is a, c, g, or t
  modified_base (419)..(419): a, c, t, g, unknown or other
  misc_feature (419)..(419): n is a, c, g, or t
  modified_base (441)..(441): a, c, t, g, unknown or other
  misc_feature (441)..(441): n is a, c, g, or t
tcagtgacgtatgtcacgaccggtgctcgatttagagcgactagcaacacacaaagggacccaaaaaccacacccctccttgggagaatcccctagatcacagctcctcaccatggacgggacctggagcatccttttcttggtggcagcagcaacaggtgcccactcccaggttccacctggtgcagtctgganctgagctgcagaagcctggggcctcagtgatggtctcctgcagtgcttctggttacattctttccacctacggtatcgtaatttggtgagaccgtacggcccccggagaggggtcttggaggtcggagtgggataggatcgacgtacccgttacggaactaaaacgagaacgtatggaagtagaagttccgaggtacaggatcgatacactacgaccgcgacanactccacgagtacagaccctanacgtaggaactggaacggcgtacctcgaagtacgtccgtagaaccgaccgaccggacctaacgtttacttaccgtcggtaccgacgaagtacgttaattacgttacgccgtagtccggttacgtccgggtacttaccggtaaccctaccggtttacggttcgggtacggtacccgg

SEQ ID NO: 246236 - DNA, 620 bp, Homo sapiens
  misc_feature: GYAE6OF02H69Y3.42.49.E05.1.454.CMB.1.raw
  modified_base (404)..(404): a, c, t, g, unknown or other
  misc_feature (404)..(404): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagacgctggggcctcagtgagtggtctctgcagtgcttcgtggttactattcctttccaccgttacggtatgtaattggttagacgacgacgggccccggaggacggggtcgttggaggtgggagtgggatggatcgacgtacccgttaacggaaactaaaacgagtagtagtaggagagtaaggttacgagggacgagngtactagtacactcgaccgacggaacacgacaccgacgacgtacacgacctaacgagtacggaacgtaggacggacgtcctagacgactacgtacggaacggaccgtaccggaccttaacgtttactaccgtgaccggtacgtagtacgtacgttacgtgtacctcgtaccggttcctaggtcctaacggtaccgtacggtcgttcggcggtacgg

SEQ ID NO: 246237 - DNA, 641 bp, Homo sapiens
  misc_feature: GYAE6OF02J2192.42.49.E05.1.454.CMB.1.raw
  modified_base (530)..(530): a, c, t, g, unknown or other
  misc_feature (530)..(530): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgtcttctggttacattctttccaccttacgtatgaattggttgagacgtacggcccccggagacggggtccttgacgtggagttgggagtggatcgacgtacccgttaacggaaactaaacgacgtaagtagtggagagtaacgttaccgagggcagagtcagtacagtacaccgtacgacacacgtaccgaacgtacgtaccgacgtacctaactacgtaggaactggtaacggacgccttacgatactacgtacgaccgaccgacgggtaccctaacttacgttaaccgnggaccgaggtaagtacgtacgtttacggttcgaccggtaaccgttcgggtacccgtttggacccgttaacggtacccggtaacgttccggttaccgggtcggtaacccggg

SEQ ID NO: 246238 - DNA, 571 bp, Homo sapiens
  misc_feature: GYAE6OF02GA31H.42.49.E05.1.454.CMB.1.raw
  modified_base (252)..(252): a, c, t, g, unknown or other
  misc_feature (252)..(252): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacntctttccactacgtatgaattggtgagacgacggcccccggagaggggcttggagtggagtgggatgggatcgagtccttaacggaactaaacgagtagtataggagagaagttcgagggcagagtcatcatcgacgcggacacactccgaacgatacgacgcctagagtcggaacttaggacggagaccctcgagacttcgacgtacgacgaccggcctaacgttacttacgtggccgacgaggtacgtagttagttcgaactaccgttgggtacccgtggtacctcgtaaccgtacgtcggtttcggcgggtaccgg

SEQ ID NO: 246239 - DNA, 605 bp, Homo sapiens
  misc_feature: GYAE6OF02H91NQ.42.49.E05.1.454.CMB.1.raw
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
  modified_base (435)..(435): a, c, t, g, unknown or other
  misc_feature (435)..(435): n is a, c, g, or t
  modified_base (579)..(579): a, c, t, g, unknown or other
  misc_feature (579)..(579): n is a, c, g, or t
tcagtgacgtatgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagaagcctggggcctnagtgattggtctcctgcagtgcttctggttacnttcctttccactcgtatgtattgtgagacacggccccgaggaggggtcttaggacggtggagtggggatgggatcgtacggacccgttaacggaaactaaacgagagtagtagggagaagtacgtcgaagggacagagtacatcataccgacgcgacacacgtccacgagtacgagtacctanagtaggaacctaggtacggacgacctacgagtaacgtctaggaaccgaccgaccggtactactttaacgtacgtcgacgacgtagtagtacgtttagtcgaaccgttacgttacggttcccgtggtaccgttacggttaacccncggttacgttacgggtcgggtaccgg

SEQ ID NO: 246240 - DNA, 617 bp, Homo sapiens
  misc_feature: GYAE6OF02FSPDF.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttcgtggttactattcttttccacctacggtatcgtaattggttgagacgacggcccccgggagacggggcttggaggtggagtgggtagtggatcgacgtacccgttacggaaacgtaaaacgaggtaagttagtagggagaaggtacgttacgaggacgtaggacgctatacgatccgacgacggacaacactccgaagacgtaacacgcctaacacgtcgaagtcgaggtacgccgtacagtactctacggacgaaccgaccgactaactttagtacctcggacgtaccgagagttacgttagttcgacgtacggtcggttcccgtaggtaccgtacgttaacccgtaggtccgtttagggcggttaacccggg

SEQ ID NO: 246241 - DNA, 565 bp, Homo sapiens
  misc_feature: GYAE6OF02GXZ71.42.49.E05.1.454.CMB.1.raw
  modified_base (347)..(347): a, c, t, g, unknown or other
  misc_feature (347)..(347): n is a, c, g, or t
  modified_base (496)..(496): a, c, t, g, unknown or other
  misc_feature (496)..(496): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggggcatccttttcttggtggcagcagcaacaggtgcccactcccaggttcacctggtgcagtctggagctgagctgcagaagcctggggcctcagtgatggtctcctgcagtgcttctggttacatcttttcacctacggtatgaattggttgagacacggcccccggagaggggcttgacgtggagtgggatggatcgagcccttacggaactaaaacngagtatggagagaagttcgagggcagagtcatacatcgaccgcgacacactccgacgacgtaacagacctacagtcgaaacgttggaaggacgtcctacgaagactcgtagacgaccgacggcctaacgttatacgtgcgtacgagganagttatggcctacgtggttacccgtggtaccgtcgtaaaccgtcgtaccgttggtcgggtcgtaccggg

SEQ ID NO: 246242 - DNA, 613 bp, Homo sapiens
  misc_feature: GYAE6OF02F4HRV.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggagtgggatggatcgacgcccgttaacggaactaaaacgagagtatggagagtaagtccgagggcagagtcatcatcacgcgacacactaccacgagtacagacctacgagtcggaaccgtggacggacgccgtacgacgtactcgtacgaaccgacaccgggtaccctaacgtttaacttaccgtcggtacgaccgtaaggacgttaatttacgtttaggaccttacccggttacggttacccgtttgggaccgtttaccggttaaaccccgtacggtaccggtttcggtacggggtacccgg

SEQ ID NO: 246243 - DNA, 830 bp, Homo sapiens
  misc_feature: GYAE6OF02HEAMN.42.49.E05.1.454.CMB.1.raw
  modified_base (206)..(206): a, c, t, g, unknown or other
  misc_feature (206)..(206): n is a, c, g, or t
tcagtgacgtatgtcacgaccggtgctcgatttagagcgactagcaacgtacgacaaaggggacccaaaaaccacacccctccttgggagaatcccctagatcacgacgctcctcaccatgggacggacctggagcattccgttttcttggtggcagcagcaacaggtgcccactcccaggttccaccttggtcgcagtcctgganctgacgtcgtgcagacgccgtgggcctcagtgacgtggtacctcgtagctaggtcgtcctttacgttaggttactacttccttttaccgtaaccgttacggtacgttaggtaacggtttcggttacgaggtaccgtacgggtacccccggtaaggtcgggtcgttggtacggtacggtacggttagggtagtacgggacgtacggtaaccgtacccgttaaacggtaaaccgttaaaacggacgtaggtagttaagggacggtaagtaacgggttacgaacgggtacgtaacgtacgtaacgtacgttacgactaccgacccggtaacgtaaccgtaacgtaccgtaccgtaaacggtaacggttaaaccgtaccgttaacctaaccggtaagttaacgggtaacgttacggtaacggaccgtaccttaacgtagtaccgtttacggtaacgaacccggtacggaacccggtaacttaaccgttttaaacgtaccgtacggtaccgtacgtaaggtacttaacggtttaccgttaacgaccggtttacgttcgggtttacccgaccgggtttaccctacgggttaaaccccttcgttacgggtttcgggtaccggttaacccgg

SEQ ID NO: 246244 - DNA, 649 bp, Homo sapiens
  misc_feature: GYAE6OF02GIJ3J.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggaggaggggcttggagtggagtgggatggatcaggtacccttacggaactaaaacgagagtaagtggagagaagttccgagggcagagtcatcatcacgcggacacgactccgacgtagtacacgacctaacagtacggaaccgttaggaacgggacgaccctacgacggtactcgttaggaaccggtaaccgaccgggacccttaactttaacgtttaaccgtcggaccggtacggaacggtacggttaactttacggtttcggacccgttaacggttaccgggttacccgttcggggtacctttacgggttaaacccgtaaccggtccggttttagggtaccggggtacccgg

SEQ ID NO: 246245 - DNA, 610 bp, Homo sapiens
  misc_feature: GYAE6OF02GIZZF.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccaccgtacgtatgtaattggttgagtacgacggccccggaggaggggtcttggaggtggagtgggatggatcgacgtacccgttaacggtaactaaaacgagtagtagtagggaagaagtaacggttcgagggcaggagtacatcactccgaccgacgacacactaccgaacgagtaccacgacctacgacgtaggaacgtaggacggacgtcctacacgtactacgtacgaaccggaccgacggtacctaacgtttacttaccgtacggcgacggagtagttagtttagtcgtactacgttggtccctaggtacctacggtacccgtacgtcggttcggtcggtacccgg

SEQ ID NO: 246246 - DNA, 706 bp, Homo sapiens
  misc_feature: GYAE6OF02IAKUN.42.49.E05.1.454.CMB.1.raw
  modified_base (607)..(607): a, c, t, g, unknown or other
  misc_feature (607)..(607): n is a, c, g, or t
  modified_base (680)..(680): a, c, t, g, unknown or other
  misc_feature (680)..(680): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagacgccgtgggcctcagtgagtcggtctcctggcagtcgcttcgtggttaactgttccttttaccaccgttacggtattaggtaagtttcgggttagagtaaccggaccggggtacccccgggtaagggacgggggtactttggaacgggtcgggaagttcggggtatgggtacgtcgtaacgtacccgttaacggaaaacctaaaacgtaggaagttaagtacgggtagtaacggtaacgtcgagggaactacggagtacactacgtacgtaccgaccgtacggtaacactaacgtaccacgggaactaaccgagtacctaacgagtaacggtaacgtacggaggaccgtaccacgtaagtctacgtacggaccgacgacccggtactaacgttacttacgnggtccggaagtacgtacgtattacgttgacctacgggttacggtaccggtaggtacccgttacggtaacccgngtttaccggtaggtacggtaaccggg

SEQ ID NO: 246247 - DNA, 697 bp, Homo sapiens
  misc_feature: GYAE6OF02IZ5KM.42.49.E05.1.454.CMB.1.raw
  modified_base (203)..(203): a, c, t, g, unknown or other
  misc_feature (203)..(203): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagtgacgtatgtcacgaccggtgctcgatttagagcgactagcaacacacaaaggggacccaaaaaccacacccctccttgggagaatcccctagatcacagctcctcaccatggacggacctggagcatcctttcttggtggcagcagcaacaggtgcccactcccaggttcacctggtgcagtctggagctgagctgcngaagcctggggcctcagtgatggtctcctgcagtgtcttctggttactattcttttccaccgtacggtatgtaattcggttgagtacgacggcccccggaggacgggggtcttggaggttacggagttcggggatggagtcgacgtacccgttaacggaaacgtaaactaggtagtagtacgggagtaacgtaagttcgaagggcaaggagtnaacncgtatccgacgcggaacacgtactaccgaagtacgtacacgtacccttacgaacgtacgaacgtaggaaccggtacgacccttacgacgtacgtacgtacgtaacggacccgtaaccggtacccttaacgtttacttaaccggtcgaacccggacggtaacgtacgggttaactttacggttcggtaccgtaccggttaccggtcccgggtttagtaccggtttaacccggtaaacccgtaacccggtttcggttacggggtacggtaaccccgggg

SEQ ID NO: 246248 - DNA, 626 bp, Homo sapiens
  misc_feature: GYAE6OF02GD131.42.49.E05.1.454.CMB.1.raw
  modified_base (429)..(429): a, c, t, g, unknown or other
  misc_feature (429)..(429): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacattcttttccaccttacggtatcgtaattggttgagacacggcccccggaggagggtcgttggagtggagtgggatggatcgagtccgttaacggaactaaacagagtatggagagacgttacgaggacagagtcatcatcgaccgcggacacactccgacgacgtacacgacctanatcggaacgttgacggacgcctacgaagagtccgtaggaaccgtaccgaaccgggtaccctaacgtttaacgttaaaccttcggaccgacggaagtacgtaagtttacgttcggaccttcggttaccgggttaccttacgggttccttaacggttaaccccgacggtttaccgtttacgggtacgggttaccccggg

SEQ ID NO: 246249 - DNA, 601 bp, Homo sapiens
  misc_feature: GYAE6OF02GIDPA.42.49.E05.1.454.CMB.1.raw
  modified_base (314)..(314): a, c, t, g, unknown or other
  misc_feature (314)..(314): n is a, c, g, or t
  modified_base (389)..(389): a, c, t, g, unknown or other
  misc_feature (389)..(389): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccaccttacggtatgtaattggttgagacacggcccccggagagggggtcttggnggtggagtgggatggatcagccccgttaacggaactaaaacagagtagtggaagagaagttaccgaggcagagtnatcatcacgcgacacactaccgacgacgtacacgacctaacatagggaactggaaggacgccctacgagtactcgtagacccgtaacgaccggacccttactttaacgttacgtacggccgacggaagtagtagtttacgttcgacctaacggttccggtaccgttgggtaccttacggtaacccgtacggtccgttagggtcgggtacccg

SEQ ID NO: 246250 - DNA, 647 bp, Homo sapiens
  misc_feature: GYAE6OF02H3Y58.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctgagtgattggtctcctgcagtgtcttctggttactattccttttccaacctacggtatcgtaattggttagagacgacggcccccggagacgggggtcttaggaggtggagtgggatggtatcgtacgtacccgttaggaaacctaaacgaggtagtagtaggagaaggtaagttccgagggacgagagtcagtcatccacggcgacacactccgaagactacgagacctacgagtacgtaactgggaacgacgacctacgagtactacgtcggaccgtaccgacccgtaccgtaaacctttagttaacccgtggtaccgacggtaacgtaaggtctttacggtacggtacctacgggttcggtttcccgtacgggttacgttaccggttaaccccgtacgggtccgttttacgggccgggtaccgg

SEQ ID NO: 246251 - DNA, 639 bp, Homo sapiens
  misc_feature: GYAE6OF02I384F.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttcgtggttacattcttttccgaccttacggtactgtaagttggttgagacacgggtacccccggaggtagggggcttggacggttgggacgttaggggatggagtcacggtacccgttacggaaactaaaaccgagtacgtagtaggagtagtaacgttacgagggcgagagtacatacacgtcgaaccgcggaaccaccgactccgaacgacggtaccagtaccgtaacagacggaacgttgacggtacgccgtactagtacgtcgagaccgacgaccggtacctaactttacgttacgtcggaccgcgtaaggtatacgtttagtcgtactacgttcggtaccgtacggttacgttaccggttaaaccctggttacgttacggtccgggtaaccgg

SEQ ID NO: 246252 - DNA, 638 bp, Homo sapiens
  misc_feature: GYAE6OF02GLJPL.42.49.E05.1.454.CMB.1.raw
  modified_base (397)..(397): a, c, t, g, unknown or other
  misc_feature (397)..(397): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacctacggtatgtaattggttgagacgacgggcccccggaaggacgggggtcttggagtgggagtggggatgggatcgacggtcccgttaacggaactaaaacgagagtagtaggagaaggtaagttccgaagggtnaggagtcatcatccgaccgcgaccacactaccaacgacgtacacgcctacagtacgaacgtggacggtacgcctagacgtactcgtacgaaccggacgacccggtacctaacgtttacttaaccgtcggaccgtaccggtaagacgttaactttacggttacgtaccgtaaccggttcggttcccgttggtacccgttacggttaaaccccgacggttacgtttcgggtagggtacccggg

SEQ ID NO: 246253 - DNA, 622 bp, Homo sapiens
  misc_feature: GYAE6OF02HL2L2.42.49.E05.1.454.CMB.1.raw
  modified_base (448)..(448): a, c, t, g, unknown or other
  misc_feature (448)..(448): n is a, c, g, or t
  modified_base (462)..(462): a, c, t, g, unknown or other
  misc_feature (462)..(462): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctctgcagtgcttctggttacattcttttccaccttacggtatgtaattggttgagacaggcccccggagaggggcttggaggtggaagtgggatggatcgagcccttaacggaactaaaacagagtaagtggagagaagttcagtcagagtcatcatcaccgacggacacactccaacgacgtacacgacctacaagttaggaaccgtggaacgggacnccgtacagaccttntacggaccgtaacgaccgggtaccctaactttaacgttacgtacggtaccgacgtacggacgttaagtttaacgttcggtacctaacgttcgggttacccgtagggtcccttaacggtaaccccgtacgtttaccggtttcgggtacgggttaaccccgg

SEQ ID NO: 246254 - DNA, 692 bp, Homo sapiens
  misc_feature: GYAE6OF02HAG40.42.49.E05.1.454.CMB.1.raw
tcagtgacgtatgtcacgaccggtgctcgatttagagcgactagcaacacgacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacattcttttccacctacggtatcgtattggtgagacgacggccccggaggaggggcttgacgtggagtgggatggatcgagtccgttaacggaactaaacgagtagtagtaggaagtaggtaacgttccgagggcaggagtacagtcagtcgaccgacggacacgtactaccgacgactacgacgaccgtaacgacgtaccggtaaacgttcggaacggtaccgaccgttaccgaacgtaccgttaccgtacggaaccgaccgtaccggtaccctaacggttttaaccgttaaccgttcggaccgggtaacgtacgggtaacgttaacgttttacggttacgtaccgttaccggttacggggttaccccgtttagggacccgttttaccggtaaaccccgttacggtttacccgggtttagggttaccggggttaacccggg

SEQ ID NO: 246255 - DNA, 613 bp, Homo sapiens
  misc_feature: GYAE6OF02FO5A7.42.49.E05.1.454.CMB.1.raw
  modified_base (355)..(355): a, c, t, g, unknown or other
  misc_feature (355)..(355): n is a, c, g, or t
  modified_base (363)..(363): a, c, t, g, unknown or other
  misc_feature (363)..(363): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgcctggggcctcagtgatggtctcctgcagtgcttctggttacatctttccactacggtatgaattggttagagacacgggcccccggagagggggtcctttggagtgggatggggatggatcaggtcccttacggaactaaaacngaagtagnggagagaagttccgagggcagagtcatcatcgacgacggacacataccaacgtagtaacacgaccttaacagtcggaacttggagtagtcctacgaagtctcgtagacgacgaccggtacctacgtttaacgttcgtacggacgagtacgggtagtaacgtttacgttcggaccgtaacgttcgggttacccgtagggttaccgttacggttaaaccccgtacggtccgttttacgggcggggtaacccg

SEQ ID NO: 246256 - DNA, 789 bp, Homo sapiens
  misc_feature: GYAE6OF02HGUKO.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatgggacgggacctggagcatccttttcttggtggcagcagcaacaggtgcccactcccaggttcaccgtggtgcagtctggagctgagctgcagaagccgtgggcctcagtgatggtctcgtgcagtcgtcttcgtggttactattcttttaccacctacggtagtagtatttgggttgaacgtaacgtaccgggcccccgggaggtacgggggtcctttaggaggttgggaggtacgggaggttacgggtagtacggtaacggtaccccgttaaaccgggtaaaaacctaaaaaccgtaaggtaaggtaagttaggggtaaaggtaacggtaaacggtttaccggaaggggtacctaaaggtacgtacgtaaacgtacgtaacgtaccgaaccccgggacgggtaaaccaacgtaacgtaaccccgaacggtaaacgtaccggtaaacgcccgttaaaccaacgggttaacggtaaaccggttaaggaggggtaaccgttccctaacggtagaaccttcgtaaccgggaaccgtaacccgacggggtacccttaacggtttaacttaccgcggtaaccgggtaccgaacggtacgttaattacggttctaccggttacgtccggttacggtcgtaccgtacgttaacccgacgtttacgtggtaccggtacggg

SEQ ID NO: 246257 - DNA, 806 bp, Homo sapiens
  misc_feature: GYAE6OF02JWRFJ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtcggggcctcgagtgtagtggtctccgtgctagtgtcttcgttggttacacgttccttttccgaccgttacggtagtcgtaagttgggttacgagacgtacccgggccccggaagggtacggggtcttagggtacggtgggaggttgggacgttcgggtacttccgaacgttacccggttaacggtaaaaccgtaaaacgtaggtaaggttaacggtgggtaaacggtaacgttaacggtttacgggacgggtacgaagggtacttacgtagtaccgtacgttaccgacccgggtaccggtaacaccgttacgtacccggtaaacggtacgttaaccggaacgtcccgtaaacgtaccggttaacgggaacgttacgggaaccgggtaccgtaacccgtacgtaaggttacccgtacggtaacccgggtaaccgtaaccccggaccgttaaacccttaacccggttttaactaccggttacggaccggacggtaccgttaagtaccgttttaggtaaccgccgttaaccggtcggttaccgtacggttacctacggtaaacccgttggtaccgttgggtaccgggtaacccgg

SEQ ID NO: 246258 - DNA, 649 bp, Homo sapiens
  misc_feature: GYAE6OF02F7OP4.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctgttactattcttttccactacggtatgtaattggttagagtacacggccccggaggaggggcttgagtggagtgggagtggatcgacgtcccgttaacggaaactaaaacagagtagaggagaagtacggttacgagggcaagagtcatacacgtacgacgcggacacactaccaacgacgtacacgaccttacgacgtacggaacttggaacggacgcccgtacgaacgtacgttacgacggaaccgtacccgaaccgggtacccttaacgttttaaccgttaccggtacggaccgaacggtaagaagttattttaacggttcggtaaccttacggttccggttccgtttacggacccttacggtaaacccgtaccggtttcgtttacgggtacgggtacccgg

SEQ ID NO: 246259 - DNA, 660 bp, Homo sapiens
  misc_feature: GYAE6OF02GZ8FB.42.49.E05.1.454.CMB.1.raw
tcagtgacgtatgtcacgaccggtgctcgatttagagcgactagcaacacacaaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactattctttccacctacggtatgtaattggttgagacgacggcccccggaggaggggtcttggagtggagtgggatgggatcgacgtcccgttaacggaaacgtaaaacgagaggtatagggaagaaggtaagttaccgagggacaggagtacatcataccgaccgacggacacgactaccaacggtacgtaccacgtaccctacacgtacgggaactggaacggacgccgtacgagtacgttccgacggaccgtaaccgaccggtaccctaacgtttaacgttaccgtacggaccgaacgggtaggtaacgttacgtttaacgttacgtaccgtaccggttcgggttacccgttcgggtaccttacggttaaaccccgtacggttccgtttagggtacgggtacccgg

SEQ ID NO: 246260 - DNA, 608 bp, Homo sapiens
  misc_feature: GYAE6OF02H9OMC.42.49.E05.1.454.CMB.1.raw
  modified_base (489)..(489): a, c, t, g, unknown or other
  misc_feature (489)..(489): n is a, c, g, or t
tcagtgacgtatgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagacgcgtgggcctcagtgatggtctcctagcagtgcttcgtggttacattctttcctacctaggtatgtattggtgagacgacggaccccggagacggggtcttaggtaggtcggaagttgggagtgggatacgacgtacccgttaacggaaactaaaacagtaagtacgtaggaggaaggacgttacgaggacgtaggagtcaagtcacgtaccgaccgcgggacacgtacacccgtaaggacgtaacgacgacctaacacgtacggaacgtgaggacgcctanagtatcgtagacgacgacgtaccacgtttaacgttaccgaggccgtagagtacgtattagtgactcgtcggtacccgtggtacctacggtaacccgtacggtcgttgggtacggtaccg

SEQ ID NO: 246261 - DNA, 597 bp, Homo sapiens
  misc_feature: GYAE6OF02J0991.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttcgtggttacacttctttccacttacggtatgtaagttggttgagtacgtacggaccccggaggacggggcttaggacggtggagtgggtatagggactcgacggtcccgttaacggaaactaaacgagagtagtggagagtaagtccgaggacagagtactagtctactacgaccgcggacacactacgacgacgtacgacgctacgagtacggacgtggacggacgcctagacgtactcacggaccgacgtaccggtactacgtttacgtacgtacggcgtacgacgtagtattacgtcgcgtacgtacggtccgtaagtctacggtaccgtacgtcgttagggtcgtaccgg

SEQ ID NO: 246262 - DNA, 617 bp, Homo sapiens
  misc_feature: GYAE6OF02FT8AW.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacattcttttccaccttacggtatgattggttgagacacggcccccggaggtacggggcttggacggtggagtgggagtggatcgacgtacccgttacggaaactaaacgagacgtagtggagagaagttcgaggcgagagtcatcatccgacgcggacacgactaccgacgtaacgtacgacgtaccctaacgagtacggaacgtacggagggacgccgtacgaagtacgtcgtacgaaccgacgacccgggtacctaccgtttaacgttacgtacggacgaccggagacggtacttacgttcgtaccgtaccgttcggttaccgtggtaccttcggtaaccgtacgtcgttagggtcggtaccgg

SEQ ID NO: 246263 - DNA, 539 bp, Homo sapiens
  misc_feature: GYAE6OF02FTIOI.42.49.E05.1.454.CMB.1.raw
  modified_base (403)..(403): a, c, t, g, unknown or other
  misc_feature (403)..(403): n is a, c, g, or t
  modified_base (532)..(532): a, c, t, g, unknown or other
  misc_feature (532)..(532): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacttacggtatgtaattggttgagacacggcccccggagacggggcttggagtggagtggggagtggatcgagtcccgttacggaactaaaacgagagtagtggagagaagttcgaggcagatcatcatcgacgcgacacacnccacgagtacacgctacactggaactgagacgcctcgagactcgtgaacgacgacgcctacttacgttactcgaccgagtagagtattagtgtacacgtcgtcgtgacttcgtaaccctagtcgttggnggtaccg

SEQ ID NO: 246264 - DNA, 670 bp, Homo sapiens
  misc_feature: GYAE6OF02GQM18.42.49.E05.1.454.CMB.1.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
  modified_base (595)..(595): a, c, t, g, unknown or other
  misc_feature (595)..(595): n is a, c, g, or t
  modified_base (650)..(650): a, c, t, g, unknown or other
  misc_feature (650)..(650): n is a, c, g, or t
tcagtgacgtatgtcacgaccggtgctcgatttagagcgactagcaacgacacgaaaggggacccaaaaaccacacccctccttgggagaatcccctagatcacagctcctcaccatggacgggacctggagcatcctttcttggtggctagcagcaactaggtgcccactccctaggttcacctggtgcagtctggagctgagctgcgagaagccgtgggcctcgagtgatcggtctccgtgctagtgcttcgtggttaacnttccgttttcccaaccttacggtaatgtaagttggttanaggacacgggtcccccggaaggtacggggcttggtacggtgggacgttaggggagttggtaccgtacgacggtacccctttaaacgggtaaactaaaacgaggtagtagtggggaacgtaaggtaacgttccggaaggtaccgagtaacgttcaacttccgacgtaccgaaccgcggaacctaccgatacccgaaggtaccgaacacgtacctaacgacgtacggtaaacgtcggacggtacgtccaacgtacgactcgtaacgaaccgacgaccggtacctacgttatacgnacgacgatacgtattacgtcggacgtacgtcggtcgtacggactaccggttaccncggttcgttcggacgtacgg

SEQ ID NO: 246265 - DNA, 721 bp, Homo sapiens
  misc_feature: GYAE6OF02F5XQY.42.49.E05.1.454.CMB.1.raw
  modified_base (201)..(201): a, c, t, g, unknown or other
  misc_feature (201)..(201): n is a, c, g, or t
tcagtgacgtatgtcacgaccggtgctcgatttagagcgactagcaacacacaaaggggacccaaaaaccactacccctccttgggagaactccccgtacgagtccacagctcctcaccatggacgggacctggagcatccttttcttggtggcagcagcaacaggtgcccactcccaggttcacctggtgcagtctgganctgagctgcagaacgcctgggggcctcgagttgagtggtcctccgttggctagtcgtcttctgggttacagttccttttcccaccgtacggtatacgtaagtttgggttgaagaccgtacgggacccccggtaggacgggggtccttaggaggttaggaggtagggtatgggtatcgacggtcccgttaacggtaaactaaaacgagtaagtacgtagggacgaggtaacgttaccgagggcagagtacattcgatccgtaccgacggtaccaacgtactacccgaagtacgtacgacgtacccgtaagacgtaacggtaacgttacggaagggtaccgccgtaacgtaacggtaacctacgttaccgaaaccgttacccgaacgggttacccctagttttaacgtaccgtggtccgaaccggtagtaacgttaattacgttacggaaccgtaccggttaccggttcccgtaggaccgttacccgtaaacccgcggtaccgtttagggaccgggtaccgg

SEQ ID NO: 246266 - DNA, 642 bp, Homo sapiens
  misc_feature: GYAE6OF02JPFTZ.42.49.E05.1.454.CMB.1.raw
  modified_base (472)..(472): a, c, t, g, unknown or other
  misc_feature (472)..(472): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtgcttcgtggttacattccttttccaccttacggtatgtaacgtttggttagacgacgtacgggcccccggaggtaggggcttggaggtcggagttgggatggatcgacggtccgttacggaactaaaacgagacgtagtggaagagtagttccgaggacgagagtcatcgatcgaccgcgacacactaccaacgtacgtacacgtacctacgacgtaggaacgtgaaggaccncgtacgaagtactcgtaaggaccgaacgaccgaccttaacttacgtttaccgcggacgaccggtaagacgttacgtttaacgtacggtacctaccggttcggttacccgttaggtaccccgtttaacggttaacccgaccgggtttcgtttacgggtccgggtaaccggg

SEQ ID NO: 246267 - DNA, 694 bp, Homo sapiens
  misc_feature: GYAE6OF02I3W8P.42.49.E05.1.454.CMB.1.raw
  modified_base (195)..(195): a, c, t, g, unknown or other
  misc_feature (195)..(195): n is a, c, g, or t
tcagtgacgtatgtcacgaccggtgctcgatttagagcgactagcaacacacaaaggggaccaaaaaaccacacccctccttgggagaatcccctagatcacagctcctcaccatggacgggacctggagcatccttttcttggtggcagcagcaacaggtgcccactcccaggttcacctggtgcagtctgganctgagctgcagagcctgggcctcagtgatggtctcctgctgtcgcttcgtggttactattccttttccaccgtacggttatcgtaagtttggttgaagaccgacgggcccccggtaaggcgggggtacttggacgggtggtaggtgggagtgggagtcgacggtcccgttaacggaaactaaaacgaggtaacgtagagggaagaaggtaacgttaccggagggtccgaaggagtacaagtccgtaacgtccgaaccgggtccggaaccgaccttaacgaccgaacggacgtacctaaccggtacctaactaacggttacggaaacgttacggacggttaccgaccgttacgaacgtaagtccggtagaaccgtaccccgggacgtaacccgtaactttaacgtacgtacggaccgtacgtacgtagtagttttacgtcgtactaacggttcgtccgttaggaccttacggtaacccgtggtccgttaggcggtaccgg

SEQ ID NO: 246268 - DNA, 709 bp, Homo sapiens
  misc_feature: GYAE6OF02HGVN0.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttcgtgttacatcgttttccaccttacgtatgaattggttgagacacggccccggagaggggtctggagtggactggggatgggatcgacgtacccgttaacgggaaactaaaacgagaggttaacgtgggagtaaggtaagttaccgagggcacggtagtcgaatcactcaccggtacggacaacgtactaacccgaaggacgtaaaccgacgacccgtaactaacggtacgtaaaccggttcggtaacgggaaccgtacccgtacgtaacggtaaccgttacgtaacggtaaccggtaacccggaccggtacccgttaacctttaaccgtttacggtaccggtaacgtacccggtaagtacgttaagtttacgttacggtaaccgtaccggtttacgggtaaccgttcggtaccggttaaccggttaaacccgaccggtttaccgtttggggtaccggttacccggg

SEQ ID NO: 246269 - DNA, 641 bp, Homo sapiens
  misc_feature: GYAE6OF02HGQAH.42.49.E05.1.454.CMB.1.raw
  modified_base (252)..(252): a, c, t, g, unknown or other
  misc_feature (252)..(252): n is a, c, g, or t
  modified_base (391)..(391): a, c, t, g, unknown or other
  misc_feature (391)..(391): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtgcttctggttacnttcctttccacctacggtatagattggttagagacacgggcccccggaggacggggtcttggagtggagtgggatggatcgacgtcccgttaacggaaactaaacgagagtagtgagagtaacgttcgaggcagagtanatacactaccgaccgccggaacacacgtaccgaacgaacggtacacgtacctaacgacgtacggaacgttaggacggacgccgtacgacggtactacgtacgaaccgaccgacggtaccctaacgtttaacgttacccgtacgccggtacgaacggtagttacgtttaacgtcggtacctacggttcggttacccgtgggtccgttaacgtaacccggttacgtaccggtttcggtaccgggtaaccggg

SEQ ID NO: 246270 - DNA, 644 bp, Homo sapiens
  misc_feature: GYAE6OF02HA9L7.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttcgtggttacattcttttccacctacggtatgaagttggttgagacgacgggcccccggaggacggggtcttggaggtggaagtggggatgggagtcgacgtacccgttaacggaaacctaaaacgagagtagtaggagaagtaagttccgagggcaagagtacgatacgatcaccgtacggacacactacccgaacgtgtaccagacctacaacgtcggaacgttaggaacgggaccgtacctacgaagtacttccgtacgggaacccgacgaaccggacccttaacgttttaaccttaacggtccggaccgtacggagtaagttattttaagtcgtaccgttacggtccggtccgttacgggctttacggtaacctacggtcgtttcgggaggtaccgg

SEQ ID NO: 246271 - DNA, 524 bp, Homo sapiens
  misc_feature: GYAE6OF02JA2WS.42.49.E05.1.454.CMB.1.raw
  modified_base (423)..(423): a, c, t, g, unknown or other
  misc_feature (423)..(423): n is a, c, g, or t
  modified_base (459)..(459): a, c, t, g, unknown or other
  misc_feature (459)..(459): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggtacatcttttccactacggtatgaattggttgagacaggcccccggagaggggcttggagtggagtgggatggatcagcccttacggaactaaacagagtatggagagaagttcaggcagagtcatcatcacgcggacacatccacgagtacagccacatcggaactgagagcctnagatcgtgacgacaccggtaccaacgttattaccgngacgacgagagtattagtgtaccacgttggtcctaggtctacgtaaccacgtcttggcggtaccg

SEQ ID NO: 246272 - DNA, 694 bp, Homo sapiens
  misc_feature: GYAE6OF02J0F5Z.42.49.E05.1.454.CMB.1.raw
  modified_base (219)..(219): a, c, t, g, unknown or other
  misc_feature (219)..(219): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagccgtgggcctnagtgatggtctcctgcagtgcttctggttacattctttaccacgttacgtatcgtaagtttcggttagagacgaccgggccccggagggacggggtcttggtaggcggtaaggtggggagtcggtatccgtacggacccgtttaacggaaactaaacgaagtacgtagaggagagtaacgtcgaagggacaggtacgtcgatacgacgtaccgaccggtacggaacacgatacccgaggtacgtaacaccgtaaccctaagtaaggtacggtaaccgtaggtaacggacgtaccctacgaagtacgtaccgtacgtaaccgaaccggacccgtacctaaccgtttaactacgtacggacccggtaaggaaccgtaggttacgtttaacgtacggtaacctcggttccgtaccgggttaggtcccgttaaccggtaacccggtaacggtttccgttacggggtacggtaacccggg

SEQ ID NO: 246273 - DNA, 601 bp, Homo sapiens
  misc_feature: GYAE6OF02F7NQE.42.49.E05.1.454.CMB.1.raw
  modified_base (564)..(564): a, c, t, g, unknown or other
  misc_feature (564)..(564): n is a, c, g, or t
  modified_base (581)..(581): a, c, t, g, unknown or other
  misc_feature (581)..(581): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactattctttccaccttacggtatagtaattggttagagtacgacggcccccggaggacgggggtcgttggaggtggagtggggtagtggatcgacgtacccgttaacggaaactaaaacgagtaagtagagggagaagaacgttcgagggcaggacgtacgatacatccgaaccggcgaacaacgactaccgacggaacgtaaccgacgaccctaacagtacggaacgtaggacggtacgcctacagtactcgtagaccgacgaccgcctactttagtactggcgacgagagtattagtcgctacgtcgtccgnggtacgtacgtacccgngtccggttggccggtaccgg

SEQ ID NO: 246274 - DNA, 630 bp, Homo sapiens
  misc_feature: GYAE6OF02GVZ2N.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacacttcttttccaccttacggtatgtaattggtgagacgacggcccccggaggacggggtcttggaggtggagtgggagtggatcgacgtacccgttaacggaaactaaaacgagaagtagtagggaagacgtaacggttaccgagggacgaaggtacgtacgtacgtacgacgttaccgaacccggtcggaaccaaccgtaccgtaccccgaaacggaacgtaaccgacggtaaccctaacgtaacgtacggaacgttaggaacggacgtccgtacgagtactcgacggacgaccgacgtacctacgttactacgtcgacgagagtatattacgtgactcgtcggtctggtactacgtacctcgtgttcggcgtacgg

SEQ ID NO: 246275 - DNA, 649 bp, Homo sapiens
  misc_feature: GYAE6OF02GVVMN.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcagtgcttcgtgttacattcctttccaccttacggtatgtaattggttgagacgacggccccggaggacggggtcgttggaggtggacggtgggagtggatcgacgtacccgttaacggaaactaaacgagtagtagtaggaagtaggtaacgttacggagggacaaggtagtacacgtagaacctccgaaccggacggtaaccacgtaccgtaccgaacggtaacgtaccgacgaccctacgtagtacggaacttaggaacggtacgtaccgtacgagtaacttcggtacgaccggtaccgaccggtaccttacgtttacgttacgcgacgacgagtagtagttagtgtacctacggtcggttccgtaggtaccttacggtaacccgtacgttcgttacggacggtaccgg

SEQ ID NO: 246276 - DNA, 705 bp, Homo sapiens
  misc_feature: GYAE6OF02HB5KU.42.49.E05.1.454.CMB.1.raw
tcagtgacgtatgtcacgaccggtgctcgatttagagcgactagcaacacgacaaaggggacccaaaaaccacacccctccttgggagaatcccctagatcacagctcctcaccatggacggacctggagcatccttttcttggtggcagcagcaacaggtgcccactcccaggttccacctggtgcagtctggagctgagctgcagaagccgtgggcctcagtgatggtctcctgcagtgtcttctgttacattctttccactacggtatgtaattggttgagtaccgacgggcccccggaggacggggtcttaggaggtcggtagtcgggtagtggacgtcgacgtacccgttaacggtaaaccgtaaaacgacggtacgtaacgtaggaagtaaggtaacggttaccgagggacgaggtacgtcatactacgtaccgaccggacgaacactactaccgaacggtacgtacgacgaccctacgaacgtacggaaacgttcggaacgggtacctaccgttacgtaacgtactaccgtacgaaccggtaaccgaccggtaccttaactttaacgttaccgtacggtaccggtaccggaaggtacgttaacgtttacggtacggtaaccgttacgttacccgggttccgttaggttacccgttaacgtaaccggtaccgttccggtttacgggacggttacccggg

SEQ ID NO: 246277 - DNA, 644 bp, Homo sapiens
  misc_feature: GYAE6OF02G6FWX.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctccgtgcagtgcttctggttacattccttttccacctacggtatgtaattggttgagacacggcccccggaggacggggtcttggaggtggagtgggtagtggactcgacgtacccgttaacggaaactaaaacaggacgtagtagggaagaacggtaagttaccgagggcgaaggacgtacgtatcactccgaccgcggacactactaccgaacgacgtacgaacgtaccctaacgacgtacggaacgtggacggacgcctacgagtacttccgtacgaacgaccgaaccggtacctaacgtttaacttaccgacgtccggaacgtacggtagtactttagtcgtacctacggttccgttacccgtggtaccgttacgttaacccgtaccggtcgtttacgggcggtaccgg

SEQ ID NO: 246278 - DNA, 615 bp, Homo sapiens
  misc_feature: GYAE6OF02GOIE1.42.49.E05.1.454.CMB.1.raw
  modified_base (287)..(287): a, c, t, g, unknown or other
  misc_feature (287)..(287): n is a, c, g, or t
  modified_base (435)..(435): a, c, t, g, unknown or other
  misc_feature (435)..(435): n is a, c, g, or t
  modified_base (464)..(464): a, c, t, g, unknown or other
  misc_feature (464)..(464): n is a, c, g, or t
  modified_base (544)..(544): a, c, t, g, unknown or other
  misc_feature (544)..(544): n is a, c, g, or t
  modified_base (605)..(605): a, c, t, g, unknown or other
  misc_feature (605)..(605): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggggcctcgagtgatggtctcctgcagtgcttctggttacattcttttccaccgttacggtatgtaattggttnagtacacgggcccccggaggaggggcttggaggtggagtgggatggatcgacgtcccgttaacggaaactaaaacgagaagtagaggagaagaacgttcggaggcagacgtcatcatacgaccggacggaccacacgtccaagactanacgacctagactcggaacttggacggacncctacagtactcgtagaacgaccaccggaccttaactttaacgtactcgaccggtacgaaggttacgtaatttaggtacnccggttacgttccgggttcgtcggtaccgttaccggtaacccgttaccgtcggtttacggngggtacccgg

SEQ ID NO: 246279 - DNA, 705 bp, Homo sapiens
  misc_feature: GYAE6OF02ILFUX.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctgggcctcagtgatggtctcctgcagtgcttctggttacattcttttccacctacggtatgaattggttgagacacggcccccggagagggggtcttggagtgggatggggatggatcgacgtcccgttaacggaaactaaaacgacgagtaagtagggaaggtaaggaacgttccgaagggacaaggagtacagtacgacttaccgacccggacggaacctaacgaactacccgaaaccggtaacggtaaccaacgacccttaacgaacgttagggaaaccgttggaaacgggacgtcccgtacgtaacgtattcgacggaacgaaccgaaccggggtccctaaacgtttacgtttaaccgtaggtcccggacggaaggtacgttaacgttttagttacggacccttacgggtttaccggttaccgttcggggttaccgttaaccggttaacccgtacccggttacggtttacgggtaccggggtaacccggg

SEQ ID NO: 246280 - DNA, 676 bp, Homo sapiens
  misc_feature: GYAE6OF02GVE7C.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccactacggtatgtaattggttgagacacggccccggaggagggcttgagtggagtgggatggatcgacgcccgttaacggaaactaaaaacagtaagtaagtaggaagaagtaagttaccgaagggacaaggagtacactacaactaccgaaccggacggaacaacactacccgaacgacgtaacgacgacctaacgaacgtaggaaaccgttggaacggacgacccgtacgaacgggtacttaccggtacgaaaccggaaccgtaacccgggtaccctaaacgtttaacgtttaaccgttacggaaccgacccggtaagaaggttaacgtttacgttaacggtaccgtaccgttaccggttccgtacggtacttacggttaaacccacggttacgtttcggtacgggtaacccgg

SEQ ID NO: 246281 - DNA, 663 bp, Homo sapiens
  misc_feature: GYAE6OF02IY4U1.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacaggcccccggagaggggcttgaggtggatgggatggatcgaacgtcccttaacgggaactaaaacgagaagtagtggagagtaagttccagggcagagtcatcatcgaccgcggacacactccaacgtaggtacagccaatacgtaggaacgttaggaacgggtacgcctaacgaggaacgttcgtacgaaccggtaacgaaccgggtacctaacgtttaactttaaccgtacggacccggtaccggtaaggtacggttaacgtttacgttttaccggaaccgttaaccgtttaccggggttaccccgttacggggttacccgtttacggttaaaaccccgtaccgggtttaccgtttacggggttccggggtaacccgg

SEQ ID NO: 246282 - DNA, 623 bp, Homo sapiens
  misc_feature: GYAE6OF02INCO4.42.49.E05.1.454.CMB.1.raw
  modified_base (363)..(363): a, c, t, g, unknown or other
  misc_feature (363)..(363): n is a, c, g, or t
  modified_base (442)..(442): a, c, t, g, unknown or other
  misc_feature (442)..(442): n is a, c, g, or t
  modified_base (464)..(464): a, c, t, g, unknown or other
  misc_feature (464)..(464): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattccttttccaccttacggtatgaattggttgagtacacgggcccccggaggacggggtcttggaggtggagtgggatgggatcgagtcccgttaacggaaactaaaacgngaagtagtaggaagagtaacgttaccgagggcagagtacatcatcgaccgcgacacatccgaacgagtacacgacctanagtacggtaactgggaaggacnccgtacagacttacgacggtaccgacgaccggacctaactttaacgtacgtagccggtacgtagacgttatttacgtcggtacctaacgttccgggttacccgttagggtaccttaccggttaaacccgtcggttaccgtttcgggacggttacccggg

SEQ ID NO: 246283 - DNA, 628 bp, Homo sapiens
  misc_feature: GYAE6OF02IS263.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtgcttctggttacattctttccacctacggtatgaattggttgagacacggccccggagaggggcttggaggtggagtggggatggatcgacgtcccgttacggaactaaaacgagacgtagtaggagaagtaacgttaccgagggcaaggtagtacagtccagtccgaaccgcggaacaccactacccacggtaacgtaacacgaccctaacacgtaggtaaccgtgaacgggacgtccgtacgacgtactccgttagaacccgacgaacgacccgtaacgtttacttacgtcggccgacgaacggtagtaattttaacgtcgtaccgtacgttcggttcccgtaggtaccgttacggtaacccgagtccggtttacggcgggtaccgg

SEQ ID NO: 246284 - DNA, 685 bp, Homo sapiens
  misc_feature: GYAE6OF02FW3EU.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccactacggtatcgtaattggtgagactacggcccccggagacggggcttggacggtggagtggggagtgggactcgacgtcccgttaacggaactaaaacgagacgtagtacggagagtaacggttaccgagggacaaggagtacagtcgagtacaccggtacggacacatacccaaggacgtacgacgtacctacagtacggaactggacggtacgccgtacgacggtactaccgtaggtaaccgaccgaccggggtaccctaaccgttttaaacgttaaccgttcggtacccgacggttaacggtacggttaagtttaaccggtttaggacccgttaacccggttccgggttaccccgtttagggacccgttttacgttaaacccgtaccggggttacctttaccgggtcggggttaacccggg

SEQ ID NO: 246285 - DNA, 613 bp, Homo sapiens
  misc_feature: GYAE6OF02FRJEY.42.49.E05.1.454.CMB.1.raw
  modified_base (184)..(184): a, c, t, g, unknown or other
  misc_feature (184)..(184): n is a, c, g, or t
  modified_base (266)..(266): a, c, t, g, unknown or other
  misc_feature (266)..(266): n is a, c, g, or t
  modified_base (488)..(488): a, c, t, g, unknown or other
  misc_feature (488)..(488): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtncagtctggagctgagctgcagagcctgggcctcagtgatggtctctgcagtgcttcgtggttacatctttccacttacggtntagtaacttggtgagacgtacgggcccccggaggacggggtctttaggacggttggacgttggggattgggatccgacggtcccgttacggaacctaaacgagagtagtaggagtagaggttccgaagggcagagtacatcgacttcgaccggacggacacgactccgacgtacggtacacgtcctacagtgtaacgtggacggacgcctacgagacttccngaacgacacggtacctacgttacttacgtcgcgtaccgaggtacgtacgtttaagtcgtaccgtacgtcgggtaccttggcccgtttacgtaaccccgtggttccgtttacgggccggtaaccgg

SEQ ID NO: 246286 - DNA, 601 bp, Homo sapiens
  misc_feature: GYAE6OF02ITP02.42.49.E05.1.454.CMB.1.raw
  modified_base (354)..(354): a, c, t, g, unknown or other
  misc_feature (354)..(354): n is a, c, g, or t
  modified_base (385)..(385): a, c, t, g, unknown or other
  misc_feature (385)..(385): n is a, c, g, or t
  modified_base (476)..(476): a, c, t, g, unknown or other
  misc_feature (476)..(476): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccactacgtatgattggttgagacacgggcccccggaggacggggtctaggaggtggagtgggatggagtcgacgtcccgttaagaaacctaaaacngaagtagtaggagaagtacgtcgaggcaganacatcatccgaccgacgacacactaccgacgtaacgacaacgtacctaactacgtacggaaaccgttggaacggacgtaccctacgaacgngttaccgtagaccgaccgacgtaacctacgttacttaccgtgaccgacgaacgtagtactttagtcggtacctacgttcggtacccgtggtctacggttacccgaggtccgttaggcggtaccgg

SEQ ID NO: 246287 - DNA, 674 bp, Homo sapiens
  misc_feature: GYAE6OF02H0GW1.42.49.E05.1.454.CMB.1.raw
  modified_base (221)..(221): a, c, t, g, unknown or other
  misc_feature (221)..(221): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctnagtgagtggtctccgtgcagtgtcttcgtggttactattcctttccaccgtacggtatgtaattggttagagacgaccggccccggaggacggggtcttaggaggtggtacgtgggacgtggtactcgacggtacccgttaacggaaaactaaaacgaggtagttaagtagggtaagaacgtaagttccggagggtacgaggtacgtacagtaccacgtaccgaccggacgacctaacacgtaccgaacgtaacgtacacgtacccgtacgacgtacggtaacgtgggaacggacgtccgtaacgacgtacgtctaacggaccgaacgaacccgtaccgttacttacgttacgcgacgtaccgaaggtacgttaagtttagtccgtaccgtaccgttcggttacccgtggtaccttacgggtaaccccgtagtccggtttaggccggtaccgg

SEQ ID NO: 246288 - DNA, 680 bp, Homo sapiens
  misc_feature: GYAE6OF02HBMOK.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttacattctttccacctacggttatgtaattggttgtaggacgacgggcccccggagggacggggtcgttggaggtcgggagtggggtaacgtggtatcgacggtacccgttaacgggaaactaaaacgagtagtacgtagggaagaggtaacggttacggagggacaaggtagtactagtacactaccgacccggaccggaactacctactaccccgaagtaacggtaaccacgacctaacgaacgtacggtaaccgtaggaacggacgccgtacgacgacgttacgtacggaacgacccgaacggtccctaacgtttacgttacgtacggtaccggacggtacgtaagtactttacggttcgtacgtacggttcggttaccgtaggttaccgttacggtacccgttacgtcggttacgggtcggtaccgg

SEQ ID NO: 246289 - DNA, 672 bp, Homo sapiens
  misc_feature: GYAE6OF02JTY68.42.49.E05.1.454.CMB.1.raw
tcagtgacgtatgtcacgaccggtgctcgatttagagcgactagcaacacacaaaggggacccaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgagtggtctcctgcagtgcttctggttacatcttttccactacggtatcgaattggttgagtacacggccccgaggaggggcctgagtcggagtcgggatggactcgacggtacccgttacggaaacttaaaaccgaggtaacgtaagtgggaacgtaaggtaaacgtttccggaagggtaccaggtacgtaccgtaagtacctaacgtaccgaacccggtcgggaaacctaccgaaccgttccgaacggtacgttaaccacggtaccctaacgacgttacggaaacgttggaagggtacgtacccttgaacgtactaccgtaaggaccgtaaccgacccgggtaacctactttaacgttcccgttacgcggtaccgatacgtatttacgtcgacgtaacgtcggttcctaggtaccttacggaacccctaggtccgtttgggcgtaccgg

SEQ ID NO: 246290 - DNA, 638 bp, Homo sapiens
  misc_feature: GYAE6OF02HYLSH.42.49.E05.1.454.CMB.1.raw
  modified_base (367)..(367): a, c, t, g, unknown or other
  misc_feature (367)..(367): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactccccaggttcacctggtgcagtctggagctgagctgcagaagccgtggggcctcgagtgattggtctccgtgcagtgtcttcgtggttacattcctttccacctacggtatgattggtgagacaggccccggaggagggcttggaggtggagtgggagtggatcgacgtcccgttacggaaactaaaacgagagttagnggaagagtaagttacgaggcgaagtagtacgatacgagtaccgaccgtaccggacacgactacccggaacgtacgtacacgacctaacgtacgtacggaactaggaaggacgaccgttacgagtacgtcgtacgaaccggaccgaaccgggtaccctaacgttttaagtaaccgtgaccgtacgaagtagtaacgtttacgtcgacccgttactccggttaccgtcgttacgtaccggtaacccgtaccggtcgttaggtcgggtacccgg

SEQ ID NO: 246291 - DNA, 606 bp, Homo sapiens
  misc_feature: GYAE6OF02GK9YZ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgctagtgcttctggtactattctttccacctacggtatgtaagttggtagagacacgggccccggaggagggtcgttggaggtggagtgggatggatcgacgtccgttaacggaactaaaacgagtagtatagggagaggtaacgttccgaggacagagtcatacatacgacgcgacacactacgacgacgtacacgtaccgtacgacgtacggaactaggagacgccgtacagtactcgtacgacgaccgacgtacctactttaactacgtacgacgacgagtagtagtttagtcgtacctaccggttcggttacccgtggtaccgttacggtaaacccgtacggttacggttacgggtaccgggtaccg

SEQ ID NO: 246292 - DNA, 688 bp, Homo sapiens
  misc_feature: GYAE6OF02GGAT4.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccaccttacggtatgtaattggttgagacacgggccccggagaggggcttggagtggatgggatggatcgagcccttacggaactaaacagagtatggagagtaagtcgaggcagagtcatcagtacaccggcgaacacactccgacgtacgtacacgtacctacgatcggaactggaggacgaccctacgaagtacgtacctacggaaccgaccgaaccgggtacccttaacgtttaacgttaaccgtcggtaaccggaccgggtaacggtaacgttaaggtttttaacgttccgggtaacccgttaacccggtttaccggggtttaccccggtttaggggttaccccgtttaaccgggtttaaaaacccccccggtaacgggtttaccccgggttttttaacgggggtcccgggggttaacccccgggg

SEQ ID NO: 246293 - DNA, 581 bp, Homo sapiens
  misc_feature: GYAE6OF02HT5DE.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggtacattctttccactacggtatgaattggttgatacacggcccccggaggaggggcttgaggtggagtgggatggatcgagtcccgttacggaaactaaaacgagagtaatggagagtagttccgaggcagagtcatcatcgaccgacggacacactccaacgagtacacgtacctacgagtaggaacttgaggacgtccacgagtatctacgaacgacgtaccgcctaacttacgttactacgacgtaccgaagtagtatttaacgtcgtacctaacgtcggttacccgtggtactacggtaaaccctacggtacgtttcggacgggtaccgg

SEQ ID NO: 246294 - DNA, 787 bp, Homo sapiens
  misc_feature: GYAE6OF02I7L0G.42.49.E05.1.454.CMB.1.raw
  modified_base (725)..(725): a, c, t, g, unknown or other
  misc_feature (725)..(725): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgacagtctggagctgagctggcagagcctgggcctcagtcgagtggtctctgctagtctcttcgtggttacattccgttttaccaccgttacggtattcgaagtttcggtagtaggtaaccgacggacccccgggtagtaacgggggtccttgggtaaggttaggaacgttcggggagtacggggacttaccggtaccggtacccgtttaaacggggtaaaacccttaaaaaccggaggttaaacggttaacggtaggggtaaacgtaacgggtaaacggtttacccgggtaaaggggacccgtaaggtaacggttacgtaaacgtaccgtaaggttacccgacccgggtaaccgggaaccggtaactacccgtttacgaaaccggacgttaaacgaacgtacccgtagaacgttacgggaacgtacggtaacgacgggtacctacgtaggtaaccttacgttacgggaaccgtaaccgtaccccggcttaaacctttagtaccgttcgacgtacgaagtacgttattaagtcggtaaccncgttaccggtccggttaggacccgttaccgttaaccgcgttacgtttccgggagttacccgg

SEQ ID NO: 246295 - DNA, 836 bp, Homo sapiens
  misc_feature: GYAE6OF02H844G.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttccacctggtgcagtctggagctgagctgcagaaccgtgggccgtcagtgagtggtctcgtgcgagtgcttcgtcggttactacttccttttcctaccttaccggttagttacggtaagttggttaggtacggtacgaccggaccccgggacgggacgggtccgttaggtaggtagggaggtagggtaggtacggtagtacgtacggtaccccgttaaacggtaaaacgtaaaaacgaagtaaggttaaggtacggtaaggtaaacgggtaaaggttaccggaacgggtacgtaaacggtaagtacccgtaagtaccaaccgttacccgaaccgggacccggtaaccgaacgtaaccgtaaccccggaaccgggtaaaagtacccgtaaccgtaccgtaaccgtaagttaacgggaaaccgttggggtaacggaacgaccgttacgaagtacgtacggttccggaaaccgtaaaccggccggtaccctttaacgtaacgtttaacccggtacgtccgggaaccgtaagtaaccggttagtttaacggttacgcggttaccctttaacgggggtccccttagggtaaccccggtttaccgtaaaacccgggttcggtttaccggtttagggtaaccccgggggttcttaaccccggggggg

SEQ ID NO: 246296 - DNA, 695 bp, Homo sapiens
  misc_feature: GYAE6OF02I8DJS.42.49.E05.1.454.CMB.1.raw
  modified_base (481)..(481): a, c, t, g, unknown or other
  misc_feature (481)..(481): n is a, c, g, or t
tcagtgacgtatgtcacgaccggtgctcgattttagagcgactagcaacgacacaaaggggacccaaaaaccacacccctccttgggagaatcccctagatcactagctcctcaccatggacggacctggagcatccttttcttggtggcagcgagcaacgaggtcgtcccactcccgaggtttccaccgtggtgccagtcgtggagtctggagtctggcagaaggcccgtgggggcctagacgtgacgttgggtaccttcctcggcaggttcgcctttacgtggttactactttcctttaccctaccgttacggttattagttaagtttggttagtacggtaccggaccgggtaccccggagggtacggggtcgttacggtaggtaggtacggtagggtaggtacggagtacgtaccggtaccgttaacgaaacaaacgagaagttagaggaggaacgtaacggtacgaggagagagtanagtacgacgtccgaacgacgacacgtacgacgacgacgtaccgacgacctaacacgtacgaacgtaggacgaccaccgacgacgtacgcgtacgaaccgacgaaccgtaccgtaacttacgttacgcgtaccgacgtagtagttagtttacgtcgtacgttacgttcggtacgttcggtacgtacgttaccgtacgtcggttacggtacggacg

SEQ ID NO: 246297 - DNA, 761 bp, Homo sapiens
  misc_feature: GYAE6OF02JG1ML.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgcttctggttacattctttccacctacggttatgtaattcggttgagtaccgacgggcccccggaggacgggggtacgttggaggtgggacgttggggacgttgggacgtacgtacgtacccgttaacgggaaaccgtaaaacgaagtaacggttaagtacgggaggtaagtaacggtttaccgaaggggtacgtacggtaagtcgtaacgttacgaacgttaccggaacccgacgggtaacccaaccgtacgttacccgaacggtaacggtaaccgacgtacccgtacgtaacgtacgggtaacctacgggaacggtaccggaccgtacgacggtacgtaccgttacgaaccggaccgtaaccgggtaccctaaccgtttacgttaaccgtacggaccgtaacggtaggtacgttaacgttaccggttagtaccgttaaccggttcggtaccccggttgggtaaccgtttaacccgggttaaaccggtacccggttacgtttcgggtacgggttacccgggg

SEQ ID NO: 246298 - DNA, 646 bp, Homo sapiens
  misc_feature: GYAE6OF02I2CZH.42.49.E05.1.454.CMB.1.raw
  modified_base (245)..(245): a, c, t, g, unknown or other
  misc_feature (245)..(245): n is a, c, g, or t
  modified_base (309)..(309): a, c, t, g, unknown or other
  misc_feature (309)..(309): n is a, c, g, or t
  modified_base (600)..(600): a, c, t, g, unknown or other
  misc_feature (600)..(600): n is a, c, g, or t
  modified_base (625)..(625): a, c, t, g, unknown or other
  misc_feature (625)..(625): n is a, c, g, or t
  modified_base (634)..(634): a, c, t, g, unknown or other
  misc_feature (634)..(634): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctgagtgagtgtctcctgcagtgcttcnggttacagtctttccactacggtatcgaattgttgagacgacggccccggaggagggtcttggnggtcggagtgggagtggactcgacgtcccgttaaggaaactaaaacgacgtaaggtaagtaggaacggaaggtaacgttaccgaagggacgtaagggaagttccaacgtacgtaagtacccgaaccgggaccgggtaacaaccgaacttacccgaacggtaaaccgtaccgaacgggtacccttaaacgacgttaaaccgggtaactaagggaccgggtaacgtcccgtaacgacggtattacccgagtaaccgaccgacgtacccaagttttacacgtggcgagagtagnttagtgcagtcgtcgtggtacctanaccgacgtntcggtgtaccgg

SEQ ID NO: 246299 - DNA, 665 bp, Homo sapiens
  misc_feature: GYAE6OF02G68G9.42.49.E05.1.454.CMB.1.raw
  modified_base (656)..(656): a, c, t, g, unknown or other
  misc_feature (656)..(656): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtcgcttcgtggttacagttccttttcccgaccgttacggtattagtaagtttggttgtaaggaccgacgggaccccccggaggacgggggtccttggaggtagggagtgggtagtggactccgacgtacccgttaacggaaactaaacgagagtagtggaagtagtaacgtacgaggcaggacgtcacgtacacgtccgaccggacgacacacaccgaacgacgtacacgaccctagactacggaacgttacgggacggaccgtacccttacgaacgtaaccgttaccgtaacgaaacccggacctaacccgggtacctaaccgttttaaccgttaccgttacggaccgtaccggaaggtacgtatttacgtcgactacgttggtaccgtgtactaccgtaccgtacgtcgtttcggnggtacccgg

SEQ ID NO: 246300 - DNA, 605 bp, Homo sapiens
  misc_feature: GYAE6OF02IYAIG.42.49.E05.1.454.CMB.1.raw
  modified_base (442)..(442): a, c, t, g, unknown or other
  misc_feature (442)..(442): n is a, c, g, or t
  modified_base (481)..(481): a, c, t, g, unknown or other
  misc_feature (481)..(481): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcctttccaccttacggtatgtaattggttgagacgacgggtcccccggaggtacggggtctggtaggtggtagtagggtagtgggactcgaacgtcccgttaacggaaactaaaacgagtaagtagtggagagacgttacgaggacgagacgtcatcgactcgacgcgacacactccgacgtacgacncgacctacgtaacgtaggaactggacggtacgtccgtanacgacgtacgtagaccgaccgaacgtcctaacttacgttactggaccgaggacgtagacgtttacgtgtactacgtcggtaccgtcgtacgttaccggacctacggtccgttgggcggtaccgg

SEQ ID NO: 246301 - DNA, 628 bp, Homo sapiens
  misc_feature: GYAE6OF02FKROW.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttactattctttccacttacgtatgtaattggtgagacgacggccccgaggacggggtcttgaggtggagtgggagtggtatcgtacgtacccgttaacggaaactaaacgaggtaagtagtagggagaggtaacggttaccgagggtacaagtagtacagtacacgtccgaccggtcgacgacactccgaacggtagtaccacgtacctaacgagtacgaacgtggacgacgacctacgagtactacgtacgaacgaccgacgtacccgtaatttaactacgttacgagtacgtagttaggacttttagtccgtacgtaccgtcggtccgttacggtacgtaccgttaacccgtacggtcggttacggtacggtaccgg

SEQ ID NO: 246302 - DNA, 636 bp, Homo sapiens
  misc_feature: GYAE6OF02HBBKO.42.49.E05.1.454.CMB.1.raw
  modified_base (506)..(506): a, c, t, g, unknown or other
  misc_feature (506)..(506): n is a, c, g, or t
  modified_base (614)..(614): a, c, t, g, unknown or other
  misc_feature (614)..(614): n is a, c, g, or t
tcagtgacgtatgtcacgaccggtgctcgatttagagcgactagcaacacacaaaggggacccaaaaaccacacccctctgggagaatcccctagatcacagctcctcaccatggacgggacctggagcattccttttcgttggtggcagcagcaacgaggtgcccacctcccaggttcaccgtggtgcagtctggagctgacgctgcaagaagccgtgggcctcaggtgactcggtctcctgcagtgtcttgtgttacattcctttaccacgttcggtattagtaagtttggttacgacgaccgtacgggccccgggtaggacggggtcttaggacggtggagtagggagttggacttcgacggtacccgttaacgaactaaacgagagtacgtaggataggaacgttcgaaggcaggtacgacatacgtactaccgaccggtacgacctacgacgtaccgaagtacgactacaccgtacaggtacgacgtagacggacgtaccngtagtactcgtacggacctacggaccgttactaacggttacttcgtcggtacgaacgtagtacgtattacggtctacgtcgttcggttcctggaccttacggtacccncggttagtcggtacggtaccgg

SEQ ID NO: 246303 - DNA, 875 bp, Homo sapiens
  misc_feature: GYAE6OF02FZ6DG.42.49.E05.1.454.CMB.1.raw
  modified_base (715)..(715): a, c, t, g, unknown or other
  misc_feature (715)..(715): n is a, c, g, or t
tcagtgacgtatgtcacgaccggtgctcgatttagagcgactagcaacacacaaaggggacccaaaaaccacacccctccttgggagaatccctagatcacagctcctcaccatgggacgggacctggagcattccttttcttgggtggcagcagacaacgaggtcgaccccactcccgtaggttccaccgtgggttcgcgtaggttcgtagggacgtcgtagacgtcgtacggacaaggtaaccggtccggtcggggacccttacggtaagggttcggtaacggtttcccgggttaccttcccgttacgggaccggttaggtttccggttcccgtttttaccggttacgggttttaaccttttaccgtttttacccgtttttaacccccggtaaccggtttaacggggtttaacgttaacgggttttaaaggttttcggggttaacggtaaccgggaacccggggtaccccgggggtaccccggggtaaggggttacggggtacggtttagggtagggttacgggtagggttagggtacggtacggtacggttaaccgtaccggttaaccggtaaacgtaaacgtaagaggtaacgtaggtaacggacgtacggtacggacggacggatacggactacgtataccgtacgaccgacgacaacctacgtacgaccgtacgtagacccgtacgtacgtaagacggtagtaaccggngtaccgacttacgacgtcgtacgtcggaaccaacgggctaaccgttcgttaacgttcgtaagcggtaacgtacgtagttacgttacgtaggttcccgacggttcggtacgttacggtagtacccgtacgttaccgtcggtcggttaccggcgtaaccggg

SEQ ID NO: 246304 - DNA, 543 bp, Homo sapiens
  misc_feature: GYAE6OF02GJGFX.42.49.E05.1.454.CMB.1.raw
  modified_base (244)..(244): a, c, t, g, unknown or other
  misc_feature (244)..(244): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (422)..(422): a, c, t, g, unknown or other
  misc_feature (422)..(422): n is a, c, g, or t
  modified_base (453)..(453): a, c, t, g, unknown or other
  misc_feature (453)..(453): n is a, c, g, or t
  modified_base (537)..(537): a, c, t, g, unknown or other
  misc_feature (537)..(537): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttntggttacatcttttccacgtacggtatgaattgttgagacacgggtcccccggaggagggggcttggagtggagtgggatggatcagcccttaacggaactaaaacgngacgtatgganagagttcgagggtcaggagtcatcatcacgcgaacacatccacgagttacagcctaacncgtacggaacgtgacgggtagacctcgaagntcgtagaccggaacaccgggacctaactttataaccgtgacgacagactatacgtgcacgtgcctggactgaccgtagcttagnggtacc

SEQ ID NO: 246305 - DNA, 611 bp, Homo sapiens
  misc_feature: GYAE6OF02G2N4Y.42.49.E05.1.454.CMB.1.raw
  modified_base (402)..(402): a, c, t, g, unknown or other
  misc_feature (402)..(402): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgtcttcgtggttacattcttttccaccgttacggtatgtaattggttgagacgacgggcccccggaggaggggtcttggaggtggagtggggatggatcgacgtcccgttaacggaactaaaacgagagtataggagagtaagttccgaggcaggagtacatnactcgaccgcggacaccactccaacgacgtaaccagtaccctaagtacgtaggaaccgtaggaaggacgcctacgaacgtacgtcgtagaccgaaccgaccgtacctaacttacgttaacgtcggacgtcggaagtagtaactttaggtcggactacggttggtccgttagccgttacgtaacccgcggttcgttagggtcggtaccgg

SEQ ID NO: 246306 - DNA, 593 bp, Homo sapiens
  misc_feature: GYAE6OF02JX7ZO.42.49.E05.1.454.CMB.1.raw
  modified_base (140)..(140): a, c, t, g, unknown or other
  misc_feature (140)..(140): n is a, c, g, or t
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (344)..(344): a, c, t, g, unknown or other
  misc_feature (344)..(344): n is a, c, g, or t
  modified_base (495)..(495): a, c, t, g, unknown or other
  misc_feature (495)..(495): n is a, c, g, or t
  modified_base (587)..(587): a, c, t, g, unknown or other
  misc_feature (587)..(587): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttnttggtggcagcagcaacaggtcgcccactcccaggttcaccgtggtnacagtctgganctgagctgcaggtacgccgtgggcctanaggtnaagtggtcctccgtgctagtgcttctggtactcttctttaccacgtagtactagagttggtagagacgtacgggccccggaaggacgggacttggagtggagtgggatggacncgacgacctaacggaaactaaacgagtaacgtagaggacgagtaacggttcgaggacgagtaagactagtacgagtccgaacggacgtaacacgtaactacgaagtaacgtcaacgtacgaataagtacgtaagacgaggtacgctacganacttacgagtaccaacgacgtacctagttacgtaccaggacgagacgtatatagtcgtatacgtgtaccgtgacttcgaaccacgtgtacgngtacgg

SEQ ID NO: 246307 - DNA, 788 bp, Homo sapiens
  misc_feature: GYAE6OF02JG0WE.42.49.E05.1.454.CMB.1.raw
tcagtgacgtatgtcacgaccggtgctcgatttagagcgactagcaacacacaaagggacccaaaaccaacacccctccttggagaatcccctagatcacagctcctcaccatggacgggacctggagcatcctttcttggtgcagcagcaacaggtgcccactcccaggttcacctggtgcagtctggagctgagctgcagaagccgtgggcctcgagtgatggtctcctgcagtcgtcttcgttggttactattccttttccaccgttacggtatagtaagtttggttagacgtaccgacggcccccggtaggacggggtcgttacggaggtcggagtgggatagggtactcgacgtacccgttaacggaaactaaaacgagtacgtaagtggtaagaggtaacgttacgagggacaggtacgtacgacgtactagtccgaccggacggaaccaacgtacgtaccgtacggaacgttaaccgacgtaccctaagtacgtacggtaaacgtacggtaaacggacgtacccgtagtaacgtaacgttaccgtaacgggtaacccggaaacccggtaaccggttaacccctaaacggtttttaaccgttaacccggttaaccgggtacccggtaacccggggtaaagggtaaccgtttaaaggtttaccggtttaaccggtacccgttaacggtttaccccggggttaccgttaccggggttaaccttttaacccggggaaacccttaaccgggtttcccggtttaccggggtacgggttaaccccggg

SEQ ID NO: 246308 - DNA, 633 bp, Homo sapiens
  misc_feature: GYAE6OF02GAL7H.42.49.E05.1.454.CMB.1.raw
  modified_base (451)..(451): a, c, t, g, unknown or other
  misc_feature (451)..(451): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagtggtctcctgcagtgcttctggttactattctttccacgtacggtatagtagttggttgagacgaccgggccccggaggacggggtcgttaggaggtggtagtgggagtaggatcgacgtacccgttaacggaaactaaacgagagtagtaggagaaggtacgtcgaggacagagtctagtcataccgacgcgacacgactaccgacgacgtaacgcgacctanagtacggtaacgtaggacggtacgacctagagtacgtcgtacgaccgacgaccgacctactttaaccgtagtcgacggtacgtacgtagttattacggttacgacctacggttaccggttcggttacggtaccgttacggtaacccgtacgggttacccgtttacgggtacgggtaacccgg

SEQ ID NO: 246309 - DNA, 745 bp, Homo sapiens
  misc_feature: GYAE6OF02FHZ4V.42.49.E05.1.454.CMB.1.raw
  modified_base (247)..(247): a, c, t, g, unknown or other
  misc_feature (247)..(247): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctagctagtgtcttntggttactattcttttacccaccgttacggtatacgtaattggttagagtacgaccggcccccggaggtaggggtccttggacggtggtagtagggtagtggactacgacgtacccgttaacgggaaaaccttaaaacgaggtaacgtaagtagggtaagaaggtaacggttacccgaaggggtacaaggtaacgtacgaacgttaccgaaacttacgaacccggacggaaccgtacgtaacccgttaccccaaaggtaacggtttaaccaaccgggtacccttaaacgaacgttagggtaaaccgttaagggaacggtaaccgtcccgttagaaacggttacttaccggttagaaacccggtacggacccggttacctaacttttacgttacgtaccggcgaacgaacgttagaacgttttaagtcgtacctacggttaccggttccgtagggtacttaaccggtaaccgtccgttacggttcggtacggtacccgg

SEQ ID NO: 246310 - DNA, 699 bp, Homo sapiens
  misc_feature: GYAE6OF02GYB6B.42.49.E05.1.454.CMB.1.raw
tcagtgacgtatgtcacgaccggtgctcgatttagagcgactagctaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctcctgcagtgtcttcgtggttacattcctttccacctacggtatgtaagttggttgtagacgacgggcccccggaggacgggggtcttaggtaggttacgggagtcggggagttagggactacgacgtacccgttaacgggaaactaaaaccgagaacgtagtaggaagaagtaacggttacgagggacgaaggtagtaccagtcacgtccgaaccggtacgaccgtacacgtaccgaacgtaacgtaccacgtacctaacgtacgtaacggaacgttacggaacggtacgtaccctagaacgtacgtccgttacggaaccgtaacccgtaccgggaacccttaactttaacgttacgtacggtaccgtacggaaggtacggttaattttaggtacgtaccgttacggttcggtaccgttggtaccgttacggttaacccgtacggttacgtttgggcggtaacccgg

SEQ ID NO: 246311 - DNA, 644 bp, Homo sapiens
  misc_feature: GYAE6OF02F460P.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtggggcctcagtgatggtctcctgcagtgcttctggttacattctttccactacggtatgtaattggtgacgacgtacggccccggaggaggggcttggacggtggagtggggatgggatcgacgtcccgttaacggaacttaaaacagtagtaagtggaagagtaacggttcgaagggcagagtacatcactccgaccggcggtacacacgtaccgacgagtacagtaccctaacgactacgggaacttggaacggtacgtccctacggagtacctcgttagaaccggaccgaacccggtaccgtaacgtttacttacggtacggaccggtacgacgtagtaagtttacgttacgaccttaaccggttcgggttacccgttagggtaccttacgtaaacccgtcggtaccgttacgggtcgggtacccgg

SEQ ID NO: 246312 - DNA, 663 bp, Homo sapiens
  misc_feature: GYAE6OF02GR2QG.42.49.E05.1.454.CMB.1.raw
  modified_base (155)..(155): a, c, t, g, unknown or other
  misc_feature (155)..(155): n is a, c, g, or t
  modified_base (180)..(180): a, c, t, g, unknown or other
  misc_feature (180)..(180): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (351)..(351): a, c, t, g, unknown or other
  misc_feature (351)..(351): n is a, c, g, or t
  modified_base (497)..(497): a, c, t, g, unknown or other
  misc_feature (497)..(497): n is a, c, g, or t
  modified_base (528)..(528): a, c, t, g, unknown or other
  misc_feature (528)..(528): n is a, c, g, or t
tcagtgacgtatgtcacgaccggtgctcgatttagagcgactagcaacacacaagggaccaaaaccacaccctcctcggagaatccctagactcacagctcctcaccatcggacggacctggagcatcctttcttggtgcagcagcaacaggttnacccactcccgaggttccacctggngcacgtctgagctgagctgcgagaatccgtgggctacgagtnacngtcctctgacgtagtgacctttgacggttacncttctttaccgacgtaccgttaatcggttaagttcggttagacgaactcgggaccccggtagaagggtccgttgcggttggaatggagttaggnttccgacgttacccgtacggtaaacgttaaaacgagtatagtcggaaaggagtacgttacccgaaaggtccgaagcgtaacgagttacaggccaacggtcacgactttagaccacgacgtaaactcgacgtacaaccgttagaacncgagggtaactccgaatacggtaactcgganaccggaacgaccggtttaactaacgttcaaacccgtttgacccgtagaaggtaccaggttttaccaacgttcgaccgtaaccgtgttaccggacgtttaacgaccccgtttaacgcgttacccggtggtaacccg

SEQ ID NO: 246313 - DNA, 747 bp, Homo sapiens
  misc_feature: GYAE6OF02H247R.42.49.E05.1.454.CMB.1.raw
  modified_base (201)..(201): a, c, t, g, unknown or other
  misc_feature (201)..(201): n is a, c, g, or t
  modified_base (667)..(667): a, c, t, g, unknown or other
  misc_feature (667)..(667): n is a, c, g, or t
tcagtgacgtatgtcacgaccggtgctcgatttagagcgactagcaacacgacgaaaaggggacccaaaaaccacacccctccttgggagaatccctagatcacagctcctcaccatgggacgggacctggagcactccttttctggtggcagcagcaacgaggtgcccactcccaggttcacctggtcgcagtctggacnctgagctgcagaacgccgtcgggcctcaggtgacgtggtcctccgtggcctaggttgtcgtttcgttacggtttaacctactttcccgtttttacccgaaccgtttaacggggttaacttacggttaaagtttcgggtttacgaacggtaccgaaccggggacccccggtaaggtacggggtcgtttggaaggtggaagtcgggacgttggactccgtacgtacccgttaagggaaacctaaacggagtaacggtagtacggaagtaagtaacggttaccggaacgggacgaacggtacggtacctaagtcctacgtaccgaacccgggacggaaccctacgtaaccgtacccgaaacggtaacgttaaccggaactcccggttaaacgagttaccggaacgttacggaaacggcgacctacgagtaaccttcgaagaccgacgtaccgtctaacgttaagtccgngccgtacgagtagtagttacgtcgacttcggcgttacgtccggcgtaacgtacccgaccggttgttccggacgtacccgg

SEQ ID NO: 246314 - DNA, 648 bp, Homo sapiens
  misc_feature: GYAE6OF02GU0DJ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccaccttacggtatgtaattggttgagacgacggcccccggaggacggggtcgttggagtgggagtggggagtggatacgacgtcccgttaacggaaactaaaacgagtagtagtagggagaaggtaacgttaccggaagggcgaaggtagttacgtataccgtactaccgaaccggaccgggaaccaccgactacccgaaccggtaacgtaaccgacgacccgtaacgtacgtacgggaacgtgggaccggaacgtccgtacgagtacgtcgtacggaaccgaccgtaccgacctacttacgttaccgtgaccgacgtagagtatttacgtcgaccttacggtcgttaccgtggacgttacgtaccaccggtcgttacgggtggtaccg

SEQ ID NO: 246315 - DNA, 693 bp, Homo sapiens
  misc_feature: GYAE6OF02GMX2A.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgagtggtctcctgctagtgcttcgtggttacattcctttaccaccgtacggtatgtaagttggttagagacgacgggtcccccggaggacggggtcttggagtggagtgggtatggatcgtagtcccgttaacggaactaaaacgagtaagtagtagggaagtaacggtaacggttccgaagggacgtaaggtacgtacgtactcgtaacgtacccgaccggtacggaactaccgacgtaccgaacggtaacgttacgaaccgtcctaacgtaacgtacgggaaacgttagggacgggtacgtcccgttagacgtactacgtagaaccggaaccgtaccggtacctaacgtttaacgttaccgcggtaaccggacgtaaggtacgttaagtttacgtacgtaccgtacgttcggttaccgtagtaccgttacggtaacccgtacggtacggtttacggtacggtaaccgg

SEQ ID NO: 246316 - DNA, 791 bp, Homo sapiens
  misc_feature: GYAE6OF02GE8J4.42.49.E05.1.454.CMB.1.raw
  modified_base (381)..(381): a, c, t, g, unknown or other
  misc_feature (381)..(381): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctggggcctcagtgatggtctcctgcagtgcttcgtggttacattcctttccaccttacggtatcgtaagttggtttagagacgacgggcccccggtaggacgggggtcttggagtggagtgggagtgggtactcgtaccggacccgtttaacggaaaaccgttaaaaccgnggtaagttagtagggaacggtaacggtaacgtttacccggaagggtaccgaaggtaaggtaccaataccgtaagtacccgaacccgggacgggaaccaaccgtaacttaccccgaaccgaacgttaaccgaccgtacccctaacgtaaacgtccgggaaaacgttaggaacgggaaccgtcccgtacgtaacgttaaccgttacccttaaacggaccccgggtaaaccgacccggggttaccctaaccgtttttaacgtttaaccgtcggtaaccggggtaaccgaaggtaccgtttaagttttaccgttacggaacccgttaccggttaccgggttacccggttcggttaaccgtaaccggtttaaaccccgtccggttacccggtttgggtaacccgggttacccggg

SEQ ID NO: 246317 - DNA, 667 bp, Homo sapiens
  misc_feature: GYAE6OF02JALZ7.42.49.E05.1.454.CMB.1.raw
  modified_base (219)..(219): a, c, t, g, unknown or other
  misc_feature (219)..(219): n is a, c, g, or t
  modified_base (410)..(410): a, c, t, g, unknown or other
  misc_feature (410)..(410): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagagccgtggggcctnagtgattcggtctcctgcgagtgcttcgtggttacctattccttttccaccgtacggttatagtaagttggttagagaccgacggcccccggaggtaggggtcgttaggaggtaggagtggggagtggagtcgacgtacccgttaacggaactaacgagagtagtggagagtaacgtcgaggcagacgtanatcacgtcgaccgtacggaacactactaccgaacggtacgtaaccacgtacctacgacgtacggtaacgtgggacggtacgtaccgtacgaggtaccgttaccgtacggaaccggacgaaccgtacccttagttaaaccgttacgacggtaccgacggtaaggtcgttaacgtttgttaacggacccttacggttcggtccgttaggtacccgttaccggttaaacccgtccggttacggttaccggtaggtccggg

SEQ ID NO: 246318 - DNA, 794 bp, Homo sapiens
  misc_feature: GYAE6OF02HHRPU.42.49.E05.1.454.CMB.1.raw
  modified_base (159)..(159): a, c, t, g, unknown or other
  misc_feature (159)..(159): n is a, c, g, or t
  modified_base (197)..(197): a, c, t, g, unknown or other
  misc_feature (197)..(197): n is a, c, g, or t
tcagtgacgtatgtcacgaccggtgctcgatttagagcgactagcaacacacaaagggggacccaaaaaccacacccctccttgggagaatcccctagatcacagctcctcaccatggacgggacctggagcatccttttcttggtggcagcagcaacnggtgcccactcccaggttcacctggtgccagtctgganctgagctggcagaagccgtggggcctcagtcgatgggtctacctgcagtcgcttcgtggttacacttcctttaccaccttacggtactaggttaacgttggttaggagtaaccgaccgggcccccgggtaaggacggggggtacttcgggtaggtagggaagttcggggagttcgggaacgtccgacggtacccgttaaacgggaaaccttaaaagacggtaaggtacgtagggaaggtaacggtaacgttccgggagggtacgtacggtagttaccgaacgttcaaccgtaccggaacccggtcgggtaactaccgaacgtacccgaacggtaacgttaaccgaccgtaccgtaccaaggtacgacgttacgggacggaccgtacctacgacgtattaccgtaacggaccgaaccgtaccggtaccttaaccgttttaagtaccgtacggccgggtaacggttaacggcgttaaacggtttttgtaaccgggttaaccccgttaggtttaccggtttacccggttacggttacccggtttaaccggtaaccgttaccccgggtttacggtttccggggtaacgggttaaccccggg

SEQ ID NO: 246319 - DNA, 535 bp, Homo sapiens
  misc_feature: GYAE6OF02FE9J3.42.49.E05.1.454.CMB.1.raw
tcagtgacgtatgtcacgaccggtgctcgatttagagcgactagcaacacacaaaaggggacccaaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatctttccacctacggtatgaattggttgagacagggcccccgagagggggcttgagtggatgggatggatcagccccttacggaactaaaacagagtatggagagaagttccagggcagagtcatcatcaccgcggacacatccaacgacgtacagcctacagtcggaactgaggacgcctgacgtatctgacgtacgacggacctactttaatactgcgcgagagtattagttgcacgtcggtccgtggcttcgtaacccgcgtcgttggtgggtaccgg

SEQ ID NO: 246320 - DNA, 612 bp, Homo sapiens
  misc_feature: GYAE6OF02GEE7R.42.49.E05.1.454.CMB.1.raw
  modified_base (440)..(440): a, c, t, g, unknown or other
  misc_feature (440)..(440): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctctgcagtgcttctggttacattcttttccacctacggtactgtaacttggttgagtacgacggcccccggaggaggggtcttggagtggagtggggatgggatcgacgcccgttaacggaaactaaacgagagtacgtaggagaaggtaagttccgagggacagacgtacatcatacgaccgcgacacatccagacgtacagtacctanagtacggaagtggaaggacgcctacgagtactacgtcgaccgacgaccgtaccttacgttaacgttctcggacgtacgaggtacgttagttacgttcgacgttaccggttcgggttaccgttcggaccgtttaccgaacccgttacggtcggtttagggccgggtaacccgg

SEQ ID NO: 246321 - DNA, 781 bp, Homo sapiens
  misc_feature: GYAE6OF02HKRV8.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctggtgcagtctggagctgagctgcagagccgtgggcctcgagtgagtggtctccgtgcctagtcgctttcgtaggttactagttccttttcctaacccgttaacggtactaggtaactttgggttacgtacgtaaccgtaccggaccccccggtaggtaaccgggggtacttaggtacggttacggaagtcgggtaacgtgggtacgtacgtaccggtaacccgttaaccggtaaaacgtaaaacgaagtaaggtaagtagggaacggtaacgtaacggttaccgaagggtacgaacggtaagtacaacgtacaacgtaccgaccggtaccggaaactaccgtaacgtaccgtaacggaaccgttaaaccgacgtaacccgttaagtaacgtaccggtaacgtaggtaacgggactaccgtaacgactacgttacgaacgtaaccgaccgtaaccgtaccgtaaactttaacgttaacgtcggaacgcggtaacgttacgtaacgttttacggttacgtaccgtacgttacccgggttaaccgtcggttaccgttaaccggttaaccctacggttaccggtttacggtcgggtaacccgg

SEQ ID NO: 246322 - DNA, 955 bp, Homo sapiens
  misc_feature: GYAE6OF02F3VB8.42.49.E05.1.454.CMB.1.raw
tcagtgacgtatgtcacgaccggtgctcgatttagagcgactagcgaacacgacaaaggggacccaaaaaccacacccctccttgggagaatcccctagatcacagcctcctcaccatcggacgggacctggagcatccttttcttggtggcagcagcaaccaggtgcccactcccaggttccacctggtcgccaggtctggagctcgagctgcagaagcctagggcctcgaggtcgattcggtctcctagactagtgaccttcgtaggttaccagttcttttacccaccgttacggtatcgtaacgttggttgagacgtacggcccccggaggacggggtacgttaggacggttacgggacgtacgggtagtagggtacgtaccgacggtacccgttaaccggaaaaccgttaaaacacggtaacggttaacggtagggtaacggaacggtaaacgggtttacccggaacggggtaccgtaacggtaacggtactaacgttaccgaacgttacccggaaacccgggaccggggaaccctaaaccgtacggtaacccccggaaaccggtaacgttaaacccggtaacgttaccccgtaaacggttaacggttaaccggggttaaaccggttaagggtaaacggggttaaaccggtacccgttaaccgggttaaacggtaacgtttacccgggttttaaccggggaaacccggtaacccggggttaaaccccgggaacccggtttaaacccgtttttaaccggttaaccgttaccggtaccggtaaccgggacggttaaacggtaaacgttttaacggtttaccgtaacccggttaccccgggtttaaacccggttcccgtttacccgggtttaacccgtttaaccccgggtttaaaccccctaaccccggggtttttcccggtttacccggggtacccggggtttaaccccgggg

SEQ ID NO: 246323 - DNA, 810 bp, Homo sapiens
  misc_feature: GYAE6OF02I7044.42.49.E05.1.454.CMB.1.raw
tcagtgacgtatgtcacgaccggtgctcgatttagagcgactagcaacacacaaaggggaccccaaaaaccaccacccctaccttcgggagaattcccctagtagtcacagctcctcaccatggacgggacctggagccatccgtttcttgggtggcagcaggtctactaggttgtcccacgtcccaggttcaccgtggtggcagtctggagctgacggctgtcgagagcctggggccttcgagtgacgtcggtcctccgtgcgagtcgccttgtcggttacctatccttttaccaccgtacgggtactcgtaacttggttcgtacggtaccgtaccggggacccccggtaggtaccgggggtccgtttagggacgggttacggggtacggttagggggtacggttccggggtacgttaaccgtaacgggttaaccccgtttaaacggggtaaacctttaaaaaacccggagggttaacgttaaccggtaggggaacggtaaacggtaaccggtttaccggacggggtaacgtacggtaaacggtccgtaacgtacggtacgtaccggtaaccgacgggttaaccaccgtaacgtccggtaacggtaacgttaaaccgaccgtaacttaaccgtaagtaacgggttacgttacggacggtacgacctacgtaaggtaactccgtaacggtaacgaaccgtaacggcctaacgttaagttcgtacgtccgagacggtactacgttaacgtcgaacttacggtaccgtcgtacgtccttaggtaccccgtagttacgtacggtcggtaccgg

SEQ ID NO: 246324 - DNA, 722 bp, Homo sapiens
  misc_feature: GYAE6OF02JIE3Q.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagccgtcggggcctcgaacgtgagtcggtctccgtgactagtcgtcgttcttaggttactattccttttccaccgttacggtagtcgtaagtttggttagacgtacggtaccggaccccggtaggtacggggtccgttggtagtggaagtcggtagtgtagtaccgacgtaccgtaacggtaaactaaacgaggtacgtaaggtacggaacgtaaggtaacgttacgagggtactaggtagtactagtacactaccgaccgacggtaacacgtactaccgaacgtacgtaacgacgtaccgtacgtaacgtacggtaacgtacgtaaggaccgtacctaacgacgacgttcgaaccggtaaccgtaccgacccgggttaacaacgtttaacgtaccgtacgacccgggaacgttacggacgtaagtttaaccgttccgggtaactaccggttaccggtaccgttacgggaccttaaccggtaaccgtaccggttcgtttcggtaaccgggtaccgg

SEQ ID NO: 246325 - DNA, 633 bp, Homo sapiens
  misc_feature: GYAE6OF02HAZB8.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtcctccgtgctagtgtcttcgtaggttactattccttttaccaaccgttacgttatagtaagtttgggttagacgacgaccgggaccccgggaggtacggggtcttaggaggtggaggtagggacttggatcgtacgtacccgttaacggaaactaaaacgagtagtagtaggagagtaagtccggaggcgagacgtacatcactacgaccggcgactacgactaccgaacgactacgactaccgtaacgagtacggaatggacggtacgacctaggaacgcttcgaacgaccgaccgtaccgaccttacttaacgtcgacgccgtacgaagtagtattacgtcgacctaggtcggtaccttcggtaccttcgtaaccgtccgtttcgggtacggcgtaccggg

SEQ ID NO: 246326 - DNA, 701 bp, Homo sapiens
  misc_feature: GYAE6OF02GR1RY.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtcctccgtgctagtgtcttcgtggttacattcctttaccactacggtatgtaagttggttgagcacgggccccggaggagggggtcttggagtggagtagggagtggatccgacggtaccgttaacggaaacgtaaacgtagagtagtaggaagaaggtaacgtaccggagggactaggtagtacactcgacgtccgaccggtacgaactacgaccgtaccgaacggtaacgtaccgacgaccttaacgaagtacggtaaacgtagggtaaccggacgtcccgttaacgaacgttacgttacgaccggtaacccgaaccgtacccggtaccgttaaccgttttaataaccggtacggtaccggacggtaaggtacgttaatttaccggttacggacctacggttaccgggttcggttacgtaccgttaacggttaccctacgggttcgtttacggggtacggtaaccggg

SEQ ID NO: 246327 - DNA, 614 bp, Homo sapiens
  misc_feature: GYAE6OF02JABDO.42.49.E05.1.454.CMB.1.raw
  modified_base (311)..(311): a, c, t, g, unknown or other
  misc_feature (311)..(311): n is a, c, g, or t
  modified_base (474)..(474): a, c, t, g, unknown or other
  misc_feature (474)..(474): n is a, c, g, or t
tcagtgacgtatgtcacgaccggtgctcgatttagagcgactagcaacacacaaaggggacccaaaaaccacacccctccttgggagaatcccctagatcacaactcctcaccatggacgggacctggagcatccttttcttggtggcagcagcaacaggtgcccactcccaggttcacctggtgcagtctggagctgagctgcagaagcctggggcctcagtgatggtctcctgccagtgcttctggttacatcttttccacctacggtatgaattgggttgagtacaggcccccggagagggggtctgngtaggatgggactggatcgacgtcccgttacggaactaaacgagagtacgtggagagtaacgttccgagggcgagagtacatcagtccaccgtcggaacactactccacgtacgtacacgtcctaacagtacggaactggaaggcgtacctcgaagtaccgtntacggaccgacgtaacccgggtcctaactttaacgttactacggaccgacgtacgacgttattaacgttcgaccgtacgttcggttaccggtacgtacgtacgtaccgtacggtaccgttgggttcggaccgtaaccggg

SEQ ID NO: 246328 - DNA, 683 bp, Homo sapiens
  misc_feature: GYAE6OF02JIAUC.42.49.E05.1.454.CMB.1.raw
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagagcctgggcctcngtnatggtctcctgcagtgcttcgtgttacattctttccaccgtacgtntgtattgtgagacgacggccccgagngggtctgcgtgagtggatggatcgacgtacccgtaacggaactaaacgagtagtagtagggtagtagtacgttacgagggactaggtacgtacacgtactaacgtaccgaaccggtaccggaacctaccacgtaccgaacggtacgttaaccgacggtaacccgtaagtaacgtaacgggtaaccgttacgggaaccggttaccggtacccgtacgttaacgacgtttaacccggacggtaaacccggaccgtaacccgggtaacctttaaccgttttaacgtaccggtaccgtaccgaacgtaagtacgttaagtttacgtcgaccttacggtaccgtccgtacggttacttacggtaccgtacggtcccgttaggcccggtaaccgg

SEQ ID NO: 246329 - DNA, 622 bp, Homo sapiens
  misc_feature: GYAE6OF02GGRWD.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgtcttctggttactagttcttttccaccgtacggttatcgtaagttggttgagacgacggcccccgggaggaggggtcgttggacggtgggagtgggatggactcgacgtacccgttaaggaaacttaaacgagagtaagtagggagtaaggtacgttaccgaggacgagacgtacagtcacgtcgaaccggtccggaacacgaacgtaccgaacgtaacgtaccgacggacctaagacgttacgggaacgtagggaggacgccgtacgacgtatacgtacgaaccgaccgtaccggacctacgttattacgacgcgacgtagacgtattagtcgactacgtcgtacgtggtctacggtaacctcggtacttggtacgtacgg

SEQ ID NO: 246330 - DNA, 691 bp, Homo sapiens
  misc_feature: GYAE6OF02H5IBC.42.49.E05.1.454.CMB.1.raw
  modified_base (381)..(381): a, c, t, g, unknown or other
  misc_feature (381)..(381): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttctggtggcagcagcaacaggtgcccactcccaggttcacctggtgcagtctggagctgagctgcagacgccgtgggcctcgagtcgagtggtctacctgctagtcgtcttcgtggttaactgttccttttacaccgtaggtatagtagttggttagacgtaccgacgggtaccccggtaggacggggtcttaggaggtagtaggtggtagtggaactcgaccgtaccgtaacgaactaaacgngtagtagtcggaagagtacgtcgaggacagtntnancagtacgacggtacgacacgtactacgagtacacgtacgacttagagtacgacgtaggacgacacttacgagtaccgtcgttaccggaaaccgtaccgtaaccggtaccttaacgtttaacgttaaccgtcggaaccgtaacgggtaacgtaacgtttacgtttaccggtcggtaaacccgttccggttcccggttaacccggttggtttaaccccgtaaccggtttaaccccggaccgggttttacggttaccggggtaccggttaacccggg

SEQ ID NO: 246331 - DNA, 609 bp, Homo sapiens
  misc_feature: GYAE6OF02IJRU6.42.49.E05.1.454.CMB.1.raw
  modified_base (523)..(523): a, c, t, g, unknown or other
  misc_feature (523)..(523): n is a, c, g, or t
  modified_base (546)..(546): a, c, t, g, unknown or other
  misc_feature (546)..(546): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttcgtggttacattccttttaccaccgttacggtagtgtaagttggttagagtacgacgggcccccggaggacgggggtcgttggaggtaggagtggggatggatcgacgtaccgttaacggaaactaaacgagacgtagtaggagaagtaacgtacgaggcaagagtacatcatccgacgacgacacataccgacgacgtacgacgacctaacacgtaggaaccgtggaacgacgtcctacgacgtatcgacgacgaccgacgtaccgtattacttacgngtaccgacgagactagtttacgngtacctacgtcggttccgaggttaccgtaccgttaaccgcggtacttgggtaccggtaccggg

SEQ ID NO: 246332 - DNA, 620 bp, Homo sapiens
  misc_feature: GYAE6OF02HY9CA.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctgagtgatggtctctgcagtgcttcgttggttacattcctttttccaacccgttacggtattacggtaatttgggttagaggaccgacggggaccccccggaggacggggtactttggaggtgggtaagtggggaatgggtatcgacgtacccgttaaggaaactaaacgagtagttagaggagaagtaacgtcgaagggcagagtcatacactcgaccggacggacaacactacccgaacggacgtaacgacgacctacgaagtacggaactaggaagacgcctagactagtacagaaccgacgaccggcctacgtttaattacgcgtacgacgagtagtattactcgactcgtggtccgtggtacgtacgtaaccgtacggtcgttcggtacggtaccgg

SEQ ID NO: 246333 - DNA, 668 bp, Homo sapiens
  misc_feature: GYAE6OF02FLRGT.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgtaattggttgagacacggcccccggaggaggggtcttgagtggagtgggatgggatcgagtcccgttacggaaactaaaacagagtagtggagagaagttccgagggcagagtacatcgatccgaaccgcggaaccacgactccgaacgtaacgtaacgacgtaccctaacaacgtaggaaaccttagggacgggtacgacccgtacgaacggtacttccgttagggaaccgtaacccgaaccgggtacccgtaaccgtttaacgtttaacccgtacggacggaccggtaacggtaacgtactttaaggtttcggaccttaaccggttccggttacccgttggttacccgttacggtaaaccccgtaacggtccgtttagggtccggtaacccggg

SEQ ID NO: 246334 - DNA, 632 bp, Homo sapiens
  misc_feature: GYAE6OF02JSPU4.42.49.E05.1.454.CMB.1.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (488)..(488): a, c, t, g, unknown or other
  misc_feature (488)..(488): n is a, c, g, or t
  modified_base (551)..(551): a, c, t, g, unknown or other
  misc_feature (551)..(551): n is a, c, g, or t
  modified_base (557)..(557): a, c, t, g, unknown or other
  misc_feature (557)..(557): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctgagcatcctttcttggtggcagcagcaacaggtcgcccactcccaggttcacctggtgctagtcgttggagctgagctgcagagcctgggcctnagtgatcgtctccngcagtcgcgttcgtaggtactacttcctttccaccgttagtacgtagtacgttggttcgacgacggtaccggccccggtaggacgggtcgttaggtagtcggtagtcgggtataggtagtcgacggtacccgttaacgaaacgtaacgaggtagacggtaggagtaaggtaaccgttagggaacggtacaggtagtaccgtatacgactccgacggtcgaactacgcttacgacgtagtacgactcgtaaacgngtaccggaacgtggacgctcgaacgtgtctaacgagtccacgccgtaccattacgacgtcganaccgtntacggtttactaggttccgaccttagggtccgttaacgcgtccgaagtaaccccgtcgtggttccggaggtccgg

SEQ ID NO: 246335 - DNA, 700 bp, Homo sapiens
  misc_feature: GYAE6OF02I52FA.42.49.E05.1.454.CMB.1.raw
  modified_base (140)..(140): a, c, t, g, unknown or other
  misc_feature (140)..(140): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttnttggtggcagcagcaacaggtgcccactcccaggttcacctggtgcagtctggagctgagctgcagaacggccgtggggcctcgagtgagtggtcctcctgctagtcgtccttcgttggttactattccttttaccaccttacggttattaggtaagtttggttagaacggaaccggaccggggacccccgggtaagggtcggggggtccttagggacgggttgggtaggtgggtagtgggtactacgacggtacccgttaacggaaaccttaaacgagtaagtagtaggaaggagtaacgttacggaggacgagtacgtacacgtactacgtaccgaccgacggaccacgaaccgtcccgaacgacgtaccacgtaacctaacgaggtacggaacgttggaacggtcgacctacgcgtacgtcgtaacggacggaccgtaaccgtacttaacttcgttaacgcggacgacgtacgtagttacgttagttacgacgttacggtcgttaccggtggttaccgtacgttacccggtaggtttcccgttgggtacggtaccgg

SEQ ID NO: 246336 - DNA, 652 bp, Homo sapiens
  misc_feature: GYAE6OF02GV13Z.42.49.E05.1.454.CMB.1.raw
  modified_base (485)..(485): a, c, t, g, unknown or other
  misc_feature (485)..(485): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctggagctgcagaagccgtggggcctcagtgagtggtctcgtgcagtgcttcgtggttactagttcctttccacgtacggtatagtaagttggttgacgacgacggccccggaggagggtcgttggaggtggagtgggtagtcgggagtcgtacgtacccgttaacggaacgtaaaacgagtaggtagtacggaagtaaggtaacgttacgaagggacgaaggacgtacgtactacgtaacgtccgaaccggtacggaaccaacgacgtaacccgaaaggacgtaaaccncgaaccctagaacgttaacggaacgttcggaacggacgtccgtacaggactcggaacgtaccgacgaaccgtacctaacttacttacgtcggacgacgagtagttattacgtcgtctacggtcggtaccgtcgtaccgtacgtaacctagtcgttcgggcgtaccgg

SEQ ID NO: 246337 - DNA, 878 bp, Homo sapiens
  misc_feature: GYAE6OF02JPAZ9.42.49.E05.1.454.CMB.1.raw
tcagtgacgtatgtcacgaccggtgctcgatttagagcgactagcaacacacaagggaccaaaaccaacaccctccttcggagaatccctacgatcacagctcctcaccatggacggacctggagcatctttctggtggcagcagcaacaggtgccactccaggttcacctggtgcagtctgagctgagctgcagaagcctggggcctcagtcgatggtctctgcaggtgcttgtcggttacattcgtttcacctacgtatcgattgttgagacgacggccccggtaggacggggtcttacggtaggtacggtagttacggggtagtgggtacgttacgacggtaccccgtttaacgggtaaaaccgtaaacgtaacggaaggttaacgttaggggtaagtaaagggtaaccggtttacccgaacgggggttacgacggtaaccggttacgtaacgtcccgtaaaggttaaccgtaacccggtaccgggggaaccctaaaccgtaaccgttacccgaaacgggtaaccgtttaaaccgacggtaaccctaaccgtaaacgtacggggtaaaccgttagggaaaccgggtaaacggtcccgttacgggtaaaccgtacgttaacccgttacggaaacccggtaaccgggtaccccgggtaacctttaacccggtttaaactttacccgggttaaaacggtcccggggttaaacggtaaccgggtaaacggttttaaccggttaacgtttaacccggggttacccgttaaaacgggtttcccgggttaaccccggttttaacgggtaacccgtttacccggtaaaacccgggttaacccggtttacccgggttttacgggtaacccgggggttccccggg

SEQ ID NO: 246338 - DNA, 627 bp, Homo sapiens
  misc_feature: GYAE6OF02JIVKR.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccacgtacgtatagtagttgtgagacgacggccccggaggacgggcttgaggtggagtgggatggtactcgacgtacccgttaacggaaactaaacgagtagtagtaggagaaggtacgttacgaggacgtagtacgtacgatacacgtccgaaccgcggaacacacgtaccaggtacgtacacgtacctaacgagtacggaacgtaggacggacgcccgtagtacggtactacgtacggaacccgtaccggacccgtaactacgttaacttacccgaggtccgagggtaacgagttagtacgttacgtccgtacggtccgttcgtaacggtcgtaaccgttaaccgcgtacggttcggtcggtaccgg

SEQ ID NO: 246339 - DNA, 662 bp, Homo sapiens
  misc_feature: GYAE6OF02IL5ER.42.49.E05.1.454.CMB.1.raw
tcagtgacgtatgtcacgaccggtgctcgatttagagcgactagcaacacacaaaggggacccaaaaaaccacacccctccttgggagaatcccctagatcacagctcctcaccatggacgggacctggagcatcctttcttggtggcagcagcaacaggtgcccacctcccacggttcacctcggtgcagtctggagctgagctgcagaagccgtcggggcctcagtgattgggtctccgtgcgagtgcttctggttactattcttttcctacctacggtagtgtaagtttggttgagacgacggcccccgggaggacgggggtcgttggaggtggggtagtggggtagtggagtcgtacggtacccttaacggtaaactaaaacaaggtaagtaagtaggaagtaagaacgttcgaagggcaaggacgtactatacgactcgacccggacgacacaatccgaacgagtaacacgacctacacgtaggaactggagacgcctcagtactacgtcgacggtaccacggaccttacgttacttacgacgcggacgacggtatacgtttactcggtacctacggttccggttcccgttacgggtaccgtttaaccggttaaccccgtacgggttaccgttttacgggtaccggggtaaccccgg

SEQ ID NO: 246340 - DNA, 617 bp, Homo sapiens
  misc_feature: GYAE6OF02F1Q4A.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtcctcctgcgagtgtcttcgtggttactacttccttttacccaccgttacgtagttagtagtttggttgacgacgaccgggacccccgggagtacgggggtcgttacggaggtagggagtgggtagtggagtcgacgtcccgttaacggaactaaacgagtagtagtaggagagtaagtcgaggacagagtacatcacgtcaccggcgaaccacactccgagacgtacacgtacctacgagtacggtaagtcggagacgaccagtacgactacgtacggaccgaccacccgtactaactttactaccgtagccgagtacgtagtagtacgttgaccgtcgtcggtcgttgtacgtacgtaaccgtacgtcgttacggtcggtaccgg

SEQ ID NO: 246341 - DNA, 680 bp, Homo sapiens
  misc_feature: GYAE6OF02IEE2C.42.49.E05.1.454.CMB.1.raw
  modified_base (255)..(255): a, c, t, g, unknown or other
  misc_feature (255)..(255): n is a, c, g, or t
tcagtgacgtatgtcacgaccggtgctcgatttagagcgactagcaacacacaaaggggacccaaaaaccacacccctccttgggagaatccctagatcacagctcctcaccatggacgggacctggagcatccttttcttggtggcagcagcaacaggtgcccactcccaggttcacctggtgcagtctggagctgagctgcagaacgcctggggcctcagtgagtggtctcctgcagtgcttcgtggttactnttccttttcctaccgtacgtatagtaagttggttgagacacggccccggagacggggtcttggaggtggagtgggagtggactcgacgtacccgttaacggaaactaaaacgagaagtagtggaagaaggtaagtccgaggacaaggtgtacagcaacgtccgaccgacgacaaccactaccacggagtaccgaacgaccgtaacgagtacggaaacgtacggaacggacgtacccgtacgaacgtattaccgtaggaaccggaccgtaacccggtaaccttaacgttttaacgttaacccgtcggaccgtacggtaacggtaacgtaagttttaacgtcgtaacgtacccggttcggttacccgttaggttacccgttacggttaaaccccgtaccgggttcctttacgggtcggtaacccggg

SEQ ID NO: 246342 - DNA, 737 bp, Homo sapiens
  misc_feature: GYAE6OF02HTM6F.42.49.E05.1.454.CMB.1.raw
  modified_base (333)..(333): a, c, t, g, unknown or other
  misc_feature (333)..(333): n is a, c, g, or t
  modified_base (434)..(434): a, c, t, g, unknown or other
  misc_feature (434)..(434): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccgaggttcacctggtgcagtctggagctgagctgcagaagcctgggcctcagtgatgtctctgcagtgcttctggtcagtactccgttttaccacctacggtatacgtaacgttggttagtacgaccgtacgggcccccggagacggggcttacggagtaggngtagggagtggactcgacgacccgttaacgaacgtaaaacgaggtaagtagtaggaacggtaggaacgttaccgagggaactaggacgttagactacgtanaccgtacccgggagaacccaactaccgtaaaccccgtaacggtaacgaaccgacccggtaccgttaaaccgaggtaaccggtaaacgttacgggacggtaaacccggtacccgtaactaaccgaggttaaacccgtacggaaccgtaacccggaaacccggtccttaaaccgtttagtaaaccgtcgggtaacccgaggttaaacggtacgttaaggtttataccggtcgtaacggtttcggtacccgttacgggttacctaacccggtaacccgtaaccggtttggttacccggtaccgggg

SEQ ID NO: 246343 - DNA, 542 bp, Homo sapiens
  misc_feature: GYAE6OF02FNBFL.42.49.E05.1.454.CMB.1.raw
  modified_base (387)..(387): a, c, t, g, unknown or other
  misc_feature (387)..(387): n is a, c, g, or t
  modified_base (442)..(442): a, c, t, g, unknown or other
  misc_feature (442)..(442): n is a, c, g, or t
  modified_base (491)..(491): a, c, t, g, unknown or other
  misc_feature (491)..(491): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggggcctcagtgatggtctcctgcagtgcttctggttactatcttttccgacctaccggtatcgaattggttgagtacaggcccccggaggacggggcttaggcgtggagtgggatgggatcagcccttacgaactaaaacgagagtatggagagtaagtccagggcagagtnatcatcacgcggacacatccacgagtacagacctacatcggaactgaggagcctnagtatcagacgacaccgccaacttataactgcgagaacgtgaattagtnactacgtcggtccgttaggcttcgtaacccacggtcgttgtacgggtaccg

SEQ ID NO: 246344 - DNA, 653 bp, Homo sapiens
  misc_feature: GYAE6OF02H8FOD.42.49.E05.1.454.CMB.1.raw
  modified_base (273)..(273): a, c, t, g, unknown or other
  misc_feature (273)..(273): n is a, c, g, or t
  modified_base (523)..(523): a, c, t, g, unknown or other
  misc_feature (523)..(523): n is a, c, g, or t
tcagtgacgtatgtcacgaccggtgctcgatttagagcgactagcaacacacaaaaggggacccaaaaaccacacccctccttgggagaatccctagatcacagctcctcaccatggacgggacctggagcatcctttttcttggtggcagcagacaacaggtcgcccactcccaggttcaccgtggtgctagtctggagctgagtctgcgaagaagccgtggggcctcgtagtgtatggtctaccgtgcgtagtgtcttcgttaggttactnttccttttaccaccgtaacggtagtaggtaagtttggttagagtaacctacggggacccccggaaggacggggtacttggtacggtgggagttaggggtaagtgggtatacacgtaacccgttaacggaaactaaacgaagacgtaagaggagtaaagagttacgagggacaggactacaatcatacgtaccgacgtacacgtacacgtaacgactacagtactaacagtagaacctggtaacgcgactnagtactcgtacgaccgacgaccgtacctaacgttacttaacgtgacgagaacgtagtaactttagcgtaccgtacggttcggtaacctgtacccgtaggtaaccccgaggttcgtacggggtgtacccgg

SEQ ID NO: 246345 - DNA, 805 bp, Homo sapiens
  misc_feature: GYAE6OF02G0Y1E.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtctggagctgagctgcagaacgccgtggggcctcaggtgagtggtctcctgcctagtgtcttcgtgttactattccttttaccaccgttacggtatgtaagtttggttagagaccgtacgggaccccccgggtagggacggggtccgttaggacggttagggaggtaggggtagtacgggtaactaccgtaccggtacccgtttaaaccgggtaaaacttaaaaaccggaaggtaacggtaacgtagggaaggtaagggtaaacggttaccggaacgggtacggtaaggtaacgtacgtaactaccgacgtacccgaacccgggacggaccaacgtaccgtacccgaaccgtaacgtacgaaccgtacccgttaacgtaacggtacggaacgtaacgggaacggaccgtaccgtacgtacggtacgttaccgtacggaacccgtaccggaaccggtaccttaaccgtttacgttaccggtacggtaccgtaacggtaaggtacgtttaactttacggttacgtacccggttacgttaccgggttacccgttacggtacccgttaccggttaaccccgtaccgtttaccgggtttacggggtaccggtaacccgggg

SEQ ID NO: 246346 - DNA, 755 bp, Homo sapiens
  misc_feature: GYAE6OF02FP8QP.42.49.E05.1.454.CMB.1.raw
tcagtgacgtatgtcacgaccggtgctcgattttagagcgactagcaacgacacaaaggggacccaaaaaccacacccctccttgggagaactcccctagatcacagctcctcaccatgggacgggacctggagcatccttttcctggtggcagcgagcaacaggtgcccactcccaggttcacctggtgcagtctgggagctgagctgcagaacggccgtgggggcctcgaagtcgtagtgggtctcctgcagtgtccttcgtgttactattcctttccactacggtatgtaatttcggtagtagacgtacggccccggagaggggtcgttggaggtggtagtcgggtagtgggtacgtcgacgtacccgttaacggaaaccttaaaacgacgaagtagtagggaagtaaggtaaacggttacgagggtacaggtacgtacagtacaacgtccaaccggacgacgaacctacacccgaaacgtacgtaaccgaaccgtacccgtaaagtaccggttaacgggaaacgtttacggaaacgggtacggtaccccttaacggaacggttaccgtaccgtaaggaacccgttaacccggaaccggtacccgtaaaccggtttaactaacccgggtcggtcccgggaagaccggttaacgtagtttaacgtaaccgtacgtaacccggttcggttaacccgttccggtacgttacccgtaaccggttaaccggtttcggttacgggtacgggtacccgg

SEQ ID NO: 246347 - DNA, 626 bp, Homo sapiens
  misc_feature: GYAE6OF02FZGLY.42.49.E05.1.454.CMB.1.raw
  modified_base (617)..(617): a, c, t, g, unknown or other
  misc_feature (617)..(617): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctccgtgcagtgcttctggttactattcgttttccaaccttacggtatcgtaagttggttgacgacgacggccccgggagaggggtcgttaggcgtgggagtgggagtggatccgacggtacccgtaacggaaactaaaacgaggtaacgtacgtagggagaaggtacgttaccggaggcagagtcattacagtccgacgacggacacgaactccaacgacgttaaccacggacctaagtacggagaacgtggagacgtaccgtacgagatacgtacgtacgaccgacgtcccttaacgttacgttactcgaccgacggagtagtattacgttcgaaccgtcgttaccggtaccgtggaccttacggtacctacggtgttaccgggnggtacccgg

SEQ ID NO: 246348 - DNA, 958 bp, Homo sapiens
  misc_feature: GYAE6OF02I6OIW.42.49.E05.1.454.CMB.1.raw
  modified_base (141)..(141): a, c, t, g, unknown or other
  misc_feature (141)..(141): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttnttcggtggcagcagcaacgaggtcgcccactcccaggttcaccgtggtgcagtcgtggagctgagcgtgcagaacgccgtgggcctcgaggtgagttcggtcctccgtcgacgacggttcgtcctttcggtacggtttacctacgttttccttttaccctaaccgtttaaccgggttacttaacggtaacgttttagggtttacgggaacggtaaccggacccgggggaacccccccggggtaggggtaacgggggggttaccgtttaggggtaaccgggttagggggtaaggttcgggggaaggttttagggaacgttaccggtaccggttaacccccggtttaaacgggaaaaacccgtttaaaaaccggaaacggttaaaggttaacggtaaaggggtaaggaaacggttaaacggttacgggaaacgggaccgtaagggtacgtaacgtaactacgtaaacgtacccggaaccgtacggaacctaaccgaacgtacccgtaacggtaacgtaactaaccggaccttaaaccgtaacggtaccggaaacggttaacggtaaccggacggttaccctaaacggtagtacccgtaacgtaacccgggaactaaccccgaaccgggtaaccctttaacgttttaaacccgttaaccgtacgggtacccgtaaaggaacgggtttacgttaaagttttaccgtacgggttaacccgttacccgggttcggttaacccgggttaacggtttaacccttaaccgggttaaccccgttaaccggggtttggtttttacccgggaccgggggtttaacccgg

SEQ ID NO: 246349 - DNA, 656 bp, Homo sapiens
  misc_feature: GYAE6OF02F9RJ6.42.49.E05.1.454.CMB.1.raw
  modified_base (295)..(295): a, c, t, g, unknown or other
  misc_feature (295)..(295): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (458)..(458): a, c, t, g, unknown or other
  misc_feature (458)..(458): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtctggagctgagctgcagaagccgtggggcctcgagtgagtcggtctccgtgcgagtcgtcttcgtggttactattcctttccaccgttaggtatgtaattggttnagtacgaccgggccccggaggacgggtcttggacggtggacgtgggactggactcgacggtacccgttaacggaaactaaacgnggtaagtacgngggaagtaacggtaacgttcgaagggacaggtacgtcgactacgagtacccgacggtacgacctaacnctaccgaacggtacgtaccacggtactacagtacggaactggagacgtccgacgagccgttacgtacgaccgaccgacggtaccttacgtttacgtcgacggtacggagtaggtacttagtttacgtaggcccgttagttccggtcgttacggtacccgttaacgtaacccgtcgtcgggttacggtcggtaaccggg

SEQ ID NO: 246350 - DNA, 661 bp, Homo sapiens
  misc_feature: GYAE6OF02FJ5ZM.42.49.E05.1.454.CMB.1.raw
  modified_base (261)..(261): a, c, t, g, unknown or other
  misc_feature (261)..(261): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccncctacggtatgtaattggttgagtacagggccccccgagagggggcttgagtggacgtgggatgggatcgacgtccccgttaacggaaactaaaacaggagtatggagagtaagttccagggcagagtcatcatcaccgcgacacactccacgagtacagacctacgacgtggaacttgacggtacgccgtacaggactacgtagaaccggaccgaacccgggtaccctaacgttttaaccgtaccgttacggtccggtaccggtaacggtacgtaactttaacggtttaacggaccgtaacccggtttcgggggttaccccttagggggttacccttaccggggttaaaacccccgttaccgggtaccggttttacggggtacccggggttaaccccgg

SEQ ID NO: 246351 - DNA, 637 bp, Homo sapiens
  misc_feature: GYAE6OF02GHBM6.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctccgtgcagtgcttctggttacacttcttttccacttacggtatgtaattggttgagacacgggccccggaggaggggcttggagtggagtgggagtggatcgacgtacccgttaacggaaactaaaacgagagtaagtagggagaaggtacgttaccgagggacgagacgtcataccatccgaaccgcggaacaccactccgaagtagtaaccgacgaccttaacagtacggaacgtaggaggacgacctagacgtactacgtacgaaacccggtccgtaacccggaccttaccttaagttaccacggacgtacgaagtacgtagttttagtcgaccgttaccgttcggtaccgttgggtaccttaccggttaacccgacggttacgtttaccggagggtacccgg

SEQ ID NO: 246352 - DNA, 740 bp, Homo sapiens
  misc_feature: GYAE6OF02J0IHX.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacgccgtgggcctcagtgatggtcctcctgctagtcgcttcgtggttacacttctttaccaccgttacgtatgtaacttggttagagactacgggccccggtaaggtacggggtcttacggtaggtacggtaaggtcgggtaagtcgggtaacttcgaaccggtaccccgttaacggtaaacgtaaaacgaggtaagtagtagggtaacggtaacggtaacggtttacccggaagggacgtaacggtagttacgaacgtactaacggtaccgaacccgggtacgtaaccctactaaccgtacccgtaaacggtaaccgtaaccgtacgtacccgtaacgacggtaacggtaaccgttagggaacggaccggtccgttaacgacgtacgttaccggacgtaaccggtacccgtaaccgtaccggtaaccttttacggtaaccgtacgggaccggtaaccgaacgtagttacgtttaacgtgtaccgtagtacccggtgacgtccgtacgtaccgtagtcgttcggaggtacccg

SEQ ID NO: 246353 - DNA, 750 bp, Homo sapiens
  misc_feature: GYAE6OF02JAY1O.42.49.E05.1.454.CMB.1.raw
  modified_base (167)..(167): a, c, t, g, unknown or other
  misc_feature (167)..(167): n is a, c, g, or t
  modified_base (202)..(202): a, c, t, g, unknown or other
  misc_feature (202)..(202): n is a, c, g, or t
  modified_base (398)..(398): a, c, t, g, unknown or other
  misc_feature (398)..(398): n is a, c, g, or t
  modified_base (495)..(495): a, c, t, g, unknown or other
  misc_feature (495)..(495): n is a, c, g, or t
  modified_base (522)..(522): a, c, t, g, unknown or other
  misc_feature (522)..(522): n is a, c, g, or t
  modified_base (563)..(563): a, c, t, g, unknown or other
  misc_feature (563)..(563): n is a, c, g, or t
  modified_base (580)..(580): a, c, t, g, unknown or other
  misc_feature (580)..(580): n is a, c, g, or t
  modified_base (587)..(587): a, c, t, g, unknown or other
  misc_feature (587)..(587): n is a, c, g, or t
  modified_base (631)..(631): a, c, t, g, unknown or other
  misc_feature (631)..(631): n is a, c, g, or t
  modified_base (663)..(663): a, c, t, g, unknown or other
  misc_feature (663)..(663): n is a, c, g, or t
tcagtgacgtatgtcacgaccggtgctcgatttagagcgactagcaacacacaaaggggacccaaaaaccacacccctccttgggagaatcccctagatcacagcctcctcaccatgggacgggacctggagcattcctttttctgggtcggcagcaacgctaacgnggtcgcccacctcccgtaggttccaccgtgggtcncgtaggttcgtggacgcgtaggtcgctcggacgacggtaccgtccggtcgggcctagagtcgtagtcgttacctcgtggcgtagttcgtccgttacgttacggttacctccttttccggttaacccgtacgtggttactaggttacgttgtcgaaccgccggacccgggacggtagggtggtttcgagggttaggnggtaagggtggtactcggtacctaccggttaaccgtaaccgttaaacggtaaacaaggtggagtagtacgggaacttaggaacggtcgaagcgtacntactagcccgtagaccggtacacgtanacccgagtacgaactcctaacgactacgaagtccggtaaancggtaacgagtacccgngttaacncggtacgaaccgtccggaaacccgtcgtaacgttaccgtttaanccgggttaacgacggacgggtaattaccggtntttaaggcccgtggtaacgtttcccgtacggttaactacgggtacccttagggcccctttaggtttcgggcggtacgtaacccgggg

SEQ ID NO: 246354 - DNA, 796 bp, Homo sapiens
  misc_feature: GYAE6OF02I950H.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagagccgtggggcctcagtgatggtcctcctgctagtgtcttcgtggttactacttctttccaccgtacggtatgtaagttggttagacgacgaccggggcccccggaggtacgggggtcgttcggtaggtagggtaggttacgggaggttgggaacttcgacggtacccgttaacgggtaaactaaaacgaggtacgtaggtacggaagtaaggtaacgtttaccggtagggacgtaacgggtaacgtaccgtaactacgtacgttaccgacccgggtaaccggggaactaacccggtaacctacccggtaacggtaaacggttacccgtaaccggtaaccgttaaccgaacggttaaccggggtaacgttaccgggaaagggtacccgtaccgtacgggtaaccaacgttccgttacgaacccggaaccgtacccggtaaccgtaacgtttaaccgttaccgtacggtacccgacggtacgtaacggtttacgttacggttcggtaacccgttaacggttccggttccggttaccgtacggtttaaacggtaccccgttaacgggcgttttaccgggaccgggttaacggg

SEQ ID NO: 246355 - DNA, 700 bp, Homo sapiens
  misc_feature: GYAE6OF02I2I3L.42.49.E05.1.454.CMB.1.raw
  modified_base (519)..(519): a, c, t, g, unknown or other
  misc_feature (519)..(519): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgctagtgcttctggttacattccttttaccaccttacggtatgtaagttcggttagagacgtacggacccccggaggtagggggcttggaggttcgggagtgggagttgggaatccgtacgtacccgttaacgggtaaaactaaaacgaagtacgtaagtacgggaagtaagaaacggttcgaagggtacaggtacgtacgactacagtaccaccgggtccgaactaacacttacgaaccggtagacgtaacacctaagaacctaggaaccgttagacggtaacnccgtacgactaacgtcgttacggaaccgtcgaacccggtacttaaccgttttatttaaccgtaccggtcgggaaccgtaacgggtaacttaaggtttaacctcggacctttaaccggttcgttaccgaccgggttaccttaccggttaaaccgacggttaccgtttcgggtggtacccggg

SEQ ID NO: 246356 - DNA, 662 bp, Homo sapiens
  misc_feature: GYAE6OF02IXPLR.42.49.E05.1.454.CMB.1.raw
  modified_base (501)..(501): a, c, t, g, unknown or other
  misc_feature (501)..(501): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcaaatccttttcttggtggcagcagcaacaggtgcccactcccaggttcacctggtgcagtctggagctgagctgcagaagccgtgggcctcagtgagtgtctctgcagtgtcttcgtggttactattccttttaccaaccgttacggtactagtaagttggttagacgtacgacggcccccggaggacgggggtcttacggtaggttggaacgttggggtaagtggacttacgacggtaccccgttaaacggtaaacctaaaaacgagtaagtaagtagggaagtaaggtaacgttaccggagggacgaagtacgtacgatacacgtacgaccgacgacacacgtaccgaacgacgtaacacgacctaanagtacggaactggaacgtacgaccctagacgtactcgtagtaaccgaccgtaccggactaaccgttaacgttaacctcggaccgacgaaggtactaagtttacgtcgtactacgtcggtaccgtgtccttaacggtaaccaccgttcgttgagggtaccgg

SEQ ID NO: 246357 - DNA, 800 bp, Homo sapiens
  misc_feature: GYAE6OF02HR53B.42.49.E05.1.454.CMB.1.raw
  modified_base (259)..(259): a, c, t, g, unknown or other
  misc_feature (259)..(259): n is a, c, g, or t
tcagtgacgtatgtcacgaccggtgctcgatttagagcgactagcaacacacaaaggggacccaaaaaccacacccctccttgggagaatccctagatcacagctcctcaccatgggacgggacctggagcatcctttcttggtggcagcagcaacaggtgcccactcccaggttcacctggtgcagtctggagctgagctgcagtaagccgtggggcctcgagtgatggtctcctgctagtcgtcttctgggttaacngttccttttaccgtaccttacggtattacggtaagttgggttagagtaaccgacgggtaccccccgggaggtacgggggtactttacgggacgggttacgggtaggtcggggtaagtgggtaacgttaccgtaacggtaccccggtttaaccgggtaaaacttaaaaaccggtaacgggtaagttaacggtaacgggggtaaaggtaacgggtaaacgggtttacccgggaaggggtaaccggtaacggtaacgggtaactaaccgttaacgtaccgttaccgggaacccggttacccgggaaacgtaccggtaactaaccccgggtaactaaccgggttaaacccacgggtaccccgttaaacgaacggtttaaccggaaacggtcgggtaacggtacggtacctacgacgtacgttcgtaacgacgaaccgacgaccgttaacttacgttcgagtaccgctaacgatacgttagtcgacctacggtcggttccgcggttacgtacgtaaaccgttcggtacgttcgggtaggtcccggg

SEQ ID NO: 246358 - DNA, 674 bp, Homo sapiens
  misc_feature: GYAE6OF02ILLAC.42.49.E05.1.454.CMB.1.raw
  modified_base (523)..(523): a, c, t, g, unknown or other
  misc_feature (523)..(523): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccacctggtgcagtctggagctgagctgcagaagcctggggcctcagtgagtggtctccgtgcagtcgcttcgtggttacattccttttccaccttacggtacttgtaatttggttgaacgtaccacgggcccccgggtagacgggggtctttggaggttgggagttggggaatgggactcgaacgtccccgttaacggaaactaaaacgtagaaggttagtagggaagtaggtaacgtttaccggaagggtacaaggtacgtacacgtacgagtccaccggacggaccacgtactaccgaacgacgtacacgtccaacagtaggaactgggaaggacgtccagtanacttcgtaggaaccgtacgaccggaccttaacttacgttacgtcggacgacgtaagacgttacttttacgtcggtaaccgtacggttccggttaccgtaggtcccgtttaacgggtaccctacgggttccgtttacgggtcggtacccggg

SEQ ID NO: 246359 - DNA, 596 bp, Homo sapiens
  misc_feature: GYAE6OF02HKTC2.42.49.E05.1.454.CMB.1.raw
  modified_base (438)..(438): a, c, t, g, unknown or other
  misc_feature (438)..(438): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattcttttccacctacggtatgtaattggttgagacgacggacccccggagacgggggcgttggaggtgggagtggggagtggatcacggcccgttaacgggaactaaaacagaagtagtaggaagagaagttaccgagggacagagtcagtcatcacggcgacacatccaacgagtacagacctanacgtagaacgtggagagcctacagactcgtagaccgtacgaccggtacctaactttaacttaccgtcgaccggacgagacgtaagtttacgttggcttacgtcggttccggttgaccgttacggtaacctacccggtacgtttacgggtaggtaccgg

SEQ ID NO: 246360 - DNA, 753 bp, Homo sapiens
  misc_feature: GYAE6OF02JLP7Q.42.49.E05.1.454.CMB.1.raw
  modified_base (202)..(202): a, c, t, g, unknown or other
  misc_feature (202)..(202): n is a, c, g, or t
  modified_base (619)..(619): a, c, t, g, unknown or other
  misc_feature (619)..(619): n is a, c, g, or t
  modified_base (745)..(745): a, c, t, g, unknown or other
  misc_feature (745)..(745): n is a, c, g, or t
tcagtgacgtatgtcacgaccggtgctcgatttagagcgactagcaacacacaaaggggacccaaaaaccacacccctccttgggagaatcccctagatcacagctcctcaccatcggacgggacctggagcactcctttctggtggcagcagcaacaggtcgcccactcccgaggttcaccgtggtgcctaggtctggganctgagctgctagacgccgtcggggcctcaggtcgagttcgggtctcgtagcgtaggtgtccttgtcggttacacgtttcctttacccacgttaccgggtattaggtaacgtttgggttcgaacggtaccgtaccggggcccccggtaagggcggggttctacggtacggtacggacgggttcgggtaacgtcgggtaacgtccggtaaccggtaccggttaacggtaaaactaaaccgaggttaacgtaggttacgggaacggtaaggtacggttaaccggaagggtacgtaaggtacgtactacgacgttaacgacggacccgtagggaacctaacgtaccgtaccggaacggttacgtaaccgacggtacccaacgtcgtaacggtagtacggacggacgtaccctaggtaactntacgtccgaacgaccgtccgtacctaagttcccgttagcgaccgttcgaacgtgtacttcggtacgttaccgacggttcggtcccgtaggtacttaaccgggtacccttagggtcgtttacggggnacccgggg

SEQ ID NO: 246361 - DNA, 681 bp, Homo sapiens
  misc_feature: GYAE6OF02JEN67.42.49.E05.1.454.CMB.1.raw
  modified_base (661)..(661): a, c, t, g, unknown or other
  misc_feature (661)..(661): n is a, c, g, or t
tcagtgacgtatgtcacgaccggtgctcgatttagagcgactagcaacacacaaagggacccaaaaaccacacccctccttgggagaatcccctagatcacagctcctcaccatgggaccgggacctggagcattccttttctggtggcagcagcaacaggtgcccactcccaggttccaccgtggtcgctagtcgtggagctgagctgcagacgccgtgggcctcagtgagtggtctcgtgcagtgcttcgtggtactattcctttaccaccgtacggtatagtaagttggtgagaccgacggtccccgggaggtgggtcgttaggacggtaggacggtagggagtaggtacgtacgaccgtacccgttaaacggtaaaccgaaaaacgtacggagtaagtaggaagtaagtacgtcgaaggagaggtatataactacgacgtaccgacgacgtacgaaccacgtacccgaacgaatacccgaagtaccctaaacgacgtagaaaccgttgggaacgtaccgaccgtacgtactacggttcacggaaccgtaacccgaacggtaacccttaactttacgtaaccgtacggcgaaccgtaagtacggttaattacccgttgaccgtaacccggttcgtaccgtggtaccctaggttaaccnccggtagttcgacggtaccg

SEQ ID NO: 246362 - DNA, 596 bp, Homo sapiens
  misc_feature: GYAE6OF02H5MWR.42.49.E05.1.454.CMB.1.raw
  modified_base (252)..(252): a, c, t, g, unknown or other
  misc_feature (252)..(252): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacnttcttttccacctacggtatgaattggttgagtacacggcccccggagacggggtcttggacggtggagtagggatggatcgacgccttacgaaactaaacgagagtagtggagagaacgtccaggcagagtacatacatcgaccgcgtacactatccaacgacgtacacgtcctagtagtacggaactcggaggacgccttacgagacgtacgtacgaaccgaccgacgtacccgtaacgtttaactcgtacggcgtacggaatagttacttagttcgacctacgtacggttcccgtcggtacgtaccggttaaccctacggtcgtttcgggtacggtaccgg

SEQ ID NO: 246363 - DNA, 707 bp, Homo sapiens
  misc_feature: GYAE6OF02IBG18.42.49.E05.1.454.CMB.1.raw
  modified_base (326)..(326): a, c, t, g, unknown or other
  misc_feature (326)..(326): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacaggtcgcccacctcccgaggttcacctggtgcagtctggagctgagctgcagagccgtggggcctcgagtgagtggtctcctgcagtgcttcgtggttacattccttttccaccgttacggttatagtaagtttcggtgaacggacgaccgggacccccgggtaaggngggggtccttaggaggtggtagtaggggagttggacttaccgacggtaccccgtttaaaggaaaccgttaaaaacgagggtaagtaacggtagggaacggtaaggtaacgttaccggagggactaacggagtacgtctaacgacgtccggacgacggtaacacgaacgtaccgacgtagtacagtacctacgagtacggaaccttaggaacggtacaccgttagacgtacgttacgcggaaccgaaccgtccggaccttaagttacctttaacgcggaaccgtcggtaagtaacggttactaccgttacgaccgttagtaccggtccgtacggtaccgtaaccggttaaccgaccggtcggtttaccgggcggtaaccggg

SEQ ID NO: 246364 - DNA, 641 bp, Homo sapiens
  misc_feature: GYAE6OF02HJ3HX.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctgtacattctttccactacgtatgaattggttgagacgacggccccggagaggggtcttggaggtggagtgggatggactcgacgcccgttaacggaactaaaacgagtacgtagtagggaagaagtaaggttaccgagggactaggacgtacaagtcagtaccgaccgggacgaacactaactaccgaacgaagtaccagacccgtaacagtaggaaccttagggacggacgtccttacgaacgtactacgtacggaaccgacccggtacggacccttaacgtttagtaccgttgacccgagtaagtacgtaatttacgtcgtccgtacggttccggttaccgtagggtaccttaaccgggtaaccgtacggttacgtttacgggacggtacccgg

SEQ ID NO: 246365 - DNA, 644 bp, Homo sapiens
  misc_feature: GYAE6OF02HOWSQ.42.49.E05.1.454.CMB.1.raw
  modified_base (239)..(239): a, c, t, g, unknown or other
  misc_feature (239)..(239): n is a, c, g, or t
  modified_base (322)..(322): a, c, t, g, unknown or other
  misc_feature (322)..(322): n is a, c, g, or t
  modified_base (441)..(441): a, c, t, g, unknown or other
  misc_feature (441)..(441): n is a, c, g, or t
  modified_base (459)..(459): a, c, t, g, unknown or other
  misc_feature (459)..(459): n is a, c, g, or t
  modified_base (501)..(501): a, c, t, g, unknown or other
  misc_feature (501)..(501): n is a, c, g, or t
tcagtgacgtatgtcacgaccggtgctcgatttagagcgactagcaacacacaaagggacccaaaaccacaccctcctgggagaatccctagatcacagctcctcaccatggacgggacctggagcatccttttcttggtggcagcagcaacgaggtgcccacctcccacggttcaccgtggtgcagtcgtggagctgagctgcgagacgccgtgggcctcgagtgatggtctcctagnaggtgtcttcgtggttacattccgttttccaccgtacggtatagtaagttggttgacgacgacggaccccggaggacggggtnttggagtggagtgggacgtggtagtacacgtccgttaacggaaactaaaacgagtaagtagtggagtaagtacgtacgaggtacagagtcaagtcgaacgacgaccgtacggactaacncgtaaccgagaccgtaanacggtaacctagacgtaggaacgaggtacggacgtaccgtanaggactacgtacggaaccgtacgaccgaaccgttaacctttagttacgcggaacgccgaaggtacgttaatagttcgtacgtaccgtcggtacccgtgtacccggttaacgtaaccgtcccggtagttacggttaggaaccgg

SEQ ID NO: 246366 - DNA, 688 bp, Homo sapiens
  misc_feature: GYAE6OF02GORQ2.42.49.E05.1.454.CMB.1.raw
  modified_base (263)..(263): a, c, t, g, unknown or other
  misc_feature (263)..(263): n is a, c, g, or t
  modified_base (603)..(603): a, c, t, g, unknown or other
  misc_feature (603)..(603): n is a, c, g, or t
  modified_base (612)..(612): a, c, t, g, unknown or other
  misc_feature (612)..(612): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttccacctggtgcagtcgtggagcgtgagctgcaggaagccgtggggcctcgagtgagttggtctccgtgcagtcgtcttgtggttacncttcctttaccgaccttacggtatacgtaagtttggttagaacggacgaccgggtcccccgggaggtacgggggtaccgtttgggaggttcgggtaggtaggggtagttgggactacggaccgtcccgttaaacggaaaacctaaaacgtaggagtaaggtaggaagtaacgtaacggtaccggagggtacaagggtactacgtatcgtaacgtccgaaccggcgaaccgactacgtaaccgaccgtacgtacgacgtaccgtaataacggtacggtaagttacgaggtacgcctagactacgacgtacgaacgtaccgacggtacctaacgttgttacncgacggtanaggtagttactagtagtacgtacgtaccgttcgtacgtacgttacgtaccgtaccgtcggtacggtcggtaccggg

SEQ ID NO: 246367 - DNA, 677 bp, Homo sapiens
  misc_feature: GYAE6OF02G3TQ9.42.49.E05.1.454.CMB.1.raw
  modified_base (195)..(195): a, c, t, g, unknown or other
  misc_feature (195)..(195): n is a, c, g, or t
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctgganctgagctgcagaagcctggggcctcagtgatggtctcctgcngtgcttntggttatnttctttccactacggtatgtaattggttgagacgacggccccggaggacggggtcttggagtgggagtggggagtggatcgacgtacccgttaacggaaaccttaaaacgagtacgtaagtagggaagtaaggtaacgtttccgaagggcaaggtagtacgataccgtataccgaacccggacggaacctaacctactacccgaacggaacgtacgacgtaccctaacgtacgtacggaactacgggaggtacgaccgtacgagtacgtcgtacgaccggaccgaccgggtccttaacgtttaacgtttaccgacggtacgggacgtaagacggttactttacgttcggacttaccggtcggttaccgttacggtcgttaacccggtaccgtaccgggttacgtttacggggtcggtaacccggg

SEQ ID NO: 246368 - DNA, 842 bp, Homo sapiens
  misc_feature: GYAE6OF02FZMGB.42.49.E05.1.454.CMB.1.raw
  modified_base (163)..(163): a, c, t, g, unknown or other
  misc_feature (163)..(163): n is a, c, g, or t
tcagtgacgtatgtcacgaccggtgctcgatttagagcgactagcaacgacaacaaaggggacccaaaaaccgacacccgtccttgggagaatcccctagatcacagcctcctctaccattggacgggaccttggagcagtccttttcttggtggtcagcagnaacaggtgccactcccacggttcacctggtgctacgtcgtggagcttgtagccgtggacgaacggaacgcccgtaggggcctaccgaggtgaagttcggtactccgtagtacctagttcgtccttacttcggtaactagttcctttaccgtaccgttaacggttagttagtaacgttggtagaacggaccaccgggacccccggaggtacgggtaccttaggacggtaggacgttagggtagttaggtacgtacgtacggttaccccgttaaacggtaaaccggtaaaaccgtacgggtaacggtacgttacgggaaggtaacggttacggttaccggaagggtacgtaaggacggttactaatacgtacgtaccgacccggtaccgaacctaaccgtactaaccccgtaacggtacgttaccgaacgtacccgttaacaaacggtaggtaaaccgtagggaccggtactacccgttacgtaacgttacgtacccgttaaggacctaaacccggtaccgttaaccttaaccgttttaacttacggttaccgtccggtaaacgtaccggttacgttaacggtttaaccgtcgggtaaccctaccgggtttacgggtcctttaaggcccggtttaaccggtaaccgtacggttaccggtttaggggtaccggtaccccggg

SEQ ID NO: 246369 - DNA, 655 bp, Homo sapiens
  misc_feature: GYAE6OF02JB7HA.42.49.E05.1.454.CMB.1.raw
  modified_base (196)..(196): a, c, t, g, unknown or other
  misc_feature (196)..(196): n is a, c, g, or t
  modified_base (510)..(510): a, c, t, g, unknown or other
  misc_feature (510)..(510): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttcacctggtgcagtctgganctgagctgcagaagcctgggcctgagtgatcggtctcctgcagttgcttcgtgttacacttctttccacgtacgtatgtaagttggttagagtacgacgggccccggaggacggggtcttggcggtaggtagtgggaggtgatcgagtacccgttacggtaaacgtaaacaggtaacgtagtaggaagtaggtacgttacggagggctaagtacgtacagtaccagtaccgaccggaccggactaaccgtaactaccgaacgacgttaccgacgtacctaacgtacgtacgaacggtaggacggtacgccgtanacggtataccgtgggtaaccacccgaacggtaccctaactttaacgttacgtcgaaccgtggaagtcgtaaatttgtcgtcctaggttcccgtcgttacggttccgttaacggtacccgtaccggtgttacgggaccgtaccggg

SEQ ID NO: 246370 - DNA, 763 bp, Homo sapiens
  misc_feature: GYAE6OF02FZ7AB.42.49.E05.1.454.CMB.1.raw
  modified_base (244)..(244): a, c, t, g, unknown or other
  misc_feature (244)..(244): n is a, c, g, or t
  modified_base (730)..(730): a, c, t, g, unknown or other
  misc_feature (730)..(730): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttntggttacattcttttcccacctacggtatgtaagtttggttgagtacgacgggacccccggaggacgggggtcgttggaggtgggagtggggagtgggagtcgacggtaccccttaacgggaaacctaaaacgagaaggttaagtagggaggtaagtaaacgttacccgaaggggacaaggtacgtactacgtactaacgttacccgaacccggtaccggaaccgaaccgtaacgtaaccccaaacggtaacggtaaccgaacggtaccctaaccggtagtaacgggaaaccgttagggtaaccgggtacggtccctttaacgacggtaacgttaccggttaacggaacccggaaccgtaacccggggaccttaaaccttttaacgttaacccgtcggtaccggtaccggtaaggtaacgtaagttttaacggttggtacctacggttaccgggttcccgttagggtaccgttacggttaaacccncggttaccggttttaccgggtagggttacccgg

SEQ ID NO: 246371 - DNA, 678 bp, Homo sapiens
  misc_feature: GYAE6OF02JRAWR.42.49.E05.1.454.CMB.1.raw
tcagtgacgtatgtcacgaccggtgctcgatttagagcgactagcaacacacaagggacccaaaaccacacccctccttgggagaatcccctagatcacagctcctcaccatggacgggacctggagcatcctttcttggtggcagcagcaacaggtgcccactcccaggttccacctggtgcagtctggagctgagctgcagaagccgtggggcctcgagtgatggtcctcctgccagtcgcttactggttacacttcttttacccaccttacggtattagaatttggttgacgtacgcggtccccccggtaggaggggtcttacgaggttggagtgggagtggtactacgacgtacccgttaacggtaaaccgtaaacgtacggtagtagtacggagacggtaacgttccggaggtacgagtacgtacgtatacgacgtacgaccgtacggactacgacgttaccgacgacgtaacgacgtacctacgagtacggacgttacgagggacctccgtaacgagtaccgtacacgggtaaccgaccgacgggacccttaacgtttaacgtaccgttacgcggtaccgtaagtacgttaagttacgttacggtactacgggtacgttccccggtaggaccttccgtaaaccgcccggttagttcgggtacggtaacccgg

SEQ ID NO: 246372 - DNA, 695 bp, Homo sapiens
  misc_feature: GYAE6OF02IDGOT.42.49.E05.1.454.CMB.1.raw
tcagtgacgtatgtcacgaccggtgctcgatttagagcgactagcaacacacaaaggggacccaaaaaccacacccctccttgagagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttactattcttttccactacggtatgaattggttgagactacgggcccccggaggacgggggtcttggaggttgggacgttggggacttgggaatccgaacggtaccccgtttaaacgggaaaccttaaaaacgaggtaaggtaagtgggaaaggaaggaacggtttacccgaaggggacctaaggtaacgtcaagttacgaagttacccgaaccggacgggaaccaaccgaactacccgaacggaacgttaaccacggtaccctaacgaagttacgggaaaccttagggaacgggtaccgcccgttaacgaagaacgttccgtaacggaaccgaaccgtaccggacctaaccgtttaactaaccgtcggacgacgtagaaggttactttagtacgacgtaccgtaggtccgtgacgttaccgaacgtaccggtccgttaggtacggg

SEQ ID NO: 246373 - DNA, 774 bp, Homo sapiens
  misc_feature: GYAE6OF02JPLT9.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagacgcgtgggcctcgagtgagtggtcctcctagctagtcgtcctttcgtaggttactattccttttacccgaccgttacggttatacggtaagtttggttaggacgtacgaccgggtacccccgggaggtacgggggtacgttaggacggtaggtaaggtggggtagttacgggacttacgaccggttaccccggttaacggaaaaccgtaaaacgaggtaaggtaacggttaaggggaaacggtaaggttaaaccggttaccggaaggggtacgaacgggtacgtaccgtaacgttaccgtaacgtaccggaacccggaccggaacaaccgtacgtacccgtaaggtaccgttaacgacgtacccgtaagtaacggtacggaacggttacggaacggtacgtaccgtaacgtacgtacgttacgacgtaaccggaacgaccgtaccgtaccgtttaacgtccgtaacgtaccggacgtaacggtacgttacgttacgtacccgtacgtaccgtccggtaacgttcggtaccgtaccgttaccgacggtttcgtacggtaccggtaccgg

SEQ ID NO: 246374 - DNA, 702 bp, Homo sapiens
  misc_feature: GYAE6OF02G9PWH.42.49.E05.1.454.CMB.1.raw
  modified_base (253)..(253): a, c, t, g, unknown or other
  misc_feature (253)..(253): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagtggtctcctgcagtgcttctggttanattcttttccacctacgtatgtaagttggttgacgtacacgggtcccccggaggacggggcgttcggagtgggtacgtggggagtgggtacgtcctacgtaccccgttaacgggtaaactaaaacgacgaaggttaacgtagggagaacggtagttaccgacgggtagagtaggtactaacgttacgataccgaacccggccggaaacgactacgtcccgaacgaacgtaaccgacgtaccctaacgtacgttacgggaacgtggaagggtaccgtcctacgtaaggctacggtacgaccgtaacgacccggtccctaacttttaacgtccgaggcggaccggtaatacgggttaactttacggtacgtaccttacggttcccggttaccgtaggttaccgttacccggtaacccgtacccggttacgtttcgggtacggggtacccgg

SEQ ID NO: 246375 - DNA, 783 bp, Homo sapiens
  misc_feature: GYAE6OF02GQJDV.42.49.E05.1.454.CMB.1.raw
tcagtgacgtatgtcacgaccggtgctcgatttagagcgactagcaacgacacaaaggggacccaaaaaccacacccctccttgggagaatcccctagactcacagctcctcaccatggacgggacctggagcatccttttcttggtggcagcagcaacaggtgcccactcccaggttcacctggtgcagtctggagctgagctgcagaacgccgtggggcctcgacgtgatggtctcctgcagtgcttcgtcgttacacttcgtttccaccgtaacggtagtcggtaagtttggttagacggtacgaccgggtacccccggagggtacggggtcttggtaggtcggagtcgggacgtggtacgtcgtacgtacccgttaaacggaactaaaacgacggtaacgtagtacggaagtaggaacgttacggagggacaggtacgtacactaccgactaccgaccggtacggaccaacgtaccgtaccgaaaccggtaacgttaaaccgacggtaacccgttaaacgtaacggttaaccgggtaaacggttaaccgggtaaacgggaacccggttacccgtaacggtaacggtaacgttacccgttacgggaacccgtaaccgacccgggttaaccctaaaccgttttaacgtttaccgtacggaccggtaaccgggtaaggtacgtttaacgtttaaggttaccgtaaccggttaaccgttcgggtaccgttcgggtacccgtttaacggaacccgtaggttccggtttagggtccgggtaccgg

SEQ ID NO: 246376 - DNA, 778 bp, Homo sapiens
  misc_feature: GYAE6OF02F0IL1.42.49.E05.1.454.CMB.1.raw
  modified_base (195)..(195): a, c, t, g, unknown or other
  misc_feature (195)..(195): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctgganctgagctgcagaagcctgggcctcagtcgatggtctcctgcagtgcttctggttacattctttccactacggtatgtaagttggttagagtacgacgggtacccccgggaggaacgggggtccttagggaaggttgggaagttcggggagtgggtactcgtacgtacccgtttaacgggaaacctaaaacgagtaacggtaggtacggaaggtagtaacggttaccgaacggggactaaggtaacgtctaacgttaccaacggttacccgaaccggtacggaacccgtaacgaaccgttaccccggaacgtaacgggtaaaccaacggtacccgtaaccgtaacggttacgggtaaaccgtacgggtaacggaccggtacccgttaacggaagtaaccggttaccgtaacggaaccggaacccgtaacccggttacccgttaaaccgttttacgttaacccgtcggtaccggtacccggaagttacgtaaacgttttacgtaccggacgttaaccggttccggtacccgttcgggaccttaccggttaaacccgtacgggttccttacgggtcgggtaaccgg

SEQ ID NO: 246377 - DNA, 737 bp, Homo sapiens
  misc_feature: GYAE6OF02F9JLO.42.49.E05.1.454.CMB.1.raw
  modified_base (246)..(246): a, c, t, g, unknown or other
  misc_feature (246)..(246): n is a, c, g, or t
  modified_base (301)..(301): a, c, t, g, unknown or other
  misc_feature (301)..(301): n is a, c, g, or t
tcagtgacgtatgtcacgaccggtgctcgatttagagcgactagctaacgtacacaaaggggacccaaaaaccacacccctccgttgggagaatcccctagatcacagctcctacgaccatggacgggaccctggagcatcctttacttggtggcagcgagcaacaggtgcccactcccgaggttcacctggtgcacgtcgtggagctgagctgcagaagccgtgggcctcagtgatggtctccgngccagtgcttcgtgttactacttctttccaccgttacgtatgtaagttgggttanacgacgacggacccccggtaggaacggggtcttaggagtggatgggagtgggatacgacgtacccggttaacgaaacctaaaagacgtaagtagtaggaagtaacggtacgtacgagggtacaggacgtacgaatcgtaactcccggacggttaccggaacgacctacgttaccgaacggtacgtaaccgacgacccgtaactaggtaccggtaacttagggacggaaccgtcccctacgtaacgtacgtaccgtaaggacccggtacgacccggtaccgtaacctttaaccgttactccgggaaccgtcgtaaacggttacgtaacgtttacgtacggtaccggtaaccgtttacgggtacccggttaacggttacccgttaaccggtaacccgttaaccgggttcgggtttacgggaccgggttaaaccccggg

SEQ ID NO: 246378 - DNA, 821 bp, Homo sapiens
  misc_feature: GYAE6OF02IICND.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctccgtgcagtcgtcttcgtaggttactagttccttttccaccgttaccggtattacggtaagtttggttagacggtaaccgacggggccccccgggtaggtacggggggtaccttagggtacggttggggtacgttggggtaacgttgggacgttccgaaccggttaccccgtttaaaccgggtaaaaaccgtaaaacgtaacgggtaacgttaacggttagggtaacgggtaacggtaacggtttaccggaaggggacgtaacgggacgtaccgtaactaccgtacgtaccggtacccggacggtaacctacgtaaccgtacccggaacggtaaacggtaaccgtaacgtaacccttaacgaacggtacggtaaacgtacgggtaacggaccgtacccttaacgtacggtacttacggtacggtaaccggtaccgtaccgggtaacccttaacgtttaccgttaccggtaggtacccggtagtaacgggtagttacgttttacggtcgttaccgtaccgggttacggttaccgttcgggtaccgttacggttaacccgtcgggtttaccgttcgggtacgggtacccggg

SEQ ID NO: 246379 - DNA, 658 bp, Homo sapiens
  misc_feature: GYAE6OF02GKPS2.42.49.E05.1.454.CMB.1.raw
  modified_base (272)..(272): a, c, t, g, unknown or other
  misc_feature (272)..(272): n is a, c, g, or t
  modified_base (334)..(334): a, c, t, g, unknown or other
  misc_feature (334)..(334): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccactcccaggttccaccgtggtgcagtcgtggagctgagctgcaggaacgccgtggggcctcgaggtgagttcgggtcttccgtgcaggtcgtcttcgtgttactntttcctttccacgttacggtatagtagttggtagagacgccggcccggaggtgggtcgtggnggtaggagtgggatggatcgacgtaccgtaacgaaactaacgagtacgtagtaggaagtaacggacgttccgagggcaaggtacgtctagtacgtaactccgaacccggacgaacctaacgtactacccgaacgtacgtacgaacctaccgtaacgtagtaacggaagtacgggacggtacaccctagacgtaccacggtacgaccgtaaccgaccgttacctactttaacgtacgtccggacgacgtagttatagttagtcgtcttacggtcgttaccgtcgcgttaaccggtacgtacggttggttaccggcgggttaccgg

SEQ ID NO: 246380 - DNA, 823 bp, Homo sapiens
  misc_feature: GYAE6OF02G2IX8.42.49.E05.1.454.CMB.1.raw
  modified_base (197)..(197): a, c, t, g, unknown or other
  misc_feature (197)..(197): n is a, c, g, or t
  modified_base (551)..(551): a, c, t, g, unknown or other
  misc_feature (551)..(551): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgccccactcccacggttccacctggtgtcagtcgnggagcgtgagctgcagacgccgtgggcctcgtagtgagtcggtctcctgcgtagtcgtctttcgtaggttactactttccgttttcccaccgttaacggtatacgtaagtttcgggttagactaccggaccgggtccccggaagggtacggggtcttaggagggttacgggtaaggtagggtacgttacggacggttaccggtaacccggttacccggttaaaacccgggtaaaacttaaaaaccggtaaggtaacggttaacggtaaggggtaacggtaaacggtaaaccggtttacggaacgggacggttaacgacggttacgaacttacgacgttaccgaaccgccggaanaccgactaaccgacgtacgtaacacggtacctaacgaggtaccgaaagtcgggaacgtaccgccgttaagaacccgttttaagggcctaacggggtaaccctacccgggtaaacccgttaccgtttaaacccggttaagttttacccacgggaccgtaaacgtaacggttagttaaacggttcccgtttagggacccgttaacccggttccggtacggtaccgttaacgtttacccgggaaccttacggtcgggtttacgacgggtacccgg

SEQ ID NO: 246381 - DNA, 666 bp, Homo sapiens
  misc_feature: GYAE6OF02IUBAC.42.49.E05.1.454.CMB.1.raw
  modified_base (422)..(422): a, c, t, g, unknown or other
  misc_feature (422)..(422): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgagtcggtctcctgcagtgtcttcgtggttacatttcttttcccacttaacggtatgtaagtttggttagacgtaccgacgggtcccccgggaggtacgggggcttggacggttggagtcggggtagtgggatcgtacgtcccgttaacggaaactaaacgagagtagtaggaagaagtacgttacgaggcagtagtnatcatccacggcgacaccgtataccgaacgacgtacaacgtacctacgaacgtacggaactggaacggactacctacgacgtacgtcacggacgtaaccgaccgtacctaacgtttacgttacgacgtacggacgtaacgtagtacgttttacgtcgggttaacccagtttccggttacccgttaggttaacccgttacggtaacccggttaccggttacggtttacgggtacggtacccgggg

SEQ ID NO: 246382 - DNA, 809 bp, Homo sapiens
  misc_feature: GYAE6OF02GO0GY.42.49.E05.1.454.CMB.1.raw
  modified_base (159)..(159): a, c, t, g, unknown or other
  misc_feature (159)..(159): n is a, c, g, or t
  modified_base (241)..(241): a, c, t, g, unknown or other
  misc_feature (241)..(241): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttgggtggcagcagcaacnggtgcccactcccgaggttccacctggtgctagtctggagctgagctgcagaagccgtgggcctgacgtgatcggtctccgngctaggtcgtcgttcgtaggttactacttccttttacccaccgtacggttagtacggttaacgtttgggttgaacggaccggaccgggtacccccggggtaggtcggggtcgttggtaacggtagggtaggttagggtacgtggtacgtaccggaccgtacccggtttaaaccggaaaacttaaacggaacggttagtaaggttagggaacgtaagggtaacggttaccggaagggtcgaaggtagtacaacgttaccgacgtcccgtaacgggtaccgacgtaacctacccgtaccgaaggaaccttaccggacgtaaccctaacgaacggtaacgggtaacgagggtaacggtaccggtacctaggtaacgtacgtacggtaccggaaccgacccggtaacccggttacccttagtttaaacccgtccgggtaaacgaccgggtaactaacggttacttaggtttacgttaaccgggaccctttaaccgggtcccgggttaacttcggggtacccttaaccggtaacccggtacctttcggggttacccgggtggtaaccccgggg

SEQ ID NO: 246383 - DNA, 681 bp, Homo sapiens
  misc_feature: GYAE6OF02G7HQ0.42.49.E05.1.454.CMB.1.raw
  modified_base (547)..(547): a, c, t, g, unknown or other
  misc_feature (547)..(547): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacaggtgcccactcccaggttcacctggtgcagtctggagctgagctgcagagcctgggcctcagtgatggtcctcctgctagtgcttctggtacattctttccactacggtatgaacttggttgagtacgacgggccccggtaggaacggggtcttacggaggtggtagtggggtagtgggataccgtacggacccgtttaacggaaacctaaaacgtaggtaagtaacgttaggaaggtaacggtaacgttaccgaaggggtacaaggtagtacgtataccaagtacccgacggtaccggacgaccgtaactacccgaacggtaacgtaccgtaagaccgtaccgaagtcggtaaaccgtgggaaccgggaacgtacccgtagtaacggtntaccgtcggaaccgtaacgacccggtactaacccgttacttaacggtcgacgtacgaagtagtactttaagtcggtactacggtcgttccgagttacgtacggtaaccgtacgtcggttagggcgtaacccggg

SEQ ID NO: 246384 - DNA, 822 bp, Homo sapiens
  misc_feature: GYAE6OF02GS1V6.42.49.E05.1.454.CMB.1.raw
  modified_base (393)..(393): a, c, t, g, unknown or other
  misc_feature (393)..(393): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcgagtgatggtctcctagcagtgcttctggttacattcctttccaccttacggtactgtaattggttagagtacgtaccgggacccccggtaggtacgggggtcttaggacggtaggtaggtggggacgttggacgtcgaacggtaccccgttaacggtaaacctaaaaaccgngtaacggttaagtagggaacgtagggtaacgttaccgaacgggtacgaaggtaacgtacgacttacgaacgttacccgaacccgacgggtaacctaccgtaacgttaccccggaaacggtaacggtaacccgtaacggaaccctaaacgttacgtaacgggtaaccggtaacgggaacggggtacctacccggttaacggtaagtaacccggtttacgaccggaaacccggtacccgaaccggggtaaccccttaacgtttaaaccgttaccggttaccggaacccgggtacgtaacgggtaccgttaacgtttacgggttaaccgtaccggttaaccgtttccgggttaccccgttaagggttaccccgtttaaccggtaaaccccggtacccggtttcggtttacggggtacccgggttacccgggg

SEQ ID NO: 246385 - DNA, 806 bp, Homo sapiens
  misc_feature: GYAE6OF02HBE8S.42.49.E05.1.454.CMB.1.raw
  modified_base (628)..(628): a, c, t, g, unknown or other
  misc_feature (628)..(628): n is a, c, g, or t
tcagtgacgtatgtcacgaccggtgctcgatttagagcgactagcaacacacaaaggggacccaaaaaccacacccctccttgggagaatcccctagatcacagctcctcaccgagtgggacgggacctggagctacttccttttcgtgggtcggcagcgagacaacgtaggtcgccctaccgtacccgtaggttccaccgtggtcgactacgtcgtggagtctggacgtcgtggacgaaggaacggtcccggtcggggtaccctgtaggtaggtacggttcggttccttccggcgtacgtgttcggttcttacgttacggttactacttttcctttaccgacgttaacgttattacggtaagtttcggtacgtacgaccggtacccggggacccggaggtacgggtcgttaggtacggtcggtaggtcgggacggtacgtcgtaccgaccggtaaccgtaaacggaaacgttaagacgtagtaggtagaagtagtacggtacgacggactagtagtactagtaccgacgtaccgaccggtactaaccgaacctaccgaacgtaaccgtaagtaccgtaccgtaacgtagtaaccggtacgggttacgaacggtaccggacgtacccngtaaactccggttaacggtaccgaccggtacgtaacccgttccttaaactttaccgggtccgtacggtccgggaagttaaccgttaggtaacctttaggcccgtacggttaccggttcgttaccggtcgttaacccgtacggtacccgtagggtccgttttaggggacccgacccggg

SEQ ID NO: 246386 - DNA, 701 bp, Homo sapiens
  misc_feature: GYAE6OF02H4SNX.42.49.E05.1.454.CMB.1.raw
  modified_base (157)..(157): a, c, t, g, unknown or other
  misc_feature (157)..(157): n is a, c, g, or t
  modified_base (263)..(263): a, c, t, g, unknown or other
  misc_feature (263)..(263): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttctggtggcagcagcaacnggtgcccactcccaggttcacctggtgcagtctggagctgagctgcagaacgccgtcggggcctcgaggtgacgtggtcctccgtgctagtgtcttctggttactnttcctttccactacggtatgtaattggtcgacgtacgaccggaccccggaggtacggggcttaggaggtggagttgggagtggtactcggaccgtacccgttaaacggaaaccgtaaacgaagtagtacggaggtaaacggtaaggtaaccgtaccggagggtacgacggtacgtctaaatcgaacgtccgaacccgggtacgaccgactacgtaaccgaccggaacgtaccaacgtaccgtaacaacggtacggtaacgttacggaaacggccggtacctaaccgaggtaccgacgtacgacccggtaacgtacccgtaccttacgttaaccgttacggcggtaccgtaaggtacggtattaccgtttagtccgtacgtaaccggttcgtccgtagtccgtaacgttacccgagttaccggttggtaaccggtccgg

SEQ ID NO: 246387 - DNA, 747 bp, Homo sapiens
  misc_feature: GYAE6OF02I3L4O.42.49.E05.1.454.CMB.1.raw
  modified_base (484)..(484): a, c, t, g, unknown or other
  misc_feature (484)..(484): n is a, c, g, or t
tcagtgacgtatgtcacgaccggtgctcgatttagagcgactagcaacacacaaaggggacccaaaaaccacaccccctccttgggagaatcccctagatcacagctcctcaccatggacgggacctggagcatccttttcttggtggcagcagcaacgaggtcgcccactcccaggttcaccgtggtgcgagtcgtggagcgtggagtcctgacgaggacgccgtggggcctcgagtgatcggtccttcgtggactacggtgtcctttacgttacggttacctacgttccttttaacccgtaccgtacggttattagtaaggttggttagacggtaccgaccggggaccccggagggtacggggtcgttagggacggttagggacggtaggacggtaggtactccgtaccggtacccgttaacggtaaacgtaaacgaggtagtagacgggtaagtaacggtacggtacgacggagagacgtntaagtacagtaccgaccggacgacactactaccgagtacgtacgacaacttacgaagtaccggaagttacggacggacgtcctaggataccgtactacggaaacccggtacgaaccgttacccgttaacgttacgtacgtaccggcgggtaacgaacggttataacggtttcgtaaccgttaccgtcccgggttaacgttaccggtaccggttaacgttacccgttaaccgggttccgttaccggttgggacccggggtacgg

SEQ ID NO: 246388 - DNA, 684 bp, Homo sapiens
  misc_feature: GYAE6OF02H3FSG.42.49.E05.1.454.CMB.1.raw
  modified_base (196)..(196): a, c, t, g, unknown or other
  misc_feature (196)..(196): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcttttcttggtggcagcagcaacaggtgcccactcccgaggttcaccgtggtgcagtctgganctgagctgcagagccgtagggctcgagtcgagtcggtctccgtgcagtcgcttcgtggttactattccgtttaccaccgtagtattagtaagttggtagacgcgtaccggaccccggtaggacgggtcgttaggagttaggacgtgggatggtactcgtaacgtcccgttaaacgaacgtaaacgtagaagtaggtacggtagtaacggtaacgttccggaagggtacgtaaggtacgtacgtaagtaccgaacgtaccgaacccgtacggtaacacctacgtaacccgtaaacgtacggtaaaccgacgtaacctacgtaacgtaacgtaaacgttcggaacggtacgtaccgtacgaagtacgtacgtacgaaccgacgtaccgtaccgtaactttacgcgacgtacgagtacgagttagttcgtaacgtacgtcgtacgtacgtcggaccgttacggtaaccgtcgtacggttggtacgtaccgg

SEQ ID NO: 246389 - DNA, 773 bp, Homo sapiens
  misc_feature: GYAE6OF02IVJ4O.42.49.E05.1.454.CMB.1.raw
  modified_base (221)..(221): a, c, t, g, unknown or other
  misc_feature (221)..(221): n is a, c, g, or t
tcagtgacgtatgtcacgaccggtgctcgatttagagcgactagcaacacacaaagggacccaaaaaccacacccctccttgggagaatcccctagatcacagctcctcaccatggacgggacctggagcatccttttcttggtgcagcagcaacaggtgccccactcccgaggttccacctggtgcagtctggagctgagctgcagaagccgtgggcctnagtgatggtctccgtcgctagtgtcgttctggttactatttccttttcccaccgttacggttattagtaatttaggttcgtacgacgaccgggtacccccggaggagggggtcttacggaggttagggacggtggggtagtagggtatacgtacccgtacccgttaaacggtaaaacctaaaacggtaagaaggttaagtagggaagtaaacggtaaccgttaccgaaggggaccgtaaggtacgttaccgagttacaaacgtccccgtaacggaccgggaaccctaaccgtacctaccgaacggtaaccgtaccgaacgtacccttaaacgaacgttacggaaacgttacgggaacggtaccgtaccgtaacgtagtacgtagttaaccggaacccgaacccgtaacgggtaccccttaacgtttaccttaccgtaggaccgtacggtaacggtattaacgtttacgtaaccgtaccgtaccggttacggttacccgtacggtaccgttaaccggtaacccgttcggtaccggtttcgggacggtacccgg

SEQ ID NO: 246390 - DNA, 753 bp, Homo sapiens
  misc_feature: GYAE6OF02GYAGW.42.49.E05.1.454.CMB.1.raw
  modified_base (221)..(221): a, c, t, g, unknown or other
  misc_feature (221)..(221): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctnagtgatggtcctcgtgcagtgtccttcgttggttaactacgtttcctttttacccgaccgttaaccggttaattaggtaaacgtttgggtttggaacggtaacgaccggggtaccccccggtaagggacgggggtcctttggacggttgggacggttaggggtaacgtgggtaactacggtaccgtacccgttaaacgggtaaacctaaaacgtaaggtaacggttaagtagggaaggtaaggtaacggttaccgaacggggacgtacggtaacggtcctaacttacgactaccgaacccggcggaaaccaccgtaccttacccgaacgtaacgtaccgacgtacctaaccgtaagtacgggtaactcgggtaaggacctacgtaccaggtactccgtacgtacgaccgtaccggacctacgtttaataccgtaggaccgacggaagtcgttaagttagttcggccttacggttaccggtcgttacggaccgttacgtaacccgtaccggttcgttagggtccggtaacggg

SEQ ID NO: 246391 - DNA, 1050 bp, Homo sapiens
  misc_feature: GYAE6OF02IDART.42.49.E05.1.454.CMB.1.raw
  modified_base (198)..(198): a, c, t, g, unknown or other
  misc_feature (198)..(198): n is a, c, g, or t
tcagtgacgtatgtcacgaccggtgctcgatttagagcgactagcaacacacaaaggggacccaaaaaccacacccctccttgggagaactcccctagatcacagctcctcaccatggacgggacctggagcattccttttcttggtggcagcagcaacgaggtcgacccacctcccgaggtttccaccgttgggtcncgtagttccgtgggacgcgtgacgtcgtcgacaacggaacggtcccggtacgggggcccctacgtaaggtcggttacggttcggttcccttaccgtacggaccgttaggttcggttaccgttttaccggttacggtttaccttacttttacccgttttaaccccgtaacccgtttaacggggttaagtttaggttaaaggtttacgggttacggtaaacccgggtaaccggggttaacccccggggaacccccggggttaagggggtacccgggggttcgtttaaggggtaacggggttaggggtaagggtttacggggtaacggttcggggttaaccttaaccgggtaaaccccgggtttaaaccccgggttaaaaacccggtaaaaaaccggttaaaacggttaagggttaaaccggtttaagggtaacggggtaaacgggttaaaccgggtttaaaaccggggtaacggtaacggggtaaacggtaaccggtttaaacggaaccgttacccgtaaccggtaaccgtacccgggaacccgggtaaccgggtacctaacccgtaaccgtaacccggtaaacggtaaccggtaccgaacggttaaccctaacggacggttaaacgggtaacggtaccgggtaaccggaccgtacccgtaacgtaaccgtacggtaccggttaaccgtaaccggaacgtacccgggtaacctttaacggtttaaccgtaacggttccggaccgtaaggtacgttaaggttaacgttttacgaacgttaccggttacgttaccggttacgttaccgggtacttaaccggttaccgaccggtttccggtagggtccggtaccggg

SEQ ID NO: 246392 - DNA, 616 bp, Homo sapiens
  misc_feature: GYAE6OF02GHXLU.42.49.E05.1.454.CMB.1.raw
  modified_base (371)..(371): a, c, t, g, unknown or other
  misc_feature (371)..(371): n is a, c, g, or t
  modified_base (411)..(411): a, c, t, g, unknown or other
  misc_feature (411)..(411): n is a, c, g, or t
  modified_base (474)..(474): a, c, t, g, unknown or other
  misc_feature (474)..(474): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttcacctggtgcagtctggagctgagctgcagaagccgtggggcctcagtgatggtctcctgcagtgcttcgtggttacattctttccacgtacggtatgtaattggttgagacgtacgggccccggaggtacgggtctggaggtaggaggtagggagtggacgtacgtaccgtaccgttaacggaaactaaacgngtaagtagtaggaagtagtacgtacgaggacgagacgtanactctactaccgaccggacgtaacactacaccgacgtacgtaccacgactagacgtacgaagngagcgctacgatacgcgtacgaccacggtacgtaccttattacgtacgtcggacgaggatagtagttacgtagaccgttacgggtccgttacggtacgtaccgttaccggaccgttccgttacggttcggccggtaaccggg

SEQ ID NO: 246393 - DNA, 649 bp, Homo sapiens
  misc_feature: GYAE6OF02GSKNB.42.49.E05.1.454.CMB.1.raw
  modified_base (642)..(642): a, c, t, g, unknown or other
  misc_feature (642)..(642): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctaggtgcagtctggagctgagctgcagagccgtgggctcgagtgagtcggtcctcctgcagtcgtcttcgtggttactacttccttttccgaccgttacggttaatacggtaagttagggttgacgtacgacccgggaccccggtagggtaggggtcgttggagtgggacggtaggggagtaggacgtacgaccggtacccgtaaacggtaaactaaaacgtagtaagtagtaggaagtacgtaacgtccggagggactaggtacgtacgacttacgacgtaccaccggtaccgacaacctaccgaccgaagtaccgtaacacgtacctaacgagtacggaacgtgtaggacaccgtagacgatcgacgacgacgaccgctacgttactcgtcgacgagagagttcttagtctcgtacggtcgttaccgtagtacgttacgtaccctacggcgtttacggngtacggg

SEQ ID NO: 246394 - DNA, 772 bp, Homo sapiens
  misc_feature: GYAE6OF02HQCYK.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtgcagtctggagctgagctgcagaagcctggggcctcagtgatggtctcctgcagtgtcttcgtggttacacgttcttttaccaccttacggttatagtaagtttggttagacggtaccacgggtacccccggaggacgggggtcgttacggagggtcggtaggtggggagtagggatacgaccggtacccgttaacggtaaactaaaaacgagtaagtaagtagggaagtaaggtaacgttaccgaacgggtacgaaggtacgtacgactacgaacgtccggtaacccgaccgggtaacaacccgtaacgtaccgaaccgtaacgtaaccgaacgtaccgtacgaacgtagggaaacgttacggaacgggacgtacccgtacgaacgtacttacggtacggaacccggtaccgaaccgggtacccttaaacgttttacgttaaccgttcggaacccggaggtaccgtaacggttaacttttaagtaccgggtaccttaaccgggttcgggttacccggttacgggtaaccgtttaccgggttaaacccgttacccggttaccggttttacgggaccgggttaacccggg

SEQ ID NO: 246395 - DNA, 733 bp, Homo sapiens
  misc_feature: GYAE6OF02IMNU2.42.49.E05.1.454.CMB.1.raw
  modified_base (234)..(234): a, c, t, g, unknown or other
  misc_feature (234)..(234): n is a, c, g, or t
  modified_base (560)..(560): a, c, t, g, unknown or other
  misc_feature (560)..(560): n is a, c, g, or t
  modified_base (633)..(633): a, c, t, g, unknown or other
  misc_feature (633)..(633): n is a, c, g, or t
tcagtgacgtatgtcacgaccggtgctcgattttagagcgactagcaaacacacaaaggggacccaaaaaaccacacccctccttgggagaatcccctagatcacagctcctcaccatggacgggacctggagcattcctttttcgttgggtggcagcagcaacaggtcgcccactcccaggttccaccgtggtgcagtctggagtctgagctgcaagaacgccgtggggcctnagtgatcggtcctcgtgccagtgtcttcgtggttactactttctttaccacgttacgtataggtaacttggtagtacgacggtaccgggaccccgggaggtacggggtcttaggaggttcgggaggtcgggaagtggtaacgtcgtaaccggtacccgtttaaaacggaaaacctaaaagtacggaaggtagtacggggaagtaaacggtaacggttacggaacgggtaccgtaaggtacgtaactacgtaacgtacgtaccgaacccggaacgaaccgtacgaacccgtaacgtaacgtaccgtaaccggtaacgtacccgtaanaggtaaacgtacgttaacgagtccgacctgaacatacgtcgaacgtaaccgccggtacttacgtacgttacgngtaccgtacgaagtagtacgttacgtaacgtaccttcgtacggttcgtacgttacggttaacctaaccggtggttccgggtttacggacggtaacccggg

SEQ ID NO: 246396 - DNA, 777 bp, Homo sapiens
  misc_feature: GYAE6OF02FJ5G7.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccaccttacggtatgtaagttggttgagtacgacgggcccccggagagggggtcttggagttggagtgggagttgggatccgacgtaccccgttaacggaaaacgtaaaacacggaaggttacgtagggaggtaagtaacggttaccggaagggacgaggaacggttacaacgtccaacgttaccaacccggtacgggaacctaaccacgttaaccccgaaccgggtaagtaacccgaacgtacccgtaaccgtacgtaacggtaaccggttagggaacgggtaccggaccccttacgacggtaacttacggtacggtaaccggaacccgtaaccggggtacccttaacgttttaacgtttaaccgtaccggtacccggtacggaacgtacggttaacttttaacggttacggtacccgttaacggttcccgggtttacccgttacggggttaccccgtttaacggttaaccccgttaaccgggttacccggttttacgggtaccggggttaacccggg

SEQ ID NO: 246397 - DNA, 609 bp, Homo sapiens
  misc_feature: GYAE6OF02IRBMW.42.49.E05.1.454.CMB.1.raw
  modified_base (422)..(422): a, c, t, g, unknown or other
  misc_feature (422)..(422): n is a, c, g, or t
  modified_base (424)..(425): a, c, t, g, unknown or other
  misc_feature (424)..(425): n is a, c, g, or t
  modified_base (428)..(428): a, c, t, g, unknown or other
  misc_feature (428)..(428): n is a, c, g, or t
  modified_base (446)..(446): a, c, t, g, unknown or other
  misc_feature (446)..(446): n is a, c, g, or t
  modified_base (528)..(528): a, c, t, g, unknown or other
  misc_feature (528)..(528): n is a, c, g, or t
  modified_base (535)..(535): a, c, t, g, unknown or other
  misc_feature (535)..(535): n is a, c, g, or t
tcagtgacgtatgtcacgaccggtgctcgatttagagcgactagcaacacacaaagggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtcggggcctcagtgagtcggtctccgtgcgtagtcgtcttctaggttactattccgttttccaccgttacggtattgtaacgtttggttgagacgaccggccccgggaggtcggggtacgttggaggtgggagtggggtagtgggtactcgacgtccgttaacgaaactaaacgagagtagaggagtagtacgtcgaggcaggacgtanannacncgaccgcgaacacgtacncgaacgatacgacgtactacagcggtaatcggaagtccgactagacgattcgaggaacgacgaccgtactacgttacttacncgtacgngaacgtagtactttagtcgttacgacggttctacggttcgtactacccggttaacgcgtcgttggtcgtaccgg

SEQ ID NO: 246398 - DNA, 795 bp, Homo sapiens
  misc_feature: GYAE6OF02H7E3F.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgctttcgtggttactacttccttttccaccgttacggtagttagtaacgtttggttagagaccgacgggcccccggaggaggggtcttggacggttggagtggggatggagtcgacgtacccgttaacggtaaactaaaacgagtaagtagtagggagtaaggtaacggttccgaagggacgtaggtagtacgtactaccgtacgtaccgacccggacggtaacaccgtaacgtacccgaaccggtaacgtaaccgaccgtaccctaacgtaacggttacgggtaaccgtaggtaacgggacggtacccgttaacgaacggtaccttacgtaaccggtaacccgggaaccgtacccggggtaaccctttaaccgtttaaacgtttaaccgtaccgggtaaccgggtacgggtaacggtacggtttacgtttaaacgttcgggtaacccgtttaccgggttacccgggtttacccgttaccgggttaccgtttaaccccgggtaaaccccggttacccgggtttacggttttacggggtaccggggttaaccccggg

SEQ ID NO: 246399 - DNA, 866 bp, Homo sapiens
  misc_feature: GYAE6OF02G4RN2.42.49.E05.1.454.CMB.1.raw
  modified_base (227)..(227): a, c, t, g, unknown or other
  misc_feature (227)..(227): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcgagtctggagctgagctgcagaagccgtgggcctcgaggtnagtggtcctccgtgctagtgtctttcgtacggttactacttccgttttaccaccgttacggtattacgttaagtttggttgtaacggaacgtaccgggtacccccggggaaggggtaacgggggtccgttacgggtaagggttcggggtaaggttacgggggtaacgttcggggtaaacgttcccgtaaaccgggtaccccggttttaaaaccgggaaaaaccgttaaaaaccggtaacgggttaaaggttaacgggttaacggggaaagggtaaaacggggttaaccggggtttaacccgggaaagggggtacgtaaacgggtacgggtttaaaccgacgttaccgtaaaccggttacccggtaaccccggggtacccgtaaaccgaccgtaaacccgtaacccggtaacccgggtaaacgtaaccgtaaccggtaacccgttaaacggtacgggttaaccggtaaacggtacggacggggtaccgacgtaccgtaacgtacgtaccgtacggaccgaaccgtccggtacccttaacgttacgttacgcggtacgaacgtaggtacttacgttagtcgcgttaacgtccggtacttcggtaccgtacgtaaccgttcggtacgttgggacggtaccgg

SEQ ID NO: 246400 - DNA, 702 bp, Homo sapiens
  misc_feature: GYAE6OF02HCU58.42.49.E05.1.454.CMB.1.raw
  modified_base (512)..(512): a, c, t, g, unknown or other
  misc_feature (512)..(512): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctagcagtgtcttctggttacattcctttccaccgtacggtatagtaattggttgagaccgtacgggcccccggaaggtacgggggtcttcggaggtacgggagtaggggtagtcgggacttccgaacggtccccgttaaacgggaaccttaaaaacgaggtaagtacgtagggaagaggtaacgttaccgaagggacgaggtacgtacaactcgaactaccgaaccggtaccggaactcgaacgttacccaacggtacggtaaaccaggtacccttaanacgttacggaactgggacggacgtaccctacgaacgtatcgtacggtaaccgaccgaccgggtcctaaacgtttagttaaccggtcggtaccgaccgtaggacgttacttacgttcggaactaccgggttccggtccggtaggtacccgttacgtaacccgtccgggttccgttacgggacggtacccgg

SEQ ID NO: 246401 - DNA, 828 bp, Homo sapiens
  misc_feature: GYAE6OF02FHKIM.42.49.E05.1.454.CMB.1.raw
  modified_base (164)..(164): a, c, t, g, unknown or other
  misc_feature (164)..(164): n is a, c, g, or t
  modified_base (699)..(699): a, c, t, g, unknown or other
  misc_feature (699)..(699): n is a, c, g, or t
  modified_base (816)..(816): a, c, t, g, unknown or other
  misc_feature (816)..(816): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcaggcaacagggtncccgactcccaggttcacctggtgcagtcctgggagcctggacgcgtagcaggaacgccgtgggggccctcgaagtgattacggtctacctgcaggtcgtacgttcgtagttacgtacttcctttcctaaccgtacggttagtagttaacgttagggttagtacgggtaaccgaccggggtcccccgggtaagggtaacgggggtcgtttacggaacggttagggtacgttaggggtaggtaacggtagtaccgtaacggtaacccgttaaccgggtaaaacttaaaccgaaggtagtaacgtagggaagaacgtaacggtttaccgacggggtactaacggtacggtactaacgtcgtaccgtacccgtacgggaaccgtaccgagtaccacggtaacgtacgtaccgtaagtcccggtaaacaccgggtaggttaaccggtggtaaaccgggtacgtacccgttaacgtaacggtacctaacggttaccggaaaccggttaccgaaccggtaccctttaaagttaacccgttnttaccggccgggtaaacgtacgttacggtaaattttacggaacgtacccggtacgtttccgggtaacgccggttaaccggttacccggtaaccgttaccggtagttttaccgggggngttaaccccggg

SEQ ID NO: 246402 - DNA, 726 bp, Homo sapiens
  misc_feature: GYAE6OF02H3F06.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtctggagctgagctgcagagcctggggcctcgagtgagtcggtctccgtgctaggtgtcgtttcgtggttactacttccttttccaaccgttacggtactaggtacgttggtagacgtaccgaccgggaccccgggaggacggggtctggagggtaggtaggtgggagtggatcgacgtaccgtaaccggaaactaaaacgaggtaacgtagtaggaagtaacggtaacgtaccggagggacgacggtagtacgactaccgtactacccggaccggtaccggtacaacgactacccgaacgtaaccgtacgtacgtaccctaagtaccggtaagtaacgtaggaacggtacaccttacgagtacgagtacggaacccgacgacccggttaacctacgtttaacccgttaactacggtaccgggtaacgtaaggttaaccgtagtttacgtacggtccgttacgggtcggttacccggttacggtacgtttacccggaaacccgttcggttacgggtttcgggtaccggtaacccggg

SEQ ID NO: 246403 - DNA, 727 bp, Homo sapiens
  misc_feature: GYAE6OF02JX5FI.42.49.E05.1.454.CMB.1.raw
  modified_base (199)..(199): a, c, t, g, unknown or other
  misc_feature (199)..(199): n is a, c, g, or t
  modified_base (271)..(271): a, c, t, g, unknown or other
  misc_feature (271)..(271): n is a, c, g, or t
  modified_base (659)..(659): a, c, t, g, unknown or other
  misc_feature (659)..(659): n is a, c, g, or t
  modified_base (680)..(680): a, c, t, g, unknown or other
  misc_feature (680)..(680): n is a, c, g, or t
  modified_base (688)..(688): a, c, t, g, unknown or other
  misc_feature (688)..(688): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtacgcccacctcccaggttccacctggtgcagtctgganctgagctggcagagccgtgggcctcgagtgagtgggtcctccgtagcgtagtgtccgttacgttggtttacnctttccttttacccggaccgttaacggttattaacggtaagtttgggtaggtaacgtaccggtacccgggacccccggtaggggtacgggtcctaggtacggtagggaagttggggagtcgggtacgtccgtaaccggttaacccggttaacgaaaaccggtaaacgacggtaaggttagtaaggaaggtaaccgttaagggaaccgaggggactaacggacgtagtaacgttacgaacgtacccgacggtaccgaactacgtacgccttaacggtacggaacgtaacctacccgtaagtaccgttacggacgttcggaaaccggtcaccggttacacgtttacgacgtacggaccgttacccgacggtaccttaacgacgttacgcncgggtacagtacgttatacgngttaaccngttccgattcgactaggtccgtagttcgtgtacgtccgg

SEQ ID NO: 246404 - DNA, 860 bp, Homo sapiens
  misc_feature: GYAE6OF02FRO9O.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacattctttccactacggtatgtaattggttgagtacacggtccccggaggagggggtcttggagtcggagtgggagttggatacgacggtcccgttaacgggaaacctaaaacgaggaagttacggtagggaacgtaaggtaaacgggtttcccggaaggggtaccgtaaagggtaacgtttaccggtaaacttacccggtaacggttacccgaaccccggggtacggtaacccgtaaaccgtaaacctttacccccggaaaaccgggttacgggttaaacccaaccgggttaacccttaaaacccggtaacggttaaccggggtaaacccgttaggggtaacgggtaaaccggttaacccccgttcgggtaaacggtaaccgttaacccgggtacggtaaacccggaacccgggtaaacccgggtacccgtttaacccgtttttaacggtttaaacccgtcgggttaacccggtacggtaaccgggttaaggttaacgttttaacgggttcgttaaccgttaccggttccgggttacccgttaggggttacctttaccgggttaaacccgtaccggtttcccgggtttacgggtccggggttacccggg

SEQ ID NO: 246405 - DNA, 822 bp, Homo sapiens
  misc_feature: GYAE6OF02IN2W5.42.49.E05.1.454.CMB.1.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
  modified_base (351)..(351): a, c, t, g, unknown or other
  misc_feature (351)..(351): n is a, c, g, or t
  modified_base (723)..(723): a, c, t, g, unknown or other
  misc_feature (723)..(723): n is a, c, g, or t
tcagtgacgtatgtcacgaccggtgctcgatttagagcgactagcaacacacaaaggggacccaaaaaccacacccctcttgggagaatcccctagatcacagctcctcaccatgggacgggacctgggagctattcctttttcgtgggtggcagcagcaacagggtcgacccactcccaggttccaccgttgggtncctagttcgtgggacgtctggtagctaggacaaggaacgcccggttggggcccttagaggttgagttcggtccttccggngactagtcgtctttacgtacggttactacttccttttacccgaccgtacggttagtagtaacgtttggttaggngtacgaccgggtcccccggaagggtcggggtcgttagggaacgggttgggtaggtggggtaagtgggtacttcgaacggttacccgttaaacggtaaaccgtaaaacgtcggtaagttaggtagggaggtaaacgttaggttacccggagggtacacgggttacgtagtactacgtacgccgaacgggtcaactaccggtaaacctacggacgtaaacgtacgtaccgtaccctaggtaacggtacggtaacgttcgggaaccgggttaccctaccgtaccggtataacccggttgtacccgggaacttaacccgggtaccggtaacctttacgttaactttccggttacgggacgggtaacgtaacgggtntttaacggttacgttacgacggttaccggttttccgtagggttaaccggttccgttaaccggttaccggttacccgtacgggttaggttacggacccgg

SEQ ID NO: 246406 - DNA, 707 bp, Homo sapiens
  misc_feature: GYAE6OF02JJBCQ.42.49.E05.1.454.CMB.1.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (346)..(346): a, c, t, g, unknown or other
  misc_feature (346)..(346): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaacnccgtagggcctnagtgatggtctctgcagtgtctcgttggtactattctttccaccgtacggtatgtaacgtttggtgacgacgtacgggcccccgggaggacgggggtctgacggtggtaggtcgggtagtaggntccgaacggtacccgttaacggtaaactaaaacgacggtaagtagtacgggtaaggtaagtaacggtacccgaggggtacaggtaacgcgtaacgtaccgacgtaccgaacggaccgggaacctaccgtaaccgtaccgtaaacggtaacgtaaccgacgtaacctaacgaacggttaacgggaacgtaggtaaccggacggtaccctacgtaacgacgttacgttaaccggaccgaaccggacccgtaccttaaccgtttaattaaccgaggtccgaaggtacgtacgtattacgtcgtaacgtacggtcgtaccgtggtaccgttacggtacccgtaggttccgttcggtcggtaccgg

SEQ ID NO: 246407 - DNA, 632 bp, Homo sapiens
  misc_feature: GYAE6OF02GDG4N.42.49.E05.1.454.CMB.1.raw
  modified_base (579)..(579): a, c, t, g, unknown or other
  misc_feature (579)..(579): n is a, c, g, or t
tcagtgacgtatgtcacgaccggtgctcgatttagagcgactagcaacacacaaaggggacccaaaaaaccacacccctccttgggagaatcccctagatcacagctcctcaccatggacgggacctggagcatccttttcttggtggcagcagcaacaggtgcccactcccaggttccacctggtgcagtctggagctgagctgcagaagccgtggggcctcagtgatggtctcctgcagtgcttctggtacattctttccacctacgtatgtaagttggtgtagacacgggcccccggaaggacgggtcgttggaggtggagtgggagtggactcgtacgtacccgttaacggaaacgtaaaaacgaggtaacgtaagtaggagaggtaacgttacgacgggacaggtcgtacaacgtcgactacgaccgcggtaacacgtactaccgaacgtacgtaccacgtacctaacgacgtacggaacgtcggtaacgggacgcctacgagtacgttacgtcggaaccgaccgaccgtaaccttacgttacgttacgtcgacgacgtagacgtatttacgtntaccgtacgtcgtcgtacgtacgtactaccgtaggtcgttaggtcggtaccgg

SEQ ID NO: 246408 - DNA, 647 bp, Homo sapiens
  misc_feature: GYAE6OF02HXZVW.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcagtgatggtctctgcagtcgcttctggttacacttcttttccacttacggtatagtaagttggtagagtacgacggccccggaggacgggtcttaggaggtggaggtgggagtggatcgacgtaccgttaacggaaacctaaaacgagtagtagtggaagtagtaacggttcgaagggtacaaggacgtacaatacgacgtaccgaccgacggacacgtactacccgaacgtaacgtacaacgcctaacgaacgtgaaactggacggacgccgtagacgacgtcgtacgaccgacgaccgtacctaacgtttaagtaccgtagacggacgtaggagttacgttacgtacgtacttccggttacggttaccgaggggttaccttaaccggttaacccgtaccggttacggttacggtcgggtaaccgg

SEQ ID NO: 246409 - DNA, 758 bp, Homo sapiens
  misc_feature: GYAE6OF02GX2CC.42.49.E05.1.454.CMB.1.raw
  modified_base (702)..(702): a, c, t, g, unknown or other
  misc_feature (702)..(702): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttcacctgggtgcagtctgggagctgacgccgtcgagaagacgtccgggtacgggtcctagacggtagtcgttccggtccgttcgcgacgtacgtcttccgttggttacgtactacttttccgttacctaccggttaacgttagtaacgtttacgtttgggttacgacgaccggacccggtacccggggagggtacgggttcgttagggacggtagggtagggacgggtggtacgggactacggaaccgttaccgggttaaacgaaacgtaaacgtagtagtacggaaggtaagtaacggtacgtaacgggcggacacgggtaactacgtactacgaccgtaccggaccggtaacgacctaaccgacttaccggaagtaaccgactacgacgttaacggacgtaaggaacgtacgacacggtacctagtacgtacgttccgaaacgtccggaacgttccctaacgtttaactttcggaacgtcggagtacggtaagtacgttacgttaccgacgtacggtttaccgnggttaccggttagacccgttaacggttaccgtggtcggttggtaccggtaccgggg

SEQ ID NO: 246410 - DNA, 852 bp, Homo sapiens
  misc_feature: GYAE6OF02GALAR.42.49.E05.1.454.CMB.1.raw
  modified_base (211)..(211): a, c, t, g, unknown or other
  misc_feature (211)..(211): n is a, c, g, or t
  modified_base (493)..(493): a, c, t, g, unknown or other
  misc_feature (493)..(493): n is a, c, g, or t
tcagtgacgtatgtcacgaccggtgctcgatttagagcgactagcaacacacaaaggggacccaaaaaccacacccctcctgggagaatcccctagatcacagcctcctcaccatgggacgggacctggagcatccttttcttggtggcagctagcaacaggtgcccacctccctaggttcaccgttggtgcgagtcgtggagtcgtggancgtgacaggaacgccgtacggggtccgtacgagtgtagttcggtcctactgctagtccgtcttacgttaggttactaccttccgtttaccctaaccgtacgttagttagtagttggttcggacggtaacgcccggggaccccggtacgggtaggggtccttagggtaggagggtacggttcgggaggtacggtactacggtaaccgtacccgttaaaacgaacgtaaacgtaaggtacggtaaggtagggaaacgtaacgggtaaccgttacgggaaacggnggtaacgtacgtactaaggtaccgaacgttaccggaaccggactaaccgtacctaaccgtacccggtaacgtaacgacccgtaaacgggtacctaaacgggcgtttaaacggacgggttaacggaacgtaccggttaaccaacggtaaccggtctaaacgggttcccgaaaacggccccgttaaaacgtcgtttaaacccgtcggttaaccggtaaacgtacggggtacgtaaaccggtacttaggttttaacctacggaacggttttcccggtaaaccggttttcggaaccccggtttacttaaccggggttaccctaacggggttcccggttaacgggcccgggttaaaacccgggg

SEQ ID NO: 246411 - DNA, 730 bp, Homo sapiens
  misc_feature: GYAE6OF02HVHNI.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtcgtggagctgagctgcagaagccgtggggcctcgagtgatggtctctgcagtgcttctgtactattctttccaccgttacgtatagtaagttggttagtagtacgacggacccccggaggtacggggcttggaggtggagtgggagtggacgtacgtacgaccgttaacggaaactaaaacgagtaacggttagtaggagaacggtaacgttccggaagggtacaagggacgtactagtacctacgtaccgaacccggacggtaccgtactaccgttacccgaacggacgtaccgaacgtacctaaccgaagttagggaaacctagggaacggtaacccgaccgtaccgagggtaaccttacggtaccgaccgggtaacccggttaaccgggaccctttaacccgttttaacttaccggttacggtaccgtagggaaccgtaaggttagttttaacgtccgggttacctaacgggttcgtcccggttagggtacctaccggtaaccccgttaccggttcggttacggtccggtaacccggg

SEQ ID NO: 246412 - DNA, 796 bp, Homo sapiens
  misc_feature: GYAE6OF02H7TTN.42.49.E05.1.454.CMB.1.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (291)..(291): a, c, t, g, unknown or other
  misc_feature (291)..(291): n is a, c, g, or t
  modified_base (625)..(625): a, c, t, g, unknown or other
  misc_feature (625)..(625): n is a, c, g, or t
tcagtgacgtatgtcacgaccggtgctcgatttagagcgactagcaacacacaaagggacccaaaaaccacacccctccttgggagaatcccctagatcacagctcctcaccatggacgggacctggagcatccttttcttggtggcagcagacaacaggtcgccccactcccaggttaccaccgtggtgacagtcgtggagctgagctgcagacgccgtgggccctgagtgagttcggtacctccgtgcgtagtcncttactggttacntttccttttccacgttacgtntaggtattggtgagacgccgggtaccccggaggtaccggggtctttaggacggtggaacgtgggtatgggtactaccgtaccggtaccgttaacggtaaaccttaaacgacgggtaagttaccggtagggaacgtaagggttaacggttacccgggaagggtacctaaagggtacggttacaaacgtttccggaacttccccgggaaccggtaccggtaccgaaccctaaccggttacccgaacggtaaaccgtaacccggtacggtaccctaaacggtacgtaccgggtaaccgttacggggaaacgtaccgtaccgttacgacggttaaccnccgttaacggaacccgacggtaaaccccggtcctttaaccggtttaaccttccgggtggaacccttagggaacgttagttaacggtttacgtccgtacggttaaccgttcggtcgttaccggtaccggttaccgtaaccggtccggttaacggttcggtaccggtacccgg

SEQ ID NO: 246413 - DNA, 640 bp, Homo sapiens
  misc_feature: GYAE6OF02IPGOI.42.49.E05.1.454.CMB.1.raw
  modified_base (559)..(559): a, c, t, g, unknown or other
  misc_feature (559)..(559): n is a, c, g, or t
tcagtgacgtatgtcacgaccggtgctcgatttagagcgactagcaacacacaaaggggacccaaaaaaccacacccctccttgggagaatcccctagatcacagctccctcaccatggacgggacctggagcatccttttcttggtggcagcagcaacaggtgcccactcccaggttcacctggtgcagtcgtggagcgtgagcgtgacgagaacgccgtcgggcctgagtgagtggtcctccgtgcgagtcgtcttcgttcggttactacgttcctttacctaccgttacggtagtagtaagttggttagacgtacgaccgggaccccggtaggtacggggtcgttaggtaggtggtagtaggtagtggagtcgacgtaaccgtaacggaaactaaagagtaagtagtaggaagtaagtacgtaccgaggacgagtagactatcacgtacgaccgacgacagtacaccgaacgaatacgacgtacctagacgtagaacgtggaacgcgacctagactacgtcgaacgaacgaccgtacgtacctaacgttagtacgnggaccgtagaagtacgtacttagtcgtacgtaccgtcggtaccgtagtcgtaacgtaccgtacgtcggttacggcgtacgg

SEQ ID NO: 246414 - DNA, 647 bp, Homo sapiens
  misc_feature: GYAE6OF02FMONY.42.49.E05.1.454.CMB.1.raw
  modified_base (337)..(337): a, c, t, g, unknown or other
  misc_feature (337)..(337): n is a, c, g, or t
tcagtgacgtatgtcacgaccggtgctcgattttagagcgactagcaacgacaacaaaggggacccaaaaaccacacccctccttgggagaactcccctagatcacacgcctcctcaccatggacgggacctggagctatccttttcttggtggcagcagcaacagtgcccgactcccaggttcacctggtgcagtctgagctgagctgcagagcctgggcctcagtgatggtctcccgcagtcgactttcgtggttactattctttccaccgtagtatgtattggttcgacgacgacggtccccggagacgggtctaggagtggagtggagtggancgacgtccgttaacgaactaaacgacgtagagtaggagtagagttcgaggactaggactactacgtcactaccgaccgtacgactacgtactaccacgagtacacgtactaccagttacgaaccgtagaaggtaccgaccttacgacgtgttaccgacgtaaccgacgtaaccgtaccctaacgtttactaccgggttacgacgtaccggaagttaaccggtacttagtcgttaacgtaaccgtcggttacccgtaggtaccgttaccgaacgttaccggttacgttaccggtacggtaccctaaccggg

SEQ ID NO: 246415 - DNA, 870 bp, Homo sapiens
  misc_feature: GYAE6OF02FMVVL.42.49.E05.1.454.CMB.1.raw
  modified_base (234)..(234): a, c, t, g, unknown or other
  misc_feature (234)..(234): n is a, c, g, or t
  modified_base (243)..(243): a, c, t, g, unknown or other
  misc_feature (243)..(243): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgccagtctggagctgagctgcagaagccgtggggcctcgagtgatggtcnctgcacgtnctttcgtggttactacttctttaccaccgttacggtatagtaacttggttacgaggtaccgaccggggtacccccggtagggaacgggggtcgtttacggtaagggttacgggaacggttacggggtaggttacggggacgttaccgtaaccggtaaccccggtttaaaccggtaaaaccgttaaaaaacgtaagggtaacgtaaggttaacggggaaggtaacgggtaaacgtttacccgggaaggggaacgttacggaacgttaacgtacgttaaccgtaccgttaacccggacccggaccgggaaccttacggtaaacggttaccccgaaacggtaacgttaaccgaaaccgttacccttaaacgtaacggtaccggttaaacggttacggaaacgggacccgttaccgtaaacggtactaacgttaaccgttacgggaacccgtaaccggtacccgggtaacccgttaacgtttttaacgtaaccgttacggaaccgtttaccggaaggtacgtaaccggtttacggttacgtaacccggttcccgtaacggtttcccggttacgggtactttaacccggtaacccggtcgtttaacccggtaccggttacggggtaacccgg

SEQ ID NO: 246416 - DNA, 735 bp, Homo sapiens
  misc_feature: GYAE6OF02G4VWN.42.49.E05.1.454.CMB.1.raw
  modified_base (492)..(492): a, c, t, g, unknown or other
  misc_feature (492)..(492): n is a, c, g, or t
tcagtgacgtatgtcacgaccggtgctcgatttagagcgactagcaacgacgacaaaaggggacccaaaaacccacacccctccttgggagaatcccctagatcacagctcctcaccatggacggacctggagcatccttttcttggtggcagcagcaacaggtgcccactcccaggttcacctggtgcagtctggagctgagctgcagaagccgtgggcctcgagtgatggtctcctgcagtgtcttctggttacattccttttccaccgttacggtactggtaagttggttagagaccgacgggacccccggaggtacggggtcttggaggtggtagtggggaatgggattccgacgtacccgttaacggaaactaaacgtagagtagtagggagtaagtacgttaccgagggtacaggtacgtacgatacgagtacccgaccgacggaacaccgtacgtacccgaacgtaacgtaccacgtacccgaanacgtacgggtaaccttagggacggtacgaccgtacgaacggtaccttcgtaaccgggacccgtaccggaaccgttacccgtaacgttttaacgtaccgggtccggtacgtacccgggtaaggtacgttaacgtttacggttaaccggtaccgttaaccggttcgggttaccctttcgggaaccgttttaaccggaacccggtttaaccgggtcggttttccgggggaccgggttaaccccggg

SEQ ID NO: 246417 - DNA, 747 bp, Homo sapiens
  misc_feature: GYAE6OF02FUZLJ.42.49.E05.1.454.CMB.1.raw
  modified_base (184)..(184): a, c, t, g, unknown or other
  misc_feature (184)..(184): n is a, c, g, or t
  modified_base (615)..(615): a, c, t, g, unknown or other
  misc_feature (615)..(615): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtgcccactcccaggttcacctggtncagtctggagctgagctgcagaacgccgtggggcctcgaggtgagtcggtcctccgtgacgtagtcgtccgtttgtacggttacacttttccttttaccctaaccgttacggttagttacgttaagtttggttacggtacgaccggtacccggggacccccgggtaagggaacgggggtcgttacgggtaacgggttacgggtaggtacgggggtaagtacggggtaacttacccggtaccggttaaccccggttaaacgggtaaaaaccttaaaaacgtaggtaacggtaaggttaaggggaaacggtaacggttaaaccgggtacccgggtaggggtaacctaacgggtacgtactaacgtccgaactacccgggaacccggtaggaaccctacgtactacccgaacggtaacgtaccacgtaccgtanacgtacgacggtagacgctaccgcgtactcgtcgtacgacgtaccgacgtacctagttactcgacgtcgacgtacgtagtactagtcactccgttgtccgtgtactcgtaaccgtcgtcgttaggccggtcg

SEQ ID NO: 246418 - DNA, 784 bp, Homo sapiens
  misc_feature: GYAE6OF02FIEFG.42.49.E05.1.454.CMB.1.raw
  modified_base (182)..(182): a, c, t, g, unknown or other
  misc_feature (182)..(182): n is a, c, g, or t
  modified_base (733)..(733): a, c, t, g, unknown or other
  misc_feature (733)..(733): n is a, c, g, or t
tcagtgacgtatgtcacgaccggtgctcgatttagagcgactagcaacacacaaaggggacccaaaaaccacacccctccttgggagaatcccctagatcacagctctcaccatggacgggacctggagcatcctttcttgtggcagcagcaacaggtgcccactcccaggttcacctggtncagtctggagctgagctgcagagcctcggggcctcagtgatcgggtcctccgtcgacaggtcgtcctttcgtcgggtttacactccttttacccacccgtaccgggttatcggtaactttgggttcgtacggacccgtacggggacccccccgtaaggtacgggggtcgtttacgaacggttacggtagtacggggtaggttacgggtacgtaccgtaacggttaccccccgttaacgggtaaaaccccgttaaaaaccgtacgggtaaacggtaacgttagggggtaaccgtaacgtaaaccgggtttcccggaaacgggggtaccgaaacggtacggtaccgtacgtaccgtaacgttcccgaaccgggtccggtaaccaccgtacttaccggaaaccgtaggttaacccaacgtaccctaagtaccgtaggaaaccgttcggaacggtacgtaccccgtacgtacgacgtttaccgacgaaccggtacccgaccggtacccgtaactttaactaccgttacggacgacggacgtacgtattacgttcncctacgtcgtccgtaggtactacgtaacccgcgtcttaggtcggtacccgg

SEQ ID NO: 246419 - DNA, 758 bp, Homo sapiens
  misc_feature: GYAE6OF02GHWU9.42.49.E05.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
tcagtgacgtatgtcacgaccggtgctcgatttagagcgactagcaacacacaaaggggacccaaaaaaccacacccctccttgggagaatcccctagatcacagctcctcaccatggacgggacctggagcatccttttctggtggcagcagcaacaggtcgcccactcccgaggttccaccgtggtncagtcgtgganctgagctgcagaagccgtgggcctnacggtgagtgtctcctagcagtgtacttcgtacggttactactttcctttacccgacgttacggttagtacgttacgtttggtacgaacgtaccggaccgggaccccgggagggtacgggggtcctttagggaggttgggtaggtacggggtagtcggtactacgtaccggtacccgttaacggaaaacgtaaacgacggtagttaacggtacggaacggtaacgtacgttacggtacggagtacggacgtacgacttacgtactacccggacggtccgtaacaaccgtacgtaaccgtaacggtacgtaacccgtagtaacccgtagtaaccgtacgggttaacgtaggaaccggtaccttccgtaacggtacgttaccgtacggttaaaccggcgttaccccgggtaactttaccgtttaaccgtcgtaccgggaacgtggtaacgttaacttcgtaagttaccgccgttagttccggtacgttcgaccgttaccgtacggtccgtcggttcggacggtcggtaacccggg

SEQ ID NO: 246420 - DNA, 888 bp, Homo sapiens
  misc_feature: GYAE6OF02H6UKS.42.49.E05.1.454.CMB.1.raw
  modified_base (149)..(149): a, c, t, g, unknown or other
  misc_feature (149)..(149): n is a, c, g, or t
  modified_base (196)..(196): a, c, t, g, unknown or other
  misc_feature (196)..(196): n is a, c, g, or t
tcagtgacgtatgtcacgaccggtgctcgatttagagcgactagcaacacacaaaggggacccaaaaaccacacccctccttgggagaatccctagatcacagctcctcaccatggacgggacctggagcatcctttctggtggcagcngcaacaggtcgcccactcccgaggttccacctggtgcgagtctgganctgagctgcagaacgccgtgggcctcagtgacgtggtcctccgtgcgtagtgtccgttcgttacggttaacttacgtttccctttttacccgaaccgttaacggttacttacggttaaacgtttcgggttaacggtaacggtaaccggtacccggggaacccccgggtaagggaccgggggttaccgttagggacgggttgggaacggttagggtaacgtgggtaacttaccggaaccgtaaccccggttaaacgggtaaaacctaaaacggtaaggtaacgttaaggtacgggtaacggtaaggttaacggttaccgggaaggtacgtaagtacgtacgaacgtacctacgtacccggtaaccggaccggtaaccaaccgtaccggtaacccgtaacgtaaccggtaacccgtaaccgtaacccgtaaccggttaggtaaaccgggtaaccggttacggtaaaccgggtaccgtacccgttaaggtaaaccggtacgtttacccgaaccgggaaacccgtaaccggtaaccccgtttaaccggttaaaccttttaacggtaacccgttcgggaaccggttaacgaaccgggttaacgttacgtttaacggtacgtaccgttacgtccggtttacccgtagtacccgtaacggtacccgttaacggtccggttacgggtacgttacccgggg

SEQ ID NO: 246421 - DNA, 669 bp, Homo sapiens
  misc_feature: GYAE6OF02GN5GY.42.49.E05.1.454.CMB.1.raw
  modified_base (200)..(200): a, c, t, g, unknown or other
  misc_feature (200)..(200): n is a, c, g, or t
  modified_base (370)..(370): a, c, t, g, unknown or other
  misc_feature (370)..(370): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctganctgcagaagccgtggggcctcagtgatggtctcctgcagtgcttcgtggttacattcctttccaccgttagtatagtaagttggttgagacgaccggcccccgggagaacggggtcttggaggtggagtggggatggatcgacgtacccgttaacggaaacctaaaacgngtaagtagtaggaagtaagtaaggttaccgagggactaaggtacgtacattacgaactaccgaacccggaccgaacgaacctacgtacccgaacgtacgtaacaacgtacctaagacgtaacggtaactaggacgggactaccgtcaacggtacttacggacgaaccgtacgaccgtaccgtaacgtttactaaccgtcgtacgacgaacggtactaacgttcgtaacaccggtaactttcggtacccgttggaccgtttaccggtaaccctaccggttcgttagggttaccggaccgg

SEQ ID NO: 246422 - DNA, 769 bp, Homo sapiens
  misc_feature: GYAE6OF02FY01I.42.49.E05.1.454.CMB.1.raw
  modified_base (393)..(393): a, c, t, g, unknown or other
  misc_feature (393)..(393): n is a, c, g, or t
  modified_base (621)..(621): a, c, t, g, unknown or other
  misc_feature (621)..(621): n is a, c, g, or t
  modified_base (703)..(703): a, c, t, g, unknown or other
  misc_feature (703)..(703): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtgcagcagcaacaggtgccactcccaggttcaccgtggtgctacgtctggagtcctgagcctgccgtaagaaacggccgtcgggggtccctagtaggtgtacgtggttcctccgtagactagtcgtccgttcgtacggttactacttcctttttacccgaaccgttacggttactaggttaaagtttcgggttaggtaccgaaccggttaccgggacccccgggtaggtaaccgggggtcgtttacggngggttacggggtacggtacggggtacgtacggggtacgtacgtaccggtaccccgttaaacgggtaaaccgtaaaacggtaggtaagtacgtagggtacgagtaacggtaccggaggtacgagactaacgactcgtaaccgtccgtaccgacggtacaactaccgaccgaacgacgtacaccgtaccttaacgacggtaacgtaacggttagacggaccgaccgttancgttaacgcttacggaccgtaaccgaccgtaccgttactttaacggtctacggccgaacgagttacgttagttacggtaacnccgttacggtccggttacccgtgggttccctaacggtacccgcgtaacggttgacgggttacccgg

SEQ ID NO: 246423 - DNA, 907 bp, Homo sapiens
  misc_feature: GYAE6OF02HJG5Z.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccgaggttcaccgtggtgcgtagtctggagctgagctgcagacgccgtgggcctcgagtgtagtggtctaccgtgactggtcgtcttcgtggttactagtttcctttcctaacgttacggtagtagttaacggtttggtttgaacgtaccgtaccgggacccccgggtagggtacgggtacgttaggtaacgggttgggtaaggttggggtagttacgggacgttccggtaccggttaaccccggtttaaaccggaaaaaccgttaaaaacggtaacgggtaaacgggttaaaggttagggtaaaggtaaacggttaaacgggtttacccggaaacgggggtacgtaaagggtacgttaaccgtaagttaacgtaaccggttaaccgaacccgggtacccggaaaccgtaaccgtaacccggttaaacccggaaaccggtaaaccgtaaccggtaaaccggtaccccgttaaacgttaacggtacgggtaaccgtaacggggacgggttacccgtaccgtaacgtaacggcccgttacggaaccggtaaccggtaacccgtaacccggtaaccccgttaaacgttttaccgttaacccggtacggtaccggtaacgtaacgggttacggttaaacctttaggtaacccggttaacgtaccgtttccgggttaaccgttcgggttaccgttaacccgttaacgtcccggtttacggttcggggttacggtaaccccggg

SEQ ID NO: 246424 - DNA, 825 bp, Homo sapiens
  misc_feature: GYAE6OF02HOJL9.42.49.E05.1.454.CMB.1.raw
  modified_base (161)..(161): a, c, t, g, unknown or other
  misc_feature (161)..(161): n is a, c, g, or t
  modified_base (167)..(167): a, c, t, g, unknown or other
  misc_feature (167)..(167): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtncccacncccaggttcacctggtgcagtctggagctgagctgcagaagccgtggggcctcagtgagtcgggtctccgtgacgtagtcgtaccgttcgttggttactacttcctttttacccacccgtttaacggttattacggtaaagttcgggtttaggaacgtaaccgaccgggccccccggtaagggaacgggggtccgttaggacgggtaggaaggttcggggtacgttagggacgttaccgtaaccggtacccggttaaccggtaaaaacgttaaaaaccgaggtaagtacggtaagggtaaggtaacgtaacggttaccggaacggggtactaacgggtaacgtctaacgtcgaacgtaccgtacccggaccggaacacccgtaactcccggtaaacgtacgtaaccgtaacgacccgttaacgacgttacgggaaacgtacgggtaacggacgtaccctaacggacttacgtaccgtacggtaacccggaaccgtacccggtaacttaaccgttttaccgtaaccgttccgacccgggtataacgggttagtaacgtttacgtcggtaaccgttaaccggtcgggtttaacccttcggggtaacccttaacggtaacccgtaaccggtttacgggtttcccggtacgggttaacccgg

SEQ ID NO: 246425 - DNA, 749 bp, Homo sapiens
  misc_feature: GYAE6OF02F03VW.42.49.E05.1.454.CMB.1.raw
  modified_base (198)..(198): a, c, t, g, unknown or other
  misc_feature (198)..(198): n is a, c, g, or t
  modified_base (251)..(251): a, c, t, g, unknown or other
  misc_feature (251)..(251): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtcgcccactcccaggttccaccgtggtgcagtctgganctgagctgcagagccgtggggcctcgagtgagtcggtctcctgcagtgccttntcggttactgttccttttaccaccttacggttatacggtagtttggttagtaggaccgtaccgggccccggaagggtacgggggtccttagggaggtacgggtaggtacgggtaggtacgggtacgtaccgaccggttaccccgttaaaacgggaaaactaaaaccggaaggtaaggtacggtagggaaaggtaacggttaaacggttaccggaggggtacaaggtaacggttacaagttaccaacggttacccgaaccggaaccgaaccgtacaaccgttacccgaaggtaacgttaccgaacgtaccctaacgtagacgttacggagacggtacgctacgacggtactcggtaacgaaccgacgtaacccgggtacctaacgttttaacgtcgtaccggaacggtagaacggttataggtttaactggaacgttcggtacggttccgtacggtaccgttaccgggtacctccggtgtttaccgggaggtaacccgg

SEQ ID NO: 246426 - DNA, 776 bp, Homo sapiens
  misc_feature: GYAE6OF02F07LL.42.49.E05.1.454.CMB.1.raw
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
  modified_base (712)..(712): a, c, t, g, unknown or other
  misc_feature (712)..(712): n is a, c, g, or t
tcagtgacgtatgtcacgaccggtgctcgatttagagcgactagcaacacacaaaggggaccaaaaccacacccctccttcgggagaatccctagatcacagctcctcaccatggacgggacctggagcatccttttcttagggttcggcagccagcaaccaaggttcgcccactccccgaggttccacccttggagcagttccttgggaanccttgactcctggcaggaaacgtccncgggggtcctacgtagttgattcggtcctcctaggtcagttgacctttcgtaggttaccatcttttccgaccttacggtatgttaacttggttatacggtacgacgggtcccccggtaggacgggggtcttacggagttgggngtaaccgggnggttagggtagtctacggtaccccggttaacgtaaacgtaaacctaagggacgtaagttaccgggaggtaagtaaacggtttaccggaacgggtacggtaaacggtaaggttaccgaaaggtttaccgtaaacgttaaccgacccggttaccggaaaccggtaactaaccgttaacccgaaacccggaacggtttaacccgaacgtaaccgttaaccgaagggtttacccggaaaccggttaggaacgggttaaccgtacgaccgtaacgtccgttaagttccggaacgtacgacggaccgtactttaacgtacttacggngttacgacgtagacgttatagcgtaactcggtacgtcgtgtaccgacttacgccttagcgtacg

SEQ ID NO: 246427 - DNA, 792 bp, Homo sapiens
  misc_feature: GYAE6OF02JRJJH.42.49.E05.1.454.CMB.1.raw
  modified_base (196)..(196): a, c, t, g, unknown or other
  misc_feature (196)..(196): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtgcccactcccaggttcacctggtgcagtctgganctgagctgcagagccgtcggggcctcgagtcgagtcggtcctccgtggcctagtcgtcctttcgttacggttactactttccttttcccaccgttaggttactgtaagtttggttagacgtaccgacccgggtaccccgggagggtacggggtacggttggacgggttgggacggttaggaagttcgggtataccgtacggttacccggtttaaacggaaacgtaaacggtacggtaaggtacggtagggaacgtaagggtaaccgttacgggtacggacgtaaggtacgtaccataccgagttacccgaccggtacgacctaactaccgtcccgaacgaacgtaccgaccgtacctaacggtacgtaaggaaccgttaggtaccgggaactcccggtacgaacgtaccgttaggacccgtacgggacccgtaaaccggtacctttaaccgttaccgggtttaaccccgggtaacgggaacttagggttaacctttaggttaaccgtttcggaccggttacggttacccggtttccgtacgggttaccacgggtttaaacccgccgtttaggggttccggttaccgggttacccgg

SEQ ID NO: 246428 - DNA, 770 bp, Homo sapiens
  misc_feature: GYAE6OF02GZNM8.42.49.E05.1.454.CMB.1.raw
  modified_base (207)..(207): a, c, t, g, unknown or other
  misc_feature (207)..(207): n is a, c, g, or t
  modified_base (592)..(592): a, c, t, g, unknown or other
  misc_feature (592)..(592): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattccttttcttggtggcagcagcaacaggtcgcccacctcccaggttccaccgtggtcgcagtcgtggagcgtgngcgtgcgagaacgtccgtgggcctcgagtgacgtcggttcctccgtgcgtagtcgtccgtttcgtcgggttacctactttcccgtttaccaccgttacggttattacggtagtttcggttacgacggtaccgtacccgggtaccccggtagggtaccgggggtcgttagggacgggttaggaggttaggggtacgttacgggacgttcgtaacccggtacccggttaaacggtaaacttaaacggagtaaggtacggtaggaagtaacggtacgtacggaggacgtaacgacgtactacgtacgtacgtaccgacggtaaccgacaccgtacgaccgtaacgtacgacgtcaaccgtagaacgtacggtaacgtggaccggtacnccgtagtactactcggacgaacccggacgtacggtacccttacgtttaaccgtagtacggaccgtacggtaacgtagttacgttacgttaggtacccttaacgggtccgttaaccggttcggtaaccgttaccggttaacccggtacggtttaccgttccgggtaccgttacccgggg

SEQ ID NO: 246429 - DNA, 725 bp, Homo sapiens
  misc_feature: GYAE6OF02FPX6F.42.49.E05.1.454.CMB.1.raw
  modified_base (195)..(195): a, c, t, g, unknown or other
  misc_feature (195)..(195): n is a, c, g, or t
  modified_base (528)..(528): a, c, t, g, unknown or other
  misc_feature (528)..(528): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggancgtgagctgcagagccgtgggcctcagtgatcggtctccgtgctagtgtccttcgttggttactactttcctttaccgaccgttacggtattacgtaagtttggttacgacggtaccgaccgggtacccccgggaagggtacgggggtccgtttagggtaggttacggggagtacggggtagtacgggtacgtaccgacggttaaccccgttaaaccggtaaaaccgtaaaaccgaaggtaacggtaggtaagggaacggtaagtaacggttccgaacgggacgtaaggtacgtacgactacacgtacccgaccggtacgaaccgtacgtacnccgaacgtacgaccacgtacctaagtacgtacggtaacgtggacgaccgtcgacgacgtagtccgagaccggacctaccgggtaccttaacgtttacgttaccgtcgtacggacgtacgggtattacgttacgtacgaccgttcggtccggttcgtacggtcgtaccggtaccgtacggtcgttggccgggtaccgg

SEQ ID NO: 246430 - DNA, 861 bp, Homo sapiens
  misc_feature: GYAE6OF02GNFAC.42.49.E05.1.454.CMB.1.raw
tcagtgacgtatgtcacgaccggtgctcgatttagagcgactagcaacacacaaaggggaccaaaaccacaccctccttgggagaatccctagactcacagctcctcaccatggacgggacctggagcacttcctttttcttggtgacagcagcaacaggtcgacccactcccaggttcaccgtcggtgctagtcgtggagtctggatcgtagcgaaggtaacgccggtggggcctcgaagtgagttcggtccgtcgtacgtcgtacgtcgtccgttagttcggttacttacttccttttacccgaacgttcgttaagtcgttaagttgggttacgacgaccggtacgggccccgggtaaggtcggggttcgtaccggtgggttacggaggttggggaagtacggtctacggaccggttaccgtaaaaccggtaaaacgttaaaaggcggtaaggtttagaaggggacgtaaacggttaaacgggttccggaggggtaacttaacgggaacgttacgtaaactcccggtaaaggtaccgaaccccgggacggtaaaccgtccggtaaaccgttccgggaaaccggtttaaacgaccgggtaaacccgtaacgttaacccgtaacggggtaggaacggttaacgggaaccgggtacgggttaaacccgacgtaaaccggtaacggttcgaaaccgggaacccgtaaccggtaacccggttaccttaagttaaccgttaacgcggtaaccgggtagaacggtaacgttacgtttacgggtaccgtacggttaccgttacgggtccgtaacggtaaccggtttacggaaccggtttacgtaccgggttacgggacccggttcgg

SEQ ID NO: 246431 - DNA, 740 bp, Homo sapiens
  misc_feature: GYAE6OF02F5FS1.42.49.E05.1.454.CMB.1.raw
  modified_base (510)..(510): a, c, t, g, unknown or other
  misc_feature (510)..(510): n is a, c, g, or t
  modified_base (526)..(526): a, c, t, g, unknown or other
  misc_feature (526)..(526): n is a, c, g, or t
  modified_base (570)..(570): a, c, t, g, unknown or other
  misc_feature (570)..(570): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagacaacgaggtcgcccactcccgagttccaccgtggtgcagtcgtggagctgagccgtgacaggaacggccgtcgggcctacgacgtgagtgtcctcgtagcgtagtcgtaccgttcgtacggttaccttcgtttcctttacccgtaacggttacggttatacggttaagttggtaccggacgtaaccggtaccggggaccccggtagggtacgggtacggttaggtacggtgggtaaggtaggtacgtacggtaaccgtaccggttaccgtaccccgggtaaaagtaaaccgtaaacgaacgtaggtaacggtaggtaacggtaggtaccgacggtaggacgtagtagtacagtacncgaccgacgcactacnccttacgaactagaccgactaccgtagacgtacgtacggaacgngaacgtccgatacgtcgacgttaacaccgtacccgacgttaaccgttaacgttaccgtaaggcccgtaacgacgagtttattacggtaccggttcgaacgttccggttacggtacccgaaccgttccgttaccggtaaccgttgggcccggtttaggacgggtaacccgg

SEQ ID NO: 246432 - DNA, 637 bp, Homo sapiens
  misc_feature: GYAE6OF02IQKS8.42.49.E05.1.454.CMB.1.raw
  modified_base (131)..(131): a, c, t, g, unknown or other
  misc_feature (131)..(131): n is a, c, g, or t
  modified_base (153)..(153): a, c, t, g, unknown or other
  misc_feature (153)..(153): n is a, c, g, or t
  modified_base (198)..(198): a, c, t, g, unknown or other
  misc_feature (198)..(198): n is a, c, g, or t
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
  modified_base (479)..(479): a, c, t, g, unknown or other
  misc_feature (479)..(479): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
  modified_base (526)..(526): a, c, t, g, unknown or other
  misc_feature (526)..(526): n is a, c, g, or t
  modified_base (535)..(535): a, c, t, g, unknown or other
  misc_feature (535)..(535): n is a, c, g, or t
  modified_base (584)..(584): a, c, t, g, unknown or other
  misc_feature (584)..(584): n is a, c, g, or t
tcagtgacgtatgtcacgaccggtgctcgatttagagcgactagcaacacacaaaggggacccaaaaaccacacccctccttgggagaatccctagatcacagctcctcaccatggacgggacctggagcntcctttctggtgcagcagcaanacggtcgcccacctcccaggttccacctggtgctagtcgtggacnctgagctgcaaggacgtcgtgggctcgagtgagtggctcgagcgtagtctcttcgtgttaacctcttcctttaccgaaccgttacgtatgtagttcggtagtacgacgcccgggacccggaggtcgggcttaggnggtaggtcgtagggtagtggaccggttnaaccggtccgttaaaccgaaaataacgtcgagtacgtagaagacggttacgtagacggtacaacgagtcagtacgtacgaaccgcgacganacgtacncgaagtcaanctacgtaacngtgaagnggtanctcgaacgntacgcgcaagcgtaccgcttaacgtntaccggtcncggtaagtaccgatttaacgtgcggtttaccacggtttccggttaccgnggttaccctacggtaaccccgtacggtggtttaaccggtcggtaaaccccggg

SEQ ID NO: 246433 - DNA, 734 bp, Homo sapiens
  misc_feature: GYAE6OF02IEBGD.42.49.E05.1.454.CMB.1.raw
  modified_base (160)..(160): a, c, t, g, unknown or other
  misc_feature (160)..(160): n is a, c, g, or t
  modified_base (253)..(253): a, c, t, g, unknown or other
  misc_feature (253)..(253): n is a, c, g, or t
tcagtgacgtatgtcacgaccggtgctcgatttagagcgactagcaacgacacaaaggggacccaaaaaccacacccctccttgggagaatcccctagatcacagctcctcaccatggacggacctggagcatccttttctggtgcagcagcaacaggtncccactcccaggttcacctggtgcagtctaggacgctgagcgtcgacagtaacgccggtagggccctagagtgtacgttggtcctcgtgacgngtgtcgttcgtgttacctagttcctttccgaccgttacggtagttcgtagttaggttacgacggaccgtaccgggacccccgggaggtacggggtccgttaggaggttacgggtacgtaggggtaattcgggagtccgtaacgtcccgtttaaaacgaaacgtaaacgtacggtaacgtagtacgggtagtaacggtaggttaccgaggtaccgaagggtataaccgtactacgacctaccggacccggtacgaacgaccgttaccgaccgtaaccgaggtaacccaaccggtacctaacgtacggtacgaacgtcgggtaacggcgttaaccgtcgacgtaacgccgttacggaaccgttccgacgttacccttacgttacgtttacgacgttcgaacgtacgtacgttagttaacgcgttaaccgtcgtacgttaccgtacggtcgttacgtccgtaacccggttgtggtaccgtacgg

SEQ ID NO: 246434 - DNA, 723 bp, Homo sapiens
  misc_feature: GYAE6OF02GZ4O6.42.49.E05.1.454.CMB.1.raw
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtcncctgcngtgcttctggttactattccttttccaacctacggttatagtagttggttaggaagtacgacggcccccggaggtacggggtcgttacggaggtcggtaggtgggtagtacggtacgtacgaccgtacccgttaacggaaaaccgtaaaacgagtaaggttaagtaggaaggtaaggtaacggttacgaggtacgaaggtacgtacgtagtacgtacgtccgaaccggcgtaaccaaccgtactaaccccgaacggtaaccgtaaccgacggtaccctaagtacgtaacggtaacggttaggaacgggtaccgtaaccgtagtaaccgacgtacgtaacggtaacgacccggaacgtacccgtaacgtttaaccgttacgtcgaaccgcggtaagacgttagtttacgtcggacctaacggttccggtccgttacggtaccgttaaccgtaacccggttaccgtacggtttcggtgggtacccgg

SEQ ID NO: 246435 - DNA, 833 bp, Homo sapiens
  misc_feature: GYAE6OF02HX6QT.42.49.E05.1.454.CMB.1.raw
tcagtgacgtatgtcacgaccggtgctcgatttagagcgactagcaacacacaaaaggggacccaaaaaccacacccctccttgggagaatcccctagatcacagctcctcaccatggcgggacctggagcatccttttcttggtggcagcagcaacaggtgcccactcccaggttcacctggtgcagttctggagcgtgagctgcaggaacgccgtaggggtcctacaggtaggagttcgggtcccttcgttcgaccgtaggttggtcctttcgttacggtttactacttttccctttttacccgtaaccgtttaaccgggttacgttaggttaacgtttgggtttacgacgaccggtaccggggtaccccccgggagggtacggggtccgttaggaggtggtagtcgggtagtggaacgtccgtaaccgtacccgtttaaacggaaaacgttaaaccgaaggtacggttaaggtaggtaaccgggaagttaacggttacccggaaggggacgaaacggtacgtacgtaactaaccgtacgtacccgacccgggaacgaacgtaacccgtacgtaaccccgaggtaaacccgtaacgaccggtaaccctaaccgtaacggtaacgtaacggaacggtagaacccgttacccgaagtactaacggttccgaaacggaccggtaacccgaccgttaacccttaaccgtttaacggtttaccgaggaccgaacgggtagttaagtacctttggtaccgttcgtaaaccggttcgttaccgtaggttactaccgggttaaccgttaccggtccggttttagggccggttaaccggg

SEQ ID NO: 246436 - DNA, 815 bp, Homo sapiens
  misc_feature: GYAE6OF02G5VIF.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtctggagctgagctgcagaagccgtgggcctgagtgatggtctccgtgctaggtcgtcttacgtggttactactttccttttacccgaccgttaacggttatacgttaagttggttaggaacgtaccggacgggacccccggaggggtacggggtccgttaggacgggtacggtaggtagggtacgttagggtactcggaacccggttaccgttaaaccggtaaaaccgtaaaacggacggtaacggttaaggagggtaacggtaacgtaacgggttaccgggaacggaccgaaaggtacggtaacctagtacgtaaccgtaccgaaccgggtccgtaaaccgaccgtaaccgttaaccccggtaaacggtaaacggtaaccgtaaccgtaaccgttaacgtaacggtaaccggtaaacgttacgggaaacggtaccgtaccgtaacgtaacgtaacgttaccgtaaccgggaaccaacccggtacccgtaaccttaaccgtttacgaccgttacgtaaccggtagaacggttacttagttaccgtcggtaacccgtcggttcccggtaccgttggttaaccgtaccgttaccgtacggtccgggtttacggcgggttaacccggg

SEQ ID NO: 246437 - DNA, 738 bp, Homo sapiens
  misc_feature: GYAE6OF02ISMBJ.42.49.E05.1.454.CMB.1.raw
  modified_base (195)..(195): a, c, t, g, unknown or other
  misc_feature (195)..(195): n is a, c, g, or t
  modified_base (519)..(519): a, c, t, g, unknown or other
  misc_feature (519)..(519): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctgganctgagctgcagaagccgtggggcctcaggtgatggtcctcgtgcagtcgcttcgtaggttactattccttttaccaccgttacggttattgtaagtttggttagagtagttaccgggcccccgggtaggtacggggtccttaggaggtgggtagtgggtagtggatacgacgtacccgttaaacggtaaactaaacgtacggtagtaacgtagggaacgtaaggtaacggttaccggaagggtacgtaggtaacggtctacggtaccacgtaccgaccgacggtaaccacgtactacccgaagtacgtaccacgtacccgtaanacggtagaaccggttaggaacggtaccgaccgtacgacgtaccgttacgtacggaacccggtaaccgaccggtaacccgttactttaaccggtcttacggaccggaagtaacggtacgttaggtttactcggttacccgtacggttccggttcggttaccgggtctttaacccggtaaccgttccgggttacggtttacgggtaccgggttaacccggg

SEQ ID NO: 246438 - DNA, 710 bp, Homo sapiens
  misc_feature: GYAE6OF02FT9JO.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgatggtctcctgcaggtgcgttctggttacattcttttccacctacggttatgtaattggtagtagactacgggcccccggtaggaggggcgttgaggtggagtcgggagtcggtgtccgaggtacccttaacgggaaacctaaaacgtagacgtaagtggagaaggtaaccgttacgcgggtacgaggacgtacattcgaactccgtaaccggccgggaaccaaccgactaccgaaccggtaacgtacgacgtacccgttaacagtaccggaacgttacggaacggttaccgccgtacgtactacgtacttacgggaaccgtaacccggaccggtaccttaacgtttaaccgttaacgtaccggccgtaacggtaacgtaagttaacgtaaggtttacgaccttaccgggttcggttaccgttacgggtacctttaacccgggtaaccctacggtttaccggttacgggttcgggtaaccccgg

SEQ ID NO: 246439 - DNA, 768 bp, Homo sapiens
  misc_feature: GYAE6OF02FO311.42.49.E05.1.454.CMB.1.raw
  modified_base (648)..(648): a, c, t, g, unknown or other
  misc_feature (648)..(648): n is a, c, g, or t
  modified_base (673)..(673): a, c, t, g, unknown or other
  misc_feature (673)..(673): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttgggtggcagcacgcaacgtaggtcgcccactcccaggttcacctggtgcagtctggagctgagctgcgaagaacgccgtgggcctcgagtgagtggtcctaccgtgactagtcgtcctttacgtggttaactacgtttccttttacccgtaccgttaacggttacgttagtaagtttcgggttaaggaacggtaccggaaccgggtaccccccgggaagggtaaccggggggtctttagggacgttagggtacgttaggggtaacgttagggaacgttccgtaaaccggtaccccgtttaaaccgggtaaaacgtaaaaaccgtaggtaaggttaaccgtaggggtaaacggtaaggtaaacggtttaccggaagggtacgtaaggtacgtacgtaagtacgactaccgaccggacggtaacacgacctacgaacgacgtacgacgtactaacgtacgacggtaagtggtacgagaccctagacgtacgtaccgtagaccggaccnccgggtaacctaacgttacgttacncggtagaccgtaacgtatacggttagtcgaccgtaggtacccgttacggtccgtacgttacggtaacccgcgttaccggttacggtcggtacccg

SEQ ID NO: 246440 - DNA, 710 bp, Homo sapiens
  misc_feature: GYAE6OF02G8DD3.42.49.E05.1.454.CMB.1.raw
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
tcagtgacgtatgtcacgaccggtgctcgatttagagcgactagcaaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtcgtggagctgagcgtgcagagccgtgggcctgagtgatggtctccgtgcgtagtgtcttcgtgttactnttcctttccacgttacgtntacgtagttggtcgagacgaccgggccccgggaggcggggtcgttggaggttagggaggtgggagtaggacgtcgacgtaccccgttaaacgaaacgtaaaacgtgtaacggtagtaggaacgtaggtacggtacgacgggacgtagtacgtacaagtccacgtaccgaccggtacgaacctaacgtaccgtaaccggtaacgaaccgtaaccgtacgtacccgtaacgtaacgtacgggtaacgtacggaacgtccgtaccgcgtacggacttacggaacgtaccggaaccgtccggaaccttaggttacttacgacggaccgacggtaagtacgttaagttcggtaccgtacgtaccgggttcggttacccgtaggttaccgttaaaccggacccgttacggttaccggttacgggtcgggtaacccgg

SEQ ID NO: 246441 - DNA, 743 bp, Homo sapiens
  misc_feature: GYAE6OF02HG3TR.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggactggagcacttcctttttcgttggtggcagcagcaagaggtcgccccacctcccgaggttcaccgtggtgctagtgtggagctggagctgacgaaggaacggccgtgggccctagaggtgtaagtcggttcctccgtgaacgtgtcgtccgttcgttaggttactacgtttcccgtttaccgtaacgttacggtagttagtagttcgtagaacgtaccgaccgggacccggaggtacggtacgtggtacggtggtaagtggtaagtcggactcgaacgttaaccgttaaacgaaaccgtaaaggagtaacgtagagggaacgtacggtaacggtacgtaacgggactaacggtactaacgtacgtaacgtccgaaccgcccgtaacggaacaccgtaactaccgaacgacgtaaccaccgtactaacggtagtaccggtacgaacggaggtacgacctagtagtaccgtacgaacggaacccgtacgtaccgtaaccttacgttaacgtcggtaccgaaggtacgtaagacttagttaccgtacggtactacccgggtgttaaccccgtagtacccgttaacgtaacccgtacgggttcggttaacggccggttaaccgg

SEQ ID NO: 246442 - DNA, 650 bp, Homo sapiens
  misc_feature: GYAE6OF02JZTFN.42.49.E05.1.454.CMB.1.raw
  modified_base (189)..(189): a, c, t, g, unknown or other
  misc_feature (189)..(189): n is a, c, g, or t
  modified_base (315)..(315): a, c, t, g, unknown or other
  misc_feature (315)..(315): n is a, c, g, or t
  modified_base (398)..(398): a, c, t, g, unknown or other
  misc_feature (398)..(398): n is a, c, g, or t
  modified_base (462)..(462): a, c, t, g, unknown or other
  misc_feature (462)..(462): n is a, c, g, or t
  modified_base (517)..(517): a, c, t, g, unknown or other
  misc_feature (517)..(517): n is a, c, g, or t
  modified_base (601)..(601): a, c, t, g, unknown or other
  misc_feature (601)..(601): n is a, c, g, or t
tcagtgacgtatgtcacgaccggtgctcgatttagagcgactagcaacacgacaaaggggacccaaaaaccacacccctccttgggagaatccccgtagatcacagctcctcaccatggacgggacctggagcatccttttctggtggcagcagcaacgaggtcgcccactcccgaggttcacctggtncgagtctggagctaggtacgctcgacgaggaacgccgtggggcctcgaggtgagttcgtctccgtgcgagttcgcgttctggttacctatttcctttaccgacgttacggtatagtacgttggtanagaccgtcggacccggtggtaacgggtcgtggtacgaggtacgtgggacgtggactcgacggtccgtaacggaacttaaacgngtacgtagtacgaggacgtagtcggaggacgagtcggtactagacgtacgaccgacgtacgganaccagtaccacgtagactacgaacctagcggaagtaccagggtacactaccgtanagtattcgacgtacggacaccggtactacttacgtacgtcgaccgtagtgaacgtcgtttagaacgaccgttcggtaaccgttntaccggtacgtaaccgtacccgtcggttacggtccgggtagtacccggg

SEQ ID NO: 246443 - DNA, 616 bp, Homo sapiens
  misc_feature: GYAE6OF02FK3QE.42.49.E05.1.454.CMB.1.raw
tcagtgacgtatgtcacgaccggtgctcgatttagagcgactagcaacacacaaaggggacccaaaaaccacacccctccttgggagaatccccctagatcaccagctcctcaccatggacgggacctggagcatccttttcttggtggcagcagcaacaggtgcccactcccaggttcacctggtgcagtctggagctgagctgcagaagcctggggcctcgagtgatggtctcctgcagtgcttctggttacattccttttccaccttacggtatgtaagttggttgagacacgggcccccggaggagggggtcttggagtggagtgggagtggatcgacgtcccgttaacggaactaaacgagagtagtggagagtaagttccgagggcaggtagtacatacacgtaccaccggacggaccacacgtaccaacgtacgtacacgtaccctaacgagtacggtaacgtggaacggtacgtcccgtacgtacgtacgttcgtacggaccgtaccgacggtaccctaacgtttacttacgcgcgacgtagtatagttagtcgctacggttggtccgtaggtcttacgtaacccgtacggtcgttggtcggtaccgg

SEQ ID NO: 246444 - DNA, 785 bp, Homo sapiens
  misc_feature: GYAE6OF02JQOAL.42.49.E05.1.454.CMB.1.raw
  modified_base (287)..(287): a, c, t, g, unknown or other
  misc_feature (287)..(287): n is a, c, g, or t
  modified_base (757)..(757): a, c, t, g, unknown or other
  misc_feature (757)..(757): n is a, c, g, or t
tcagtgacgtatgtcacgaccggtgctcgatttagagcgactagcaacacacaaaggggacccaaaaaccacacccctccttgggagaatcccctagatcacagcctcctcaccagtcgggaccgggacctggagcattccttttcttgggtggccagcaacggcaaacgacggtcgcccccgacttccccgaggtttccaccgttggtcgctacgtctgggagtctagagcgtcgacgaacggacgtcccggtcgggccctgaagtggcgttaggtcccttccggngtccgtgtcgtcctttcgtacggttaccttacgtttccctttacccgacgttacggttactaggtagttcggtagtacgaccgtccgggaccccggtagggtagggttcgtcggtaggtacggtacggtgggtagtaggtacgtaccggtaccgtaaccggttaaacggaaaccgtaataacggtaacggtagtaacgggaagtacggtaaccgtagggacggtacgtaaggttacgaccgttactacgttaacgaccggtaaccgactaaccgtacgtaacgtcgaacccgtaggtaccgtacacgtacgtaacgtacgtagtacgacggtacgaccgtcgaagtcgtaaccgtacgtaacccgtaccggaacgttaacccgtcgtttaacgtaaccggaccggtcgaaacgtgtagtttaaccgtacggtacgtaccttaggtccgttaccgtagtccggttaacccncggttacgtcgtagggttaccgtccggg

SEQ ID NO: 246445 - DNA, 824 bp, Homo sapiens
  misc_feature: GYAE6OF02FXKKN.42.49.E05.1.454.CMB.1.raw
  modified_base (196)..(196): a, c, t, g, unknown or other
  misc_feature (196)..(196): n is a, c, g, or t
  modified_base (443)..(443): a, c, t, g, unknown or other
  misc_feature (443)..(443): n is a, c, g, or t
  modified_base (667)..(667): a, c, t, g, unknown or other
  misc_feature (667)..(667): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggaccctggagcacttccttttcttcggtggcacgcagcaacgtaggtcgcccactcccaggttccaccgtgggtncgacgttcgtggacgcttagacgcgtagcaacggacgccggtcgggggtcctccgagtgacgttcggtcctctcgcgagttcgtaccgtttcgtttggtttacctactttccgttttaccccgtaaccttacgggtttacagggtttaagttttcgggttaggaacgaccggtaacccggggaccccccggggaggtaacgggggttcggttaaggtcgggttagggacggttagggaggtggttanaccggtaccgtaaccccgggtttaaacggaaaaccgttaaaacgaggtaacggtaggtaagggaggtaaacgtaccggtacggaacgggtatacgggtactaccaatccgtaacgtacccggtacctaccgggaacctaaccaaccggttaccaaccggtaacgtaacgacccgtacctaacgacggtaacggtaacccgtaggtaacccggtactcccgtaanaaccggttacgtccgtaacggaacgaccgttaacccggaacttaccggttaccttaccgtacggacgtaccgtaagtacggtattaccgtgtaccgttcggtcgtcccggttagtacccgacgttaacccggtaccttaggtccgggtacgtacggg

SEQ ID NO: 246446 - DNA, 806 bp, Homo sapiens
  misc_feature: GYAE6OF02GCWHH.42.49.E05.1.454.CMB.1.raw
  modified_base (618)..(618): a, c, t, g, unknown or other
  misc_feature (618)..(618): n is a, c, g, or t
  modified_base (650)..(650): a, c, t, g, unknown or other
  misc_feature (650)..(650): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcattcctttttcgttgggtggcagctagacaacaggtcgcccctactcccgaggttccaccgttgggtgccaggttcgtgggagtccgtagagtccgtgacgaacgaacgtccggtcggggtccctacgagttcgagttcggtcctccgtcgacgtacgttcgtctttacgttacggttacttacgtttaccgttttaccgtaaccgttacggttagtacggtttaaggtttaggttaccggtaacggtacccggaacccggggtacccccggggtaagggtacggggttacgttacggggacggtttacgggtaggtacggggtacgtacgggttactaccggtacggtaacccggttaaacgtaaaccgttaaacgacgtaacggtagtaggtaactaaggtacgtaggacggtacagtacgagtaacgtcaacgtaccgacgacgtacgaccgtacgtaccgtaggaactacgacgtaccgttanacggtacggaatagggacgtacaccgtaacgntaccgtcggaacgacgtaacccgaccgttacgtttaacgttacgttccgaggtacccaggtacgttggttaacttccgtacgtaccggttcggtacggttaccgttaggttacccgaacggttaacgcggtttccggtacgggtaccggtaaccgg

SEQ ID NO: 246447 - DNA, 706 bp, Homo sapiens
  misc_feature: GYAE6OF02FFWL7.42.49.E05.1.454.CMB.1.raw
  modified_base (505)..(505): a, c, t, g, unknown or other
  misc_feature (505)..(505): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcgagtgagtggtctcctgcagttgtcttcgttggttactacttctttccacctacggttatgtacttggttgagacgacgggccccggaggacggggtcttaggagtggtagtgggatggactcgacgtacccgttaacggaaaccttaaaacaggtaacgtagtagggacggtaaggtaacggtttaccgaacgggtacgaacggtacggtactaacgtcacgttaccgaaccgggaccggaccaacgacttaccgaacgtaacgtaccaacgtacccgttaanacggtacggtaaccgtaggaccgggttacaccgtacgtagtacgtacgtacggaaccgaccgtaccgtacccttacgtttaacgacgttacggccggtacgtagtacgttattacggtttaacgaccgttacggttccggtaccgtaggttacccgttacgtaaacccgttccggttacggttacgggtcggttacccggg

SEQ ID NO: 246448 - DNA, 723 bp, Homo sapiens
  misc_feature: GYAE6OF02F1HAR.42.49.E05.1.454.CMB.1.raw
  modified_base (625)..(625): a, c, t, g, unknown or other
  misc_feature (625)..(625): n is a, c, g, or t
  modified_base (700)..(700): a, c, t, g, unknown or other
  misc_feature (700)..(700): n is a, c, g, or t
  modified_base (713)..(713): a, c, t, g, unknown or other
  misc_feature (713)..(713): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcaccgtggtgcagtctggagctgagctgcagaagcctgggcctcagtcgagtggtctccgtgcagtgtccttactggttactagttcttttcccaccgtacggttatcgtaagtttggtagtacgactacgggccccccgggaggtacgggggtccgttggacggtagggagtggggtagttcgggaacttcgacgtaccccggtttaaaccggtaaaccgtaaaaaccgtaaggaagttaaggtaggaagtaagtaacggtttacggagggtacgagaacggtcaagtacgtagttaccgaacggaccgtaaccgactaaccgtacccgaaccggtaggtaaaccctacggtacccctaacgaacgtacggtaaacgtagaacgggaccgaccgttaccgaagtacgtcgtagaaccgaccgaacgggtacccttacgttacgttacncggccgtacgaggtactacgttagtcggtacgtaccgttcggtaccgttaggaccttttaccggaaacccgtacnccgtttaccgggnggtaacccgg

SEQ ID NO: 246449 - DNA, 683 bp, Homo sapiens
  misc_feature: GYAE6OF02FO2O6.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggcctcgagtgagtggtcctccgtgctagtgtcttcgtggttactacttcctttcctaccgttacgtatgtagttggttagacgacgaccggaccccggaggagggtcgttaggtaggtggtacgtgggagtaggtagtacgacgtacccgttaacggaaaccgtaaaacgaagttttttaaggaagtaggaagtaaggtaacggttaccggaagggacgtaaggagtactatacactaccgaccgacggaacacgactaccgaacgtacgaaccagtacctacgtacgaggtaacgtaggacggtaccgaccgtacgacgtacgtacgtacggtaaccgtaccgaaccggtaccttaaccttaacgttacgtacggtaccgacggtacgtacgtacgttagtcgtaccgtacggtccggtaccgtgttaccgtacgtaccgtccggtacggttcggtacgggtaccgg

SEQ ID NO: 246450 - DNA, 875 bp, Homo sapiens
  misc_feature: GYAE6OF02HLAWY.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggaccgggacctggagcattcctttttcttgggtggcagcagcaacaggtgcccactcccaggttcaccgtggtcgcgagtccgtgggagcgtggagcctgacaggaacgccggtgggacctgacgtgacgtggtcctacgcgagtagtcgtcgtttcgttacggttactactttccgtttacctaacccgttacggttagttacggttaaggtttacggttacggaacggtaacccggtaaccggggtaccccccgggtaggggtaccgggggttacggttacgggtacgggtagggttaacgggtaggggtacggtacgggtaacgtccggtaaccggtaaccccggttaaaccgggtaaaaccgttaaaacggaaacggtaacgttaacggtacgggtaaaggtaacgggtaaacgttacccgggagggtaacgtaacggtaacgtacgtaacgttacgaaccgttaccggaacccggtacgaacccgacctaaccggtacccgtaaccggtaccggttaaaccgaaccgtaccttaaccggaaggttaaccggaaccggtagggaaccggtccgttaccgaaccgtaggtccgttaacggacgggaccgtaacccgaccgggtaacttaacgtttaaccgtcgttacggacggtaaccggtaggttaaccgtaggtttacgtaacgttcggttaccttcggtaccgttaggttccgtaacgtaacggttccgtacggtttcgggacggttaccggg

SEQ ID NO: 246451 - DNA, 900 bp, Homo sapiens
  misc_feature: GYAE6OF02HK0BJ.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacggacctggagcattccttttcttggtggcagcagcaacgaggtcgccccactccccgaggttccaccgtggtcgctagtcgtagggacgcgttaggacgtcgtagaccgaaggaacggtcccggtgggggtccctacgtaggtggtacgttcggtacctccgtggccgtagtgtcctttcgttaggttactaccgtttcctttaccgtaccgttacgtattacgttagtttcggtacgtaaggaccccccccccggagggtaccccgggagggtacgggttcgttaggtagggttacgggtacggtaggggtagtacggtacgttaccgtaaccggtaacccggttaaaacggtaaaaccgtaaaacggtacggttaaggtaacggtacgggtaaacggtaacggttaacggtaaccggaagggtacggtacgtacgtaccgtactaccgtaaccggtaccggacccggaccgtaaccgaccgttaccggaacccgtaaaccgggtaccgtaacccgtacgttacccgaagtaccggtagggtaaaccgtcgggaaccggtcccgtaacgtacggtaacgttaccggtaccggaacggtaacccgaacccggtaaccgttaccgtttaacgtttaacgttaccggaccggtaaccgggttaggaaaccgttacgtttaagttacggttacccgacggttaaccgggttaccggttccggttaccgggtaacctcccgggttaaccgttccgggttacggttcgggtacccgtaaccggggg

SEQ ID NO: 246452 - DNA, 906 bp, Homo sapiens
  misc_feature: GYAE6OF02FMG4N.42.49.E05.1.454.CMB.1.raw
  modified_base (183)..(183): a, c, t, g, unknown or other
  misc_feature (183)..(183): n is a, c, g, or t
  modified_base (518)..(518): a, c, t, g, unknown or other
  misc_feature (518)..(518): n is a, c, g, or t
tcagtgacgtatgtcacgaccggtgctcgatttagagcgactagcaacgacacaaaggggacccaaaaaccacacccctccttgggagaatcccctagatcacagctcctcaccatggacgggacctggagcatccttttctggtggcagcagcaacaggtgccactcccaggttcactggtnacagtctggagctagacgcgtcgacacggtaacgtccggtagggggtcctccgaaggtgtacgttaccggtcctaccggttggacctacggttcggtacctttacggtacggttaccgttatttaccccgtttacccacggttaaccggtttgtaacgtttaaggttccggtttagaacggttaacccggccggggaaccccgggtagggtaaccgggtgttttacggggaggtaacggtgggtagggtagtacgtacgtacggaccggttaccgtaaacgaaaccgtagacgtacggagtaggagtaaacgtacgtacgggagctagtaccgtnaactcggtaacaccgggaactacggtaaccgactaaccctaccggaggtaaaccggacgtaaacgtaccttaaccggttaacgaacggttacctaacggggaccgtaaccgggtccggtaacctagggttaaccgtacccggtttaacggaccccggtaaacccggtaaccgttaacccgtttaacgtttaacccggttaaccgtaccggttaacgggtaaccgggttaacggtaaccggttttaacggtttaccgttaaaccggtaccggtttaaccggggttaacccggtttcccgggtttaaacccgggtacccggttttaacccggtaacccggttttaccggtacggggtttttaacgggggacccggtttaaccccgggggg

SEQ ID NO: 246453 - DNA, 697 bp, Homo sapiens
  misc_feature: GYAE6OF02JMVXN.42.49.E05.1.454.CMB.1.raw
  modified_base (163)..(163): a, c, t, g, unknown or other
  misc_feature (163)..(163): n is a, c, g, or t
  modified_base (275)..(275): a, c, t, g, unknown or other
  misc_feature (275)..(275): n is a, c, g, or t
  modified_base (476)..(476): a, c, t, g, unknown or other
  misc_feature (476)..(476): n is a, c, g, or t
  modified_base (625)..(625): a, c, t, g, unknown or other
  misc_feature (625)..(625): n is a, c, g, or t
tcagtgacgtatgtcacgaccggtgctcgatttagagcgactagcaacacgacgaaaggggacccaaaaaccacacccctccttgggagaatcccctagatcacagctcctcaccagtggacgggacctggagcactcctttcttgggtcgcagcacgcaacnggtgcccactcccgaggttccaccgtggtcgcgtagtccgtagggacgccgtggacgtctcgacgacgaaggcccggtaggggccctagaggtgacgtcggtctacctggcnggtcgcgtttcgtacgttactacttctttaccaccgttaaggtatagtaagttggttacgagtaccgaccgggccccgggaaggcggggtcgtggtaggtaggaggtgggtacgtacgggactaccggaccgtaccgtaacggaaacgtaaacgaggtagtagaggaacgaaggtaacgtcggaagcgtagagtacatacncgtcgaaccgcgtaacactacgtaccgagtaacgtacgacgtaccaacgtcgtaagggtaacacgggtacgtcggacctcgtaaagtccggtaacgacggaccgaaccgtaccggttaaccacgttaacgtcggtaccggagtaacggngttatacggttagtccgaagttcggtaccgtcgttacgacggttacgtaccgcgttaggtcgccggtaacgg

SEQ ID NO: 246454 - DNA, 739 bp, Homo sapiens
  misc_feature: GYAE6OF02FO346.42.49.E05.1.454.CMB.1.raw
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
tcagtgacgtatgtcacgaccggtgctcgatttagagcgactagcaacgacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtgggctcgagtnagtgtctctgcngtgcttcgtggttactagttccttaccaccgttacgtagtacgtaagtttggtcgtaacggtacgacccggaccccgggtaggtacgggggtcttagggacggtggtcggtagggagttaggataccgacgtacccgttaacggaaactaaacgaggacgttagacggagaggtacgtaccggaggactagaacgtcgtatcgtagtcccgaccggacgaccgtaactcgaacccgtacggaacttaccggacttaccggtaaccgtaggtaacccggtaaggttcgggaaacgtaccgtaccgttacgaaacgtttccgtacgggaaccgaccggttaaaccgtacccgggtaacctttaacggttacgttacggtacccggtacggaacgttagttacggtaacgttttagttccccggagtttaaccggtcccggttaccgttagggtaccctttacgggtaacccttaccggtttccggttacgggtacgtcccgggg

SEQ ID NO: 246455 - DNA, 789 bp, Homo sapiens
  misc_feature: GYAE6OF02F05LF.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacaggtcgcccactcccaggttcaccgtggtgcagtcgtggagctgagctgcaggaacgccgtcggggcctcgagtgagtggtcctccgtgctaggtcgtccgtttcgtcggttactatttccttttcccaaccgttacggttactagttaagtttcgggttaggaacggtaccggaccgggtacccccggggagggtacgggggtccgttaggacgggttcgggaacggtggggtagttagggacgtaccgtacggtaacccgtttaaacgggtaaaaccgtaaaaacgtaacggtaaggttaggtaacgggaaggtaaacgggttaacggttaccggagggaacgtaacggtacgtaacgtacgtacctacgtaaccgacccggacggtaaccacgaccgtaaccgaacgtacgtaacgaccgtaccgtaacgtacggtaaggtaacgttcgggaacggtccgttaaccgacgtaagtaccgtcgtaacggacccgaaccgtaccggtaacctaacggtttaactacgtacggtacgacggtaggtacgttaagttcgttaacggcccgttacggtacggttcgtacggtactacgggttacccgtcggtttacgtacgggtcggtacccggg

SEQ ID NO: 246456 - DNA, 808 bp, Homo sapiens
  misc_feature: GYAE6OF02F4ESM.42.49.E05.1.454.CMB.1.raw
  modified_base (157)..(157): a, c, t, g, unknown or other
  misc_feature (157)..(157): n is a, c, g, or t
  modified_base (184)..(184): a, c, t, g, unknown or other
  misc_feature (184)..(184): n is a, c, g, or t
  modified_base (194)..(194): a, c, t, g, unknown or other
  misc_feature (194)..(194): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatcctttcttggtggcagcagcaacnggtgcccactcccaggttcacctggtncagtctgganctgagctgcagaacgccgtggggtcctcgagtgagttcggtctaccgtgactaggttcggtcctttcgtacgggtttaactaccgtttccgtttttacccacccgttaagggttacttaggttaacgttttgggtttaggaaggtaccgaccggggacccccggtaggggtaacggggtccgttaggtacggtcgggtagtacgggggtatagggtactcgtacggtaccccgtttaaacggtaaacctaaaacggtaggtacggtaacgttagggaacggtaacggttaacggttacccgaggggtacctagggaacgttacgtacttaaccggtacgtaccggaacccggtacgtaaccgaaccgtacgttacccgaacggtacgttaaccgacggtaacccctaaggtacgtaacgggtaacctcgggtaaacggtacgtacccgtaccgaacgtacgttacgtaaccggaacgtacccggaaccgtaccgttaacgttttaacgttccgacggttccgaagcggttaacgttacttacggtcgaccgtacggtaccggtaccgtgtacccggtacttaaccggcgtttacggttcggtacggtaacccgg

SEQ ID NO: 246457 - DNA, 681 bp, Homo sapiens
  misc_feature: GYAE6OF02FY24B.42.49.E05.1.454.CMB.1.raw
  modified_base (157)..(157): a, c, t, g, unknown or other
  misc_feature (157)..(157): n is a, c, g, or t
  modified_base (196)..(196): a, c, t, g, unknown or other
  misc_feature (196)..(196): n is a, c, g, or t
  modified_base (349)..(349): a, c, t, g, unknown or other
  misc_feature (349)..(349): n is a, c, g, or t
  modified_base (499)..(499): a, c, t, g, unknown or other
  misc_feature (499)..(499): n is a, c, g, or t
  modified_base (532)..(532): a, c, t, g, unknown or other
  misc_feature (532)..(532): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaanaggtcgcccactcccaggttcacctggtgcagtcgtggngcgtgagctgacgagaaggccgttgggcctcagtgtatggtctccgtcgctagtgtcttcgttaggttactacgtttcctttcccgacgttacggtatgtagtttggtggagacgtaccgggccccggaggtcgggtcgttggaggtggtagngggtagtggtatcgaccgtaccgttaaacggaaacgttaaacgagtacgtagtaggaacgaagttaacggttcggagacgaagtactagtacctacacgtacccgaacgcggaactacaccgtaaccgacgtactaacgactaccgaacncggtaacgtacggaggtaacgagtcctacgacncgtacgacgtaacgaccgaccgtcctaacgttaactacggtccgaggtaccgtaagtcgtaaccttgttaccggacttaccgggttactaccggttacgtaaccgtttacggtaacccttacggtcggttacggttaccgggtacccgg

SEQ ID NO: 246458 - DNA, 1007 bp, Homo sapiens
  misc_feature: GYAE6OF02G7AV4.42.49.E05.1.454.CMB.1.raw
tcagtgacgtatgtcacgaccggtgctcgatttagagcgactagcaacacacaaaggggacccaaaaaccacacccctccttgggagaatcccctagatcacagctcctacaccatggacgggacctggagcatcctttcttggtggcagcagcgaacaggtcgacccactccccgaggttccacctggtcgcgacgtccgtaggtacgcgtgtacgcgtcgaccaggaacggcccggtcggggtccttacgagtacgtacgttcgggccttcgtgtccgtagttcggtctttcttaggttacctgttccgttttaccgacgttaacggtacttacgtacggtttagggttcgtaacggtacgaccggggtaccccggtagggaccgggggtcttacgggtacggttacggtacggtacggggtaagtcggggttaacgtaccgtaaccgggtaccggtttaaaccggaactaaaacggtacgacgttaaggttacgggaacggtaaggttaaccggttaccggacggggtaacggtaacggtaacggtacgaaccggttaacctaccgggtaacccgtaacccgggttacccggaacggttaaaccctacccggtaccggtaaacccggtaacggtaaacccgttccggtaaacccgtaaccgtaacgggttacccgtaaacgggtacgggttaaccggggtaaacccgttacgtaaaccgtaacccggttaccgtttacccggttaccgggaaacccggtttaccccggaaacccgttaacccggttaacgttttaacccgggttaaccccgttaacgggtaaccccggtacgggttaacccgtaaagggtttaacgtttaacccgggttaccggttaaccgtttaacccgggggtttccgttacccggggggtaacccggtttaaccggtttaaccccgggtttaaaccgggaccccgggtttttaaccggggtttcccggtaaccgggggttaaaccccgggg

SEQ ID NO: 246459 - DNA, 793 bp, Homo sapiens
  misc_feature: GYAE6OF02JGOIA.42.49.E05.1.454.CMB.1.raw
  modified_base (135)..(135): a, c, t, g, unknown or other
  misc_feature (135)..(135): n is a, c, g, or t
  modified_base (182)..(182): a, c, t, g, unknown or other
  misc_feature (182)..(182): n is a, c, g, or t
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
  modified_base (400)..(400): a, c, t, g, unknown or other
  misc_feature (400)..(400): n is a, c, g, or t
  modified_base (485)..(485): a, c, t, g, unknown or other
  misc_feature (485)..(485): n is a, c, g, or t
  modified_base (553)..(553): a, c, t, g, unknown or other
  misc_feature (553)..(553): n is a, c, g, or t
tcagtgacgtatgtcacgaccggtgctcgatttagagcgactagcaacacaacaaaggggacccaaaaaccacacccctccttgggagaatcccctagatcacagccttcctcaccagtgggacgggacctggancctattccctttttcgtgggttcggccaagccagccaacgtagggtnacccctcctcccgtaggttccaccgttggngactagttctgggactctagngtcttcgacgaaggacgtcccggttggggaccctgtaagtcgacgttcggttacctcgttgacgtacggttntccgtttcgttaggttaaccngttttacccgtttaccgacccggttagtnttaggttaacgtttggngtaaccgtaccgggcccggtaacccggngggaacggggtttccaggtacgggttagaggtgggtaccgagggtactaccggtaccggttaaccttaaacgggtaaaccgtaancgggttaagtcgtagggaacggttagtaacgttccggaaagggactaggtacctagtaccgtcgtacnccgtaacggtcgaccgtacacgtaccgtacgacgtacagtactaacgtacttaccggaagtcgtagaccggtagtacgacgtactacgaccgtacgtacgccttaaccgttacgttccgttagacgtaccgtagaacttacgttacgtacgtttcgtacggttaccgttacccggttactaccggggtccggtttaaccggttaccgtaccggtcgttaacgggtcccggttaaccgggg

SEQ ID NO: 246460 - DNA, 658 bp, Homo sapiens
  misc_feature: GYAE6OF02GQFHT.42.49.E05.1.454.CMB.1.raw
  modified_base (631)..(631): a, c, t, g, unknown or other
  misc_feature (631)..(631): n is a, c, g, or t
tcagtgacgtatgtcacgaccggtgctcgatttagagcgactagcaacacacaaaggggacccaaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgcttctggttactattccttttcccaccgttacggtattagtaagttggttagagtaccgacgggcccccgggaggtacgggggtcgttggacggtgggtagtggggagtgggtactacgaccgtacccgttaacggtaaactaaagagagtagtaggagtagtacgttacgacggacagagtacagtacatcccgacgccggaacaacgtacctaccgaacgtacgtaccgcgtaccacacgtacggagtacggacgtacgtccgacgtagtacgtacgtaggaccggtacctaccggtaccctaacgtttcgttaccgtacggtcggacgagtacgtagtttacgtcggtaccacggttccggtaccttggtaccttaccggttaaccnccgggttacttggggtacgtacccggg

SEQ ID NO: 246461 - DNA, 219 bp, Homo sapiens
  misc_feature: GYAE6OF01B8DI8.24.86.H09.1.454.CMB.1.raw
  modified_base (217)..(219): a, c, t, g, unknown or other
  misc_feature (217)..(219): n is a, c, g, or t
tcagactactatgtcacgaccggtgctcgatttagtgctatagacttgggtttggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnn

SEQ ID NO: 246462 - DNA, 205 bp, Homo sapiens
  misc_feature: GYAE6OF01B605P.24.86.H09.1.454.CMB.1.raw
  modified_base (202)..(205): a, c, t, g, unknown or other
  misc_feature (202)..(205): n is a, c, g, or t
tcagactactatgtcacgaccggtgctcgatttagtgctatagacttgggtttggggaggtgtgtcacaagatttgggctctgggcaccgtgggcacggggaggtgtgtcacaagatttgggctctgggcacagcggcctgggctgcctggtcaaggactacttccacatagtagtctgagcgggctggcaaggcgcatagnnnn

SEQ ID NO: 246463 - DNA, 219 bp, Homo sapiens; identical to SEQ ID NO: 246461
  misc_feature: GYAE6OF01BYYNS.24.86.H09.1.454.CMB.1.raw
  modified_base (217)..(219): a, c, t, g, unknown or other
  misc_feature (217)..(219): n is a, c, g, or t

SEQ ID NO: 246464 - DNA, 237 bp, Homo sapiens
  misc_feature: GYAE6OF01B3YVS.24.86.H09.1.454.CMB.1.raw
  modified_base (220)..(237): a, c, t, g, unknown or other
  misc_feature (220)..(237): n is a, c, g, or t
tcagactactatgtcacgaccggtgctcgatttagtgctatagacgttgggtttgggggaagaggaagactgacggtcctcccaggagttcaggtgctgggcaccttgggcacgggggaggtgtgtcacaagatttgggctctgggcacagcggcccttgggctgcctggtcaaggctacttccacatagtagtctgagcgggctggcaaggcgcatagnnnnnnnnnnnnnnnnnn

SEQ ID NO: 246465 - DNA, 237 bp, Homo sapiens
  misc_feature: GYAE6OF01BT5DO.24.86.H09.1.454.CMB.1.raw
  modified_base (218)..(237): a, c, t, g, unknown or other
  misc_feature (218)..(237): n is a, c, g, or t
tcagactactatgtcacgaccggtgctcgatttagtgctatagacttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnnnnnnnnnnnnnnnnn

SEQ ID NO: 246466 - DNA, 242 bp, Homo sapiens
  misc_feature: GYAE6OF01BV98J.24.86.H09.1.454.CMB.1.raw
  modified_base (220)..(242): a, c, t, g, unknown or other
  misc_feature (220)..(242): n is a, c, g, or t
tcagactactatgtcacgaccggtgctcgatttagtgctatagacttgggtttgggggaagaggaagactgacggtcctcccaggagttcaggtgctgggcaccttgggcacggggaggtgtgtcacaagatttgggctctgggcacagcgggccctgggctgcctggtcaaggactacttccacatagtagtctggagcgggctggcaaggcgcatagnnnnnnnnnnnnnnnnnnnnnnn

SEQ ID NO: 246467 - DNA, 219 bp, Homo sapiens
  misc_feature: GYAE6OF01BGBR0.24.86.H09.1.454.CMB.1.raw
  modified_base (218)..(219): a, c, t, g, unknown or other
  misc_feature (218)..(219): n is a, c, g, or t
tcagactactatgtcacgaccggtgctcgatttagtgctatagacttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnn

SEQ ID NO: 246468 - DNA, 205 bp, Homo sapiens
  misc_feature: GYAE6OF01D3Q1Y.24.86.H09.1.454.CMB.1.raw
  modified_base (203)..(205): a, c, t, g, unknown or other
  misc_feature (203)..(205): n is a, c, g, or t
tcagactactatgtcacgaccggtgctcgatttagtgctatagacttgggtttggggaggtgtgtcacaagatttgggctctgggcaccgtgggcacggggaggtgtgtcacaagatttgggctctgggcacagcggccctgggctgcctggtcaaggactacttccacatagtagtctgagcgggctggcaaggcgcatagnnn

SEQ ID NO: 246469 - DNA, 222 bp, Homo sapiens
  misc_feature: GYAE6OF01D1MPQ.24.86.H09.1.454.CMB.1.raw
  modified_base (218)..(222): a, c, t, g, unknown or other
  misc_feature (218)..(222): n is a, c, g, or t
tcagactactatgtcacgaccggtgctcgatttagtgctatagacttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnnn

SEQ ID NO: 246470 - DNA, 222 bp, Homo sapiens
  misc_feature: GYAE6OF01AYV18.24.86.H09.1.454.CMB.1.raw
  modified_base (219)..(222): a, c, t, g, unknown or other
  misc_feature (219)..(222): n is a, c, g, or t
tcagactactatgtcacgaccggtgctcgatttagtgctatagacttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnn

SEQ ID NO: 246471 - DNA, 219 bp, Homo sapiens
  misc_feature: GYAE6OF01BLOMJ.24.86.H09.1.454.CMB.1.raw
  modified_base (219)..(219): a, c, t, g, unknown or other
  misc_feature (219)..(219): n is a, c, g, or t
tcagactactatgtcacgaccggtgctcgatttagtgctatagacttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagn

SEQ ID NO: 246472 - DNA, 221 bp, Homo sapiens
  misc_feature: GYAE6OF01CMMQK.24.86.H09.1.454.CMB.1.raw
  modified_base (219)..(221): a, c, t, g, unknown or other
  misc_feature (219)..(221): n is a, c, g, or t
tcagactactatgtcacgaccggtgctcgatttagtgctatagacttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnn

SEQ ID NO: 246473 - DNA, 221 bp, Homo sapiens; identical to SEQ ID NO: 246472
  misc_feature: GYAE6OF01BBDAD.24.86.H09.1.454.CMB.1.raw
  modified_base (219)..(221): a, c, t, g, unknown or other
  misc_feature (219)..(221): n is a, c, g, or t

SEQ ID NO: 246474 - DNA, 220 bp, Homo sapiens
  misc_feature: GYAE6OF01BK9T3.24.86.H09.1.454.CMB.1.raw
  modified_base (219)..(220): a, c, t, g, unknown or other
  misc_feature (219)..(220): n is a, c, g, or t
tcagactactatgtcacgaccggtgctcgatttagtgctatagacttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnn

SEQ ID NO: 246475 - DNA, 209 bp, Homo sapiens
  misc_feature: GYAE6OF01EBYHS.24.86.H09.1.454.CMB.1.raw
  modified_base (204)..(209): a, c, t, g, unknown or other
  misc_feature (204)..(209): n is a, c, g, or t
tcagactactatgtcacgaccggtgctcgatttagtgctatagacttgggtttgggggaggtgtgtcacaagatttgggctctgggcaccgtgggcacggggaggtgtgtcacaagatttgggctctgggcacagcggccctgggctgcctggtcaaggactacttccacatagtagtctgagcgggctggcaaggcgcatagnnnnnn

SEQ ID NO: 246476 - DNA, 237 bp, Homo sapiens
  misc_feature: GYAE6OF01AVA7S.24.86.H09.1.454.CMB.1.raw
  modified_base (202)..(237): a, c, t, g, unknown or other
  misc_feature (202)..(237): n is a, c, g, or t
tcagactactatgtcacgaccggtgctcgatttagtgctatagacttgggtttggggaggtgtgtcacaagatttgggctctgggcaccgtgggcacggggagtgtgtcacaagatttgggctctgggcacagcggccctgggctgcctggtcaaaggctacttccacatagtagtctgagcgggctggcaaggcgcatagnnnnnnnnnnnnnnnnnnnnnnnnnnnnnnnnnnnn

SEQ ID NO: 246477 - DNA, 204 bp, Homo sapiens
  misc_feature: GYAE6OF01EDNUW.24.86.H09.1.454.CMB.1.raw
  modified_base (203)..(204): a, c, t, g, unknown or other
  misc_feature (203)..(204): n is a, c, g, or t
tcagactactatgtcacgaccggtgctcgatttagtgctatagacttgggtttgggggaggtgtgtcacaagatttgggctctgggcaccgtgggcacggggaggtgtgtcacaagatttgggctctggcacagcggccctgggctgcctggtcaaggactacttccacatagtagtctgagcgggctggcaaggcgcatagnn

SEQ ID NO: 246478 - DNA, 209 bp, Homo sapiens
  misc_feature: GYAE6OF01CKX7O.24.86.H09.1.454.CMB.1.raw
  modified_base (205)..(209): a, c, t, g, unknown or other
  misc_feature (205)..(209): n is a, c, g, or t
tcagactactatgtcacgaccggtgctcgatttagtgctatagacttgggtttgggggaggtgtgtcacaagatttgggctctgggcaccgtgggcacgggggaggtgtgtcacaagatttgggctctgggcacagcggccctgggctgcctggtcaaggactacttccacatagtagtctgagcgggctggcaaggcgcatagnnnnn

SEQ ID NO: 246479 - DNA, 221 bp, Homo sapiens
  misc_feature: GYAE6OF01DQD0U.24.86.H09.1.454.CMB.1.raw
  modified_base (220)..(221): a, c, t, g, unknown or other
  misc_feature (220)..(221): n is a, c, g, or t
tcagactactatgtcacgaccggtgctcgatttagtgctatagacttgggtttgggggaagaggaagactgacggtcctcccaggagttcaggtgctgggcaccttgggcacgggggaggtgtgtcacaagatttgggctctgggcacaggcggccctgggctgcctggtcaaggactacttccacatagtagtctgagcgggctggcaaggcgcatagnn

SEQ ID NO: 246480 - DNA, 223 bp, Homo sapiens
  misc_feature: GYAE6OF01C32TC.24.86.H09.1.454.CMB.1.raw
  modified_base (184)..(184): a, c, t, g, unknown or other
  misc_feature (184)..(184): n is a, c, g, or t
  modified_base (218)..(223): a, c, t, g, unknown or other
  misc_feature (218)..(223): n is a, c, g, or t
tcagactactatgtcacgaccggtgctcgatttagtgctatagacttgggtttggggggaagaggaagactgacggtcctcccaggagttcaggtgctgggcaccttgggcacgggggaggtgtgtcacaagatttgggctctgggcacagcggccctgggctgcctggtcaaggctactccanatagtagtctgagcgggctggcaaggcgcatagnnnnnn

SEQ ID NO: 246481 - DNA, 227 bp, Homo sapiens
  misc_feature: GYAE6OF01A5UF5.24.86.H09.1.454.CMB.1.raw
  modified_base (221)..(227): a, c, t, g, unknown or other
  misc_feature (221)..(227): n is a, c, g, or t
tcagactactatgtcacgaccggtgctcgatttagtgctatagacttgggtttgggggaagaggaagactgacggtcctcccaggagttcaggtgctgggcaccgttgggcacgggggaggtgtgtcacaagatttgggctctgggcacagcggccctgggctgcctggtcaaggactacttccacatagtagtctgagcgggctgggcaaggcgcatagnnnnnnn

SEQ ID NO: 246482 - DNA, 225 bp, Homo sapiens
  misc_feature: GYAE6OF01E4NSD.24.86.H09.1.454.CMB.1.raw
  modified_base (220)..(225): a, c, t, g, unknown or other
  misc_feature (220)..(225): n is a, c, g, or t
tcagactactatgtcacgaccggtgctcgatttagtgctatagacttgggtttggggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnnnn

SEQ ID NO: 246483 - DNA, 232 bp, Homo sapiens
  misc_feature: GYAE6OF01ASZ96.24.86.H09.1.454.CMB.1.raw
  modified_base (221)..(232): a, c, t, g, unknown or other
  misc_feature (221)..(232): n is a, c, g, or t
tcagactactatgtcacgaccggtgctcgatttagtgctatagacttgggtttggggggaagaggaagactgacggtcctcccaggagttcaggtgctgggcaccttgggcacgggggaggtgtgtcacaagattgggctctgggcacaggcggccctgggctgcctggtcaaggactacttccacatagtagtctgaggcgggctggcaaggcgcatagnnnnnnnnnnnn

SEQ ID NO: 246484 - DNA, 240 bp, Homo sapiens
  misc_feature: GYAE6OF01EKONI.24.86.H09.1.454.CMB.1.raw
  modified_base (222)..(240): a, c, t, g, unknown or other
  misc_feature (222)..(240): n is a, c, g, or t
tcagactactatgtcacgaccggtgctcgatttagtgctatagacttggggtttgggggggaagaggaagactgacggtcctcccaggagttcaggtgctgggcaccgttgggcacgggggaggtgtgtcacaagatttgggctctgggcacagcggcctgggctgcctggtcaaggactacttccacatagtagtctgagcgggctggcaaggcgcatagnnnnnnnnnnnnnnnnnnn

SEQ ID NO: 246485 - DNA, 218 bp, Homo sapiens
  misc_feature: GYAE6OF02GKMQH.24.86.H09.1.454.CMB.1.raw
  modified_base (217)..(218): a, c, t, g, unknown or other
  misc_feature (217)..(218): n is a, c, g, or t
tcagactactatgtcacgaccggtgctcgatttagtgctatagacttgggtttggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnn

SEQ ID NO: 246486 - DNA, 218 bp, Homo sapiens; identical to SEQ ID NO: 246485
  misc_feature: GYAE6OF02GC0SZ.24.86.H09.1.454.CMB.1.raw
  modified_base (217)..(218): a, c, t, g, unknown or other
  misc_feature (217)..(218): n is a, c, g, or t

SEQ ID NO: 246487 - DNA, 207 bp, Homo sapiens
  misc_feature: GYAE6OF02IZ0J2.24.86.H09.1.454.CMB.1.raw
  modified_base (203)..(207): a, c, t, g, unknown or other
  misc_feature (203)..(207): n is a, c, g, or t
tcagactactatgtcacgaccggtgctcgatttagtgctatagacttgggtttggggaggtgtgtcacaagatttgggctctgggcaccgtgggcacggggaggtgtgtcacaagatttgggctctgggcacagcggccctgggctgcctggtcaaggactacttccacatagtagtctgagcgggctggcaaggcgcatagnnnnn

SEQ ID NO: 246488 - DNA, 259 bp, Homo sapiens
  misc_feature: GYAE6OF02GBJVS.24.86.H09.1.454.CMB.1.raw
  modified_base (221)..(259): a, c, t, g, unknown or other
  misc_feature (221)..(259): n is a, c, g, or t
tcagactactatgtcacgaccggtgctcgatttagtgctatagacttgggttgggggaagaggaagactgacggtcctcccaggagttcaggtgcttgggcaccttgggcacggggaggtgtgtcacaagatttgggctctgggcacagcggccctgggctgccctgggtcaaggactacttccacgatagtagtctgagcgggctggcaaggcgcatagnnnnnnnnnnnnnnnnnnnnnnnnnnnnnnnnnnnnnnn

SEQ ID NO: 246489 - DNA, 207 bp, Homo sapiens
  misc_feature: GYAE6OF02HR71K.24.86.H09.1.454.CMB.1.raw
  modified_base (205)..(207): a, c, t, g, unknown or other
  misc_feature (205)..(207): n is a, c, g, or t
tcagactactatgtcacgaccggtgctcgatttagtgctatagacttgggtttgggggaggtgtgtcacaagatttgggctctgggcaccgtgggcacgggggaggtgtgtcacaagatttgggctctgggcacagcggccctgggctgcctggtcaaggactacttccacatagtagtctgagcgggctggcaaggcgcatagnnn

SEQ ID NO: 246490 - DNA, 219 bp, Homo sapiens; identical to SEQ ID NO: 246467
  misc_feature: GYAE6OF02G9VYT.24.86.H09.1.454.CMB.1.raw
  modified_base (218)..(219): a, c, t, g, unknown or other
  misc_feature (218)..(219): n is a, c, g, or t

SEQ ID NO: 246491 - DNA, 222 bp, Homo sapiens
  misc_feature: GYAE6OF02JJK5K.24.86.H09.1.454.CMB.1.raw
  modified_base (219)..(222): a, c, t, g, unknown or other
  misc_feature (219)..(222): n is a, c, g, or t
tcagactactatgtcacgaccggtgctcgatttagtgctatagacttgggtttgggggaaggaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnnn

SEQ ID NO: 246492 - DNA, 219 bp, Homo sapiens; identical to SEQ ID NO: 246461
  misc_feature: GYAE6OF02G6V6H.24.86.H09.1.454.CMB.1.raw
  modified_base (217)..(219): a, c, t, g, unknown or other
  misc_feature (217)..(219): n is a, c, g, or t

SEQ ID NO: 246493 - DNA, 220 bp, Homo sapiens
  misc_feature: GYAE6OF02FNCV8.24.86.H09.1.454.CMB.1.raw
  modified_base (218)..(220): a, c, t, g, unknown or other
  misc_feature (218)..(220): n is a, c, g, or t
tcagactactatgtcacgaccggtgctcgatttagtgctatagacttgggtttgggggaagaggaagactgacggtcctcccaggagttcaggtgctgggcaccttgggcacggggaggtgtgtcacaagatttgggctctgggcacagcggccctgggctgcctggtcaaggactacttccacatagtagtctgagcgggctggcaaggcgcatagnnn

SEQ ID NO: 246494 - DNA, 220 bp, Homo sapiens; identical to SEQ ID NO: 246493
  misc_feature: GYAE6OF02GBBNU.24.86.H09.1.454.CMB.1.raw
  modified_base (218)..(220): a, c, t, g, unknown or other
  misc_feature (218)..(220): n is a, c, g, or t

SEQ ID NO: 246495 - DNA, 209 bp, Homo sapiens
  misc_feature: GYAE6OF02FR9XY.24.86.H09.1.454.CMB.1.raw
  modified_base (204)..(209): a, c, t, g, unknown or other
  misc_feature (204)..(209): n is a, c, g, or t
tcagactactatgtcacgaccggtgctcgatttagtgctatagacttgggtttgggggaggtgtgtcacaagatttgggctctgggcaccgtgggcacgggggaggtgtgtcacaagatttgggctctgggcacagcggccctgggctgcctggtcaaggactacttccacatagtagtctgagcggctggcaaggcgcatagnnnnnn

SEQ ID NO: 246496 - DNA, 264 bp, Homo sapiens
  misc_feature: GYAE6OF02F8HRM.24.86.H09.1.454.CMB.1.raw
  modified_base (227)..(264): a, c, t, g, unknown or other
  misc_feature (227)..(264): n is a, c, g, or t
tcagactactatgtcacgaccggtgctcgatttagtgctatagacttgggtttagggggggaagaggaagactgacggtcctcccagggagttcaggtgctgggcaccgttgggccacgggggaggtgtcgtcacaagatttgggctctgggcacagcggccctgggctgcctggtcaaggactacttccacatagtagtctgagccgggctggcaaggcgcatagnnnnnnnnnnnnnnnnnnnnnnnnnnnnnnnnnnnnnn

SEQ ID NO: 246497 - DNA, 263 bp, Homo sapiens
  misc_feature: GYAE6OF02G3ZMG.24.86.H09.1.454.CMB.1.raw
  modified_base (216)..(216): a, c, t, g, unknown or other
  misc_feature (216)..(216): n is a, c, g, or t
  modified_base (222)..(263): a, c, t, g, unknown or other
  misc_feature (222)..(263): n is a, c, g, or t
tcagactactatgtcacgaccggtgctcgatttagtgctatagacttgggtttgggggaagggaggaagactgacggtcctcccaggagttcgaggtgctgggcaccttgggcacgggggaggtgtgtcacaagatttgggctctgggcacagcggccctgggctgcctggtcaaggactacttccacatagtagtctgagcgggctggcaaggcncatagnnnnnnnnnnnnnnnnnnnnnnnnnnnnnnnnnnnnnnnnnn

SEQ ID NO: 246498 - DNA, 254 bp, Homo sapiens
  misc_feature: GYAE6OF02H2I4B.24.86.H09.1.454.CMB.1.raw
  modified_base (196)..(196): a, c, t, g, unknown or other
  misc_feature (196)..(196): n is a, c, g, or t
  modified_base (213)..(254): a, c, t, g, unknown or other
  misc_feature (213)..(254): n is a, c, g, or t
tcagactactatgtcacgaccggtgctcgatttagtgctatagacttgggttttggggggaggtgtgtcacaagatttgggctctgggctaccgtgggcacgggggaggtgtgtcacaagatttgggctctgggcacagcggccttgggctgcctggttcaaggactacttccactatagtagtctgaggcggtgnggacgaggcgatagagnnnnnnnnnnnnnnnnnnnnnnnnnnnnnnnnnnnnnnnnnn

SEQ ID NO: 246499 - DNA, 229 bp, Homo sapiens
  misc_feature: GYAE6OF02IIOSQ.24.86.H09.1.454.CMB.1.raw
  modified_base (219)..(229): a, c, t, g, unknown or other
  misc_feature (219)..(229): n is a, c, g, or t
tcagactactatgtcacgaccggtgctcgatttagtgctatagacttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnnnnnnnnn

SEQ ID NO: 246500 - DNA, 223 bp, Homo sapiens
  misc_feature: GYAE6OF02GYSDQ.24.86.H09.1.454.CMB.1.raw
  modified_base (219)..(223): a, c, t, g, unknown or other
  misc_feature (219)..(223): n is a, c, g, or t
tcagactactatgtcacgaccggtgctcgatttagtgctatagacttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnnn

SEQ ID NO: 246501 - DNA, 227 bp, Homo sapiens
  misc_feature: GYAE6OF02FSS5T.24.86.H09.1.454.CMB.1.raw
  modified_base (220)..(227): a, c, t, g, unknown or other
  misc_feature (220)..(227): n is a, c, g, or t
tcagactactatgtcacgaccggtgctcgatttagtgctatagacttgggtttgggggaagaggaagactgacggtcctcccaggagttcaggtgctgggcaccttgggcacgggggaggtgtgtcacaagatttgggctctggggcacagcggccctgggctgcctggtcaaggactacttccacatagtagtctgagcgggctggcaaggcgcatagnnnnnnnn

SEQ ID NO: 246502 - DNA, 209 bp, Homo sapiens
  misc_feature: GYAE6OF02GFS14.24.86.H09.1.454.CMB.1.raw
  modified_base (196)..(196): a, c, t, g, unknown or other
  misc_feature (196)..(196): n is a, c, g, or t
  modified_base (202)..(209): a, c, t, g, unknown or other
  misc_feature (202)..(209): n is a, c, g, or t
tcagactactatgtcacgaccggtgctcgatttagtgctatagacttgggtttggggaggtgtgtcacaagatttgggctctgggcaccgtgggcacggggagtgtgtcacaagatttgggctctgggcacagcggccctgggctgcctggtcaaggactacttccacatagtagtctgagcgggctggcaaggcncatagnnnnnnnn

SEQ ID NO: 246503 - DNA, 231 bp, Homo sapiens
  misc_feature: GYAE6OF02HNGC4.24.86.H09.1.454.CMB.1.raw
  modified_base (219)..(231): a, c, t, g, unknown or other
  misc_feature (219)..(231): n is a, c, g, or t
tcagactactatgtcacgaccggtgctcgatttagtgctatagacttgggtttggggggaagaggaagactgacggtcctcccaggagttcaggtgctgggcaccttgggcacgggggagtgtgtcacaagatttgggctctgggcacagcggccctgggctgcctggtcaaggctacttccaacatagtagtctgagcgggctggcaaggcgcatagnnnnnnnnnnnnn

SEQ ID NO: 246504 - DNA, 233 bp, Homo sapiens
  misc_feature: GYAE6OF02H088A.24.86.H09.1.454.CMB.1.raw
  modified_base (219)..(233): a, c, t, g, unknown or other
  misc_feature (219)..(233): n is a, c, g, or t
tcagactactatgtcacgaccggtgctcgatttagtgctatagacttgggtttgggggaagaggaagactgacggtcctcccaggagttcaggtgctgggcaccttgggcacgggggaggtgtgtcacaagatttgggctctgggcacagcggccctgggctgcctggtcaaggactacttccacatagtagtctgagcgggctggcaaggcgcatagnnnnnnnnnnnnnnn

SEQ ID NO: 246505 - DNA, 232 bp, Homo sapiens
  misc_feature: GYAE6OF02GOXN4.24.86.H09.1.454.CMB.1.raw
  modified_base (205)..(205): a, c, t, g, unknown or other
  misc_feature (205)..(205): n is a, c, g, or t
  modified_base (221)..(232): a, c, t, g, unknown or other
  misc_feature (221)..(232): n is a, c, g, or t
tcagactactatgtcacgaccggtgctcgatttagtgctatagacttggggtttggggggaagaggaagactgacggtcctcccaggagttcaggtgctgggcaccttgggcacggggggaggtgtgtcacaagatttgggctctgggcacagcggccctgggctgcctggtcaaggctacttccacatagtagtctgagcgggntggcaaggcgcatagnnnnnnnnnnnn

SEQ ID NO: 246506 - DNA, 230 bp, Homo sapiens
  misc_feature: GYAE6OF02IS92I.24.86.H09.1.454.CMB.1.raw
  modified_base (207)..(230): a, c, t, g, unknown or other
  misc_feature (207)..(230): n is a, c, g, or t
tcagactactatgtcacgaccggtgctcgatttagtgctatagacttggggtttgggggaggtgtgtcacaaagatttgggctctgggcaccgtgggcacgggggaggtgtgtcacaagatttgggctctgggcacagcggccctgggctgcctggtcaaggactacttccacatagtagtctgagcgggctggcaaggcgcatagnnnnnnnnnnnnnnnnnnnnnnnn

SEQ ID NO: 246507 - DNA, 521 bp, Homo sapiens
  misc_feature: GYAE6OF02I2CHJ.24.86.H09.1.454.CMB.1.raw
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (330)..(333): a, c, t, g, unknown or other
  misc_feature (330)..(333): n is a, c, g, or t
  modified_base (428)..(429): a, c, t, g, unknown or other
  misc_feature (428)..(429): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (451)..(451): a, c, t, g, unknown or other
  misc_feature (451)..(451): n is a, c, g, or t
  modified_base (477)..(477): a, c, t, g, unknown or other
  misc_feature (477)..(477): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
tcagactactatgtcacgaccggtgctcgatttagtgctatagacttggggtttgggggaacgaggaacgactgaccggtcctccaggagttccaggtgctggacaccttgggacacggggaggtgtgtcacgaaggtatttcgggcttcgtggggcacgagcggtccctgggctcggtccctaggtccaaagggtcctacgttccacagtagtagtctgggaacgtcgggctgggaccaagggccgcgattaggntagagtngacgctcngngactcngtgatacntntcgtngtagtgcngcgcgcgngtagtctagtgatgngaccnnnngcgtagtacgtacgtacgatactacgtacgtacacgtacgtcgtcgacgtacgtcgacgacacgacgagacgacgactcgcgacgacgcgacganncgngtgtagngntgcgngnagngtagacgagatcgtcgagtacgtgtngagagagtagcgngcncgcgtcgcgcgtcgtcncgtcncncntc

SEQ ID NO: 246508 - DNA, 524 bp, Homo sapiens
  misc_feature: GYAE6OF01BC2KZ.9.70.G04.1.454.CMB.1.raw
  modified_base (233)..(233): a, c, t, g, unknown or other
  misc_feature (233)..(233): n is a, c, g, or t
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctactggacctggatccggcagtccgccggcaagggactggagtatattggacgaatctatgccagtgggaccnccatctacaacccgtcctcaagngtcgagtcagcatgtcagtcgacacgtcccagaaccagttctccctgacagtgagttatatgaccgccgcagacacggccgtgtattactgtgcgagagaggccgttatttaggaccagtctagttaaaactcctactacggtctgacgtcgngggccnggggcctaacggg

SEQ ID NO: 246509 - DNA, 571 bp, Homo sapiens
  misc_feature: GYAE6OF01CUKBK.9.70.G04.1.454.CMB.1.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtnactccatcagaggtggtcgttcctatggacctggatccggnacgtccgccggcaaggggctggatatagttggacgaatctancgccaggtcggaccgcatctaccaacccgtcctanaagacgtcgagtcagcatgtcagtcgacacgtccagaacctacgtctccctgacagtagagttatatcgaccgcgacacgacacggccgtgtacttacgtgtagacgagagacggtaccgttagtttacggacctagtacgtaacgttaaaactcgttaaccgttacggtacgttacgggtaccgttacggtaggggacccgacggggtaccgtaacggg

SEQ ID NO: 246510 - DNA, 534 bp, Homo sapiens
  misc_feature: GYAE6OF01ATWZN.9.70.G04.1.454.CMB.1.raw
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccncatctacaacccgtcctnaagngtcgagtcagcatgtcagtcacacgtccagaaccagttctccctgacagtgagttatatgaccgccgcagacacggccgtgtacttactgtgcgagagaggtccgttagtttacggacctagtactagttaaaactcctaacgtacggtctaggtacgtcgtggggccgaggggaccgtaacgg

SEQ ID NO: 246511 - DNA, 531 bp, Homo sapiens
  misc_feature: GYAE6OF01B0SGE.9.70.G04.1.454.CMB.1.raw
  modified_base (499)..(499): a, c, t, g, unknown or other
  misc_feature (499)..(499): n is a, c, g, or t
  modified_base (518)..(518): a, c, t, g, unknown or other
  misc_feature (518)..(518): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccgccatctacaacccgtcctcaagagtcgagtcagcatgtcagtcgacacgtcccagaaccagttctccctgacagtgagttatatgaccgccgcagacacgggccgtgtattacgtgtgcgagagaggtccgttatttaggaccagtcgtagttaaaactcctactacggtntcggtacgtcgtggggccnggggacctaacgg

SEQ ID NO: 246512 - DNA, 600 bp, Homo sapiens
  misc_feature: GYAE6OF01B85GG.9.70.G04.1.454.CMB.1.raw
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacaatctatgccagtgggaccncatctacaacccgtcctacgaagngtcgagtcagcatgtcagtcgacaccgtcccagaaccacgttcctccctgacagtagtagttatatcgacccgccgacgacgacaccgggccgttgtaactttacgtgttcgacgaggaggtacggtaccggtttaagttttaacggaccgtaagtaccgttaacgttaaaaaccttccgttaacgttaccggttctttacggtaccgttacggtacgggggacccgaagggggtaacccgtaaccggg

SEQ ID NO: 246513 - DNA, 533 bp, Homo sapiens
  misc_feature: GYAE6OF01ETJZ7.9.70.G04.1.454.CMB.1.raw
  modified_base (520)..(520): a, c, t, g, unknown or other
  misc_feature (520)..(520): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccgacagtccgccggcaagggctggagtatattggacgaatctatgccagtgggaccgccatcctacaacccgtcctcaagagtcgagtcagcatgtcagtcgacacgtcccagaacccagttcctccctgacagtgagttatatgacccgccgcagacacggccgtgtattacgtgtgcgagagaggtccgttagtttaggacctagtctagttaaaactcctactacgtctggtacgtcgtgggccgngggaccgtaacgg

SEQ ID NO: 246514 - DNA, 556 bp, Homo sapiens
  misc_feature: GYAE6OF01BKEQE.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatagttggacgaatctatgccagtcgggaccgccatcctaacaaccccgtccctacaagcgtcgagtcagcatgtcagtcgacacgtcccagaaccagttcctcctgacagtgagttatatcgaccgcgcagacacggcgtgtacttacgtgtgcgagagacggtccgtttaatttacggacctagcttaacgttaaaactccttaccgtacggtacgtacggtacgttcgtaggggaccgaggggaaccgtaacggg

SEQ ID NO: 246515 - DNA, 527 bp, Homo sapiens
  misc_feature: GYAE6OF01BFWVY.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatagttggacgaatctatgccagtggaccgcatcacaacccgtcctcaagagtcgagtcagcatgtcagtcgacacgtccagaaccagtcctccctgacagtgagttatatcgaccgccgcagacacggcgtgtattacgtgtgcgagagacggtccgttatttacggacctagtctacgttaaactcctacgtacgtctggtacgtcgtagggccgaggggctaacgg

SEQ ID NO: 246516 - DNA, 547 bp, Homo sapiens
  misc_feature: GYAE6OF01EBTFR.9.70.G04.1.454.CMB.1.raw
  modified_base (354)..(354): a, c, t, g, unknown or other
  misc_feature (354)..(354): n is a, c, g, or t
  modified_base (358)..(358): a, c, t, g, unknown or other
  misc_feature (358)..(358): n is a, c, g, or t
  modified_base (461)..(461): a, c, t, g, unknown or other
  misc_feature (461)..(461): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggcacgtccgccggcaagggctggagtatagttggacgaatctatgccaggtcgggaccgcatacctaccaacccgtcctanaagngtcgagtcagcatgtcagtcgacacgtcccagacctacgttcctccctgacagtgtagttatagtcgaccgccgcacgacgaccggcgtagtattacgtgtgngagagaggtcgttagttacgactagtacgtacgttaaactctacgtacggtcgtacggtacgtcgtagggccgagggacgtaacgg

SEQ ID NO: 246517 - DNA, 561 bp, Homo sapiens
  misc_feature: GYAE6OF01BSWG2.9.70.G04.1.454.CMB.1.raw
  modified_base (328)..(328): a, c, t, g, unknown or other
  misc_feature (328)..(328): n is a, c, g, or t
  modified_base (390)..(390): a, c, t, g, unknown or other
  misc_feature (390)..(390): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggctggagtatagttggacgaatctatgccagtgggaccncatctaccaacccgtcctacaagagtcgagtcagcatgtcagtcgacacgtcccacgaaccngttcctccctgacagtcgtagttatactgacccgccgacacgacacggccgtgtacttacgtgtgacgagacggaggtaccgtttagtttacggacctagtacttacgttaaaactccttaacgtacggtcgttacggtacgtcgtaggggccgacggggaccgtaacggg

SEQ ID NO: 246518 - DNA, 543 bp, Homo sapiens
  misc_feature: GYAE6OF01A0LFI.9.70.G04.1.454.CMB.1.raw
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (423)..(423): a, c, t, g, unknown or other
  misc_feature (423)..(423): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctgggagtatattggacgaatctatgccagtgggaccncatctacaacccgtcctnaagngtcgagtcagcatgtcagtcgacaccgtcccagaacccagttcctcctgacagtgagttatagtgaccgccncagaccacggcgtgtattacgtgtgcgagagacggtccgttagttacggaccagtacgttaagttaaaactcctacgttacggtcgtcggtacgtcgtaggggccaggggacctaacggg

SEQ ID NO: 246519 - DNA, 522 bp, Homo sapiens
  misc_feature: GYAE6OF01DMIGO.9.70.G04.1.454.CMB.1.raw
  modified_base (329)..(329): a, c, t, g, unknown or other
  misc_feature (329)..(329): n is a, c, g, or t
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccncatctacaacccgtcctcaagngtcgagtcagcatgtcagtcgacacgtccagaaccagttcctccctgacagtgagttatatcgaccgccgcagacacggccgtgtattactgtgcgagagaggtccgttatttagaccagctagttaaaactcctactacgtctcggacgtcgtgggcagggacgtaacgg

SEQ ID NO: 246520 - DNA, 555 bp, Homo sapiens
  misc_feature: GYAE6OF01DM4NH.9.70.G04.1.454.CMB.1.raw
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtccgccggcaagggactgggagtatagttggacgaatctatgccagtgggaccncatctacaacccgtcctnaagngtcgagtcagcatgtcagtcgacacgtcccagaaccagttctccctgacagtgagttatatcgaccgccgacacgacacggccgtgtattactgtgcgagagaggtccgttaagtttacggacctagtacttaacgttaaaactcctaacgttacggttctacgggtaccgttcgtaggggaccgaggggaccgtaacggg

SEQ ID NO: 246521 - DNA, 520 bp, Homo sapiens
  misc_feature: GYAE6OF01BH3F8.9.70.G04.1.454.CMB.1.raw
  modified_base (326)..(326): a, c, t, g, unknown or other
  misc_feature (326)..(326): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgcggcaagggctggagtatattggacaatctatgccagtgggaccncatctacaacccgtcctcaagagtcgagtcagcatgtcagtcgacacgtccagaaccagttctcctgacagtgagttatatgaccgccgcagacacggccgtgtattacgtgtgcgagagaggtccgttatttaggaccagctagttaaaactcctactacgtctcggtacgtcgtgggccagggacctaacgg

SEQ ID NO: 246522 - DNA, 530 bp, Homo sapiens
  misc_feature: GYAE6OF01BUL1Y.9.70.G04.1.454.CMB.1.raw
  modified_base (354)..(354): a, c, t, g, unknown or other
  misc_feature (354)..(354): n is a, c, g, or t
  modified_base (400)..(400): a, c, t, g, unknown or other
  misc_feature (400)..(400): n is a, c, g, or t
  modified_base (435)..(435): a, c, t, g, unknown or other
  misc_feature (435)..(435): n is a, c, g, or t
  modified_base (488)..(488): a, c, t, g, unknown or other
  misc_feature (488)..(488): n is a, c, g, or t
tcagtgatacgtctcacgaccggtgctcgatttagtgtagtgtgaagggaaaggcctgtcgaaggcttcgactagtcctagggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcttcctactggacctggatccggcagtccgcggcaagggactggagtatattggacgaatctatgccagtgggaccgccatctacaacccgtcctacaagngtcgagtcagcatgtcagtcgacacgtcccagaaccagttctcctnacagtgagttatatgaccgccgcagacacggcgtntattactgtgacgacgaggagcgttagtttacggaccaagcgtagttaaaacnctactacgtcgtacggtacgtcgtgggaccagggactaacgg

SEQ ID NO: 246523 - DNA, 542 bp, Homo sapiens
  misc_feature: GYAE6OF01BSTDK.9.70.G04.1.454.CMB.1.raw
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggatatattggacgaatctatgccagtgggaccncatctacaacccgtcctacaagngtcgatcagcatgtcagtcacacgtcccagaaccagttctccctgacagtgagttatatcgaccgccgcacgacacggtcgtagtacttactgtcgacgagacgaggtccgttagtttacggacctagtacttaacgttaaaactcctacgtacgtctacggtacgtcgtagggccgaggggacctaacggg

SEQ ID NO: 246524 - DNA, 571 bp, Homo sapiens
  misc_feature: GYAE6OF01AEOI4.9.70.G04.1.454.CMB.1.raw
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggacaaggggctggagtatattggacgaatctatgccagtggaccgcatctacaacccgtcctanagagtcgatcagcatgtcngtcgacacgtcccagaaccagttccnccctgaccagtgtagtatatcgaccgccnacgacaccggccgtgtaacttacgnggtgcgagacgtacggtaccgtttagtttaacggaccctagtcgttacggtttaaaacctccgttacgtaaccggttcgtacgggtaaccgttcgtaggggccgtaaagggggccctaaacggg

SEQ ID NO: 246525 - DNA, 548 bp, Homo sapiens
  misc_feature: GYAE6OF01DXFHS.9.70.G04.1.454.CMB.1.raw
  modified_base (365)..(365): a, c, t, g, unknown or other
  misc_feature (365)..(365): n is a, c, g, or t
tcagtgatacgtctcacgaccggtgctcgatttagtgtagtgtgaagggaaagggcctggtgaaggcttccacctaggttccctggacctcctgtgtcaagaacatgaaacatctgtggttcatcctcctcctggtggcagtcgtcccagatgggtccttgtcccaggtgcggtactgcaggagtcgggcccaggactagtgaagccttcacagggccctgtccctcacctgcgactgtctctggtcgactccatcagaggtggtcgttcctactggacctggatccggcagtccgcggcaaggggcctggagtatagtggacgaatctatgcagtgggaccgcatctacacccgtcctacaagngtcgatcagcatgtcagtcgacacgtccagaccagactctccctgaactagtagattatatcgacccgcgcagacgacggccgtagtattacgtgtgacgagaggacggtcgtttagtttacggacctagctagttaaactccgtaacgtacgtcgtcggacgtgtcggggccgagggtaccg

SEQ ID NO: 246526 - DNA, 519 bp, Homo sapiens
  misc_feature: GYAE6OF01A6BHN.9.70.G04.1.454.CMB.1.raw
  modified_base (326)..(326): a, c, t, g, unknown or other
  misc_feature (326)..(326): n is a, c, g, or t
  modified_base (348)..(348): a, c, t, g, unknown or other
  misc_feature (348)..(348): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgtggctgcaggagtcgggcccaggactagtgaagccttcataggccctgtccctcacctgcactgtctctggtgactccatcagaggtgtcgttcctactggacctggatccggcagtccgcggcaagggctggagtatattggacgaatctatgccagtgggaccncatctacaacccgtcctcaagngtcgagtcagcatgtcagtcacacgtcccagaaccagttctccctgacagtgagttatagtgaccgccgcagacacggcgtgtacttacgtgtgcgagacgagcgttatttaggacctagctagttaaaactctactacgtctggacgtcgtgggccgaggggcctaacgg

SEQ ID NO: 246527 - DNA, 537 bp, Homo sapiens
  misc_feature: GYAE6OF01D3KH2.9.70.G04.1.454.CMB.1.raw
  modified_base (526)..(526): a, c, t, g, unknown or other
  misc_feature (526)..(526): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgtggctgcaggagtcgggcccaggactagtgaagccttcacaggccctgtccctcacctgcactgtctctggtgactccatcagaggtggtcgttcctactggacctggatccggcagtccgccggcaaggggactgggagtatattggacgaatctatgccagtgggaccgccatcctaacaaccccgtcctacaaagcgtcgagtcagcatgtcagtcgacacgtccacgaaccacgttctccctgacagtgagttatatcgaccgccgcagacacggccgtgtattacgtgtcgcgagacgaggtccgttagtttaggacagcgtacgttaaactctacgtacgtctcggtcgtcgtgggccgngggcgtaacgg

SEQ ID NO: 246528 - DNA, 563 bp, Homo sapiens
  misc_feature: GYAE6OF01DD4H0.9.70.G04.1.454.CMB.1.raw
  modified_base (334)..(334): a, c, t, g, unknown or other
  misc_feature (334)..(334): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctccaagatgggtcctgtcccaggtgcggctgcaggagtcgggcccaggactagtgaagccttcacaggccctgtccctcacctgcactgtctctggtgactccatcagaggtggtcgttcctacgtggacctggactccggcagtccgccggcaaggggactggagtatagttggacgaatctatgccagtgggaccnccatcctacaacccgtcctacaagcgtcgagtcagcatgtcagtcgacacgtccagacctagttctccctgacagtgagttatagtcgaccgccgacacgacgacggtcgtagttattacgtgtcgacgagagtacggtaccgtttagtttacggacctagtacgttaagttaaacctcgttacgtacggtcgtcggtacgtcggaggggaccgacgggacctaacggg

SEQ ID NO: 246529 - DNA, 560 bp, Homo sapiens
  misc_feature: GYAE6OF01A64Y0.9.70.G04.1.454.CMB.1.raw
  modified_base (332)..(332): a, c, t, g, unknown or other
  misc_feature (332)..(332): n is a, c, g, or t
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggcctgtggaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcaccaggccctgtccctcacctgcactgtctctggtcacctccatcagaggtggtcgttcctactggacctggatccggcagtccgccggacaagggctggagtatagttggacgaatctatgcagtcggaccncatctaaccaacccgtcctacaagngtcgagtcagcagtgtcagtcgacaccgtccagaacctagttctcctagacagtgacgttatagtcgacccgcgacacgacgaccggtcgtagtaacttacgtgtcgtacgagtagacggtcgttagtttacgacctagtacgttaacgttaaactccgttacgtacggtcgtaggtacgtcgtagggccaggggcctaacgg

SEQ ID NO: 246530 - DNA, 588 bp, Homo sapiens
  misc_feature: GYAE6OF01CFAIQ.9.70.G04.1.454.CMB.1.raw
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (285)..(285): a, c, t, g, unknown or other
  misc_feature (285)..(285): n is a, c, g, or t
  modified_base (332)..(332): a, c, t, g, unknown or other
  misc_feature (332)..(332): n is a, c, g, or t
  modified_base (360)..(360): a, c, t, g, unknown or other
  misc_feature (360)..(360): n is a, c, g, or t
  modified_base (409)..(409): a, c, t, g, unknown or other
  misc_feature (409)..(409): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctatggacctggatccggnacgtccgccggnaagggctggatatattggaacgaatctatcgcctaggtcgggacccncatcctaaccaaccccgtcctagaacgngtccgagtcagcatgtcagtcgacaccgtccagaacctacgttctcccngacagtagtagtatatcgaccgccgcgacgacgacgcgtgtacttacgtgtgacgagacgtacggtaccgttagtttacggacctagtacgttaacgttaaaaccttccgttaaccgtacggttacgttacggtacggttacggtacggggtacccggaacggggtaaccgtaaccggg

SEQ ID NO: 246531 - DNA, 545 bp, Homo sapiens
  misc_feature: GYAE6OF01DYMHY.9.70.G04.1.454.CMB.1.raw
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
tcagtgatacgtctcacgaccggtgctcgatttagtgtagtgtgaagggaaagggcctgtgaaggcttcactagtcctggacttcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggctggagtatagttggacgaatctatcgccagtgggaccgcatctaccaacccgtcctnaagngtcgagtcagcatgtcagtcgacaccgtccagaaccngttcctccctagacagtgtagttatatcgaccgcgacagacacggcgtgtacttacgtgtgcgagagacggtccgttagttacggacctagtcgttaacgttaaaactcctacgtacgtcgtacggtacgtcgtacggggccaggggacctaacgg

SEQ ID NO: 246532 - DNA, 557 bp, Homo sapiens
  misc_feature: GYAE6OF01BNOXL.9.70.G04.1.454.CMB.1.raw
  modified_base (411)..(411): a, c, t, g, unknown or other
  misc_feature (411)..(411): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggctggagtatattggacgaatctatgccaggtcgggaccgccatcctaaccaaccccgtccctacaagacgtcgagtcagcatgtcagtcgacaccgtcccagacctagttcctccctgacngtcgtagttatagtcgacccgccgacacgacacggccgtgtacttactgtgcgagaggtacggtccgtttagtttacggacctagtcgttaacgttaaactccgtactacggcctaggacgtcgtagggccgaggggactaacggg

SEQ ID NO: 246533 - DNA, 556 bp, Homo sapiens
  misc_feature: GYAE6OF01BYSEV.9.70.G04.1.454.CMB.1.raw
  modified_base (295)..(295): a, c, t, g, unknown or other
  misc_feature (295)..(295): n is a, c, g, or t
  modified_base (348)..(348): a, c, t, g, unknown or other
  misc_feature (348)..(348): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcagaggtggtcgttcctacgtggacctggatccggcagtccgcgcaaggctggngtatagttggacgaatctatgcctaggtggaccgcatcgtaacacccgtcctnaagcgtcgagtcagcatgtcagtcacactccagaacagtctcctgacagtgatatatgaccgcctcacgtacacgccgtgtacttacgtcgtgacgtagaggtacggtacgttagtttaacggacctagtacgtaggttaaaacctccgttaacgtacggttactacggtaccgttcgtacgggaccgtacgggtaccgtaaaccggg

SEQ ID NO: 246534 - DNA, 528 bp, Homo sapiens
  misc_feature: GYAE6OF01EWITF.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaaggggactggagtatattggacgaatctatgccagtgggaccgccatctacaacccgtccctcaagagtcgagtcagcatgtcagtcgacacgtcccagaaccagttctccctgacagtgagttatatgaccgccgcagaccacggccgtgtattactgtgcgagagaggccgttatttacggaccagtctagttaaaactcctactacgtctggtacgtctgggccaggggacctaacgg

SEQ ID NO: 246535 - DNA, 678 bp, Homo sapiens
  misc_feature: GYAE6OF01C2JMX.9.70.G04.1.454.CMB.1.raw
  modified_base (339)..(339): a, c, t, g, unknown or other
  misc_feature (339)..(339): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctacgtggacctggatccggcaggtccgccggcaaggggactggagtatagttggaacgaatctatcgaccgaggtcgggacccnccaatacctaaccaaacccccgttccctaacaaacggacgtacgacgtcaagcagtcgtacaggtaccgaaccgacccgtacccgaacgtaacctacgttccctacccgtagaacgtaagtagtaagttaatacgtacgacccgaccgacgaacggacgaccgggtcgttacgttaacttacgtggtcgacggaggaacggtacggtaccgtttaagttttacggaaccgtaacgtaacgtttaaacgttaaaaaccttaccgttaaaccgttaccgggttacgttacgggtaccggtacggttacggggacccggtaacgggggaaccgtaaaccggg

SEQ ID NO: 246536 - DNA, 577 bp, Homo sapiens
  misc_feature: GYAE6OF01DTSNV.9.70.G04.1.454.CMB.1.raw
  modified_base (466)..(466): a, c, t, g, unknown or other
  misc_feature (466)..(466): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgactccatcagaggtggtcgttcctactggacctggatccggcagtccgccggcaagggctggagtatagttggacgaatctatgccagtcgggaccgccatctaccaacccgtccctacaagagtcgagtcagcatgtcagtcgacacgtacccacgaaccagttcctccctgactagtagagtttatatcgacccgccgcacgacacggcgtgttattactgtgcgagagnggtaccgttatttacggaccagtaccgttaacgttaaaactcccttacgttaccggtcgttacgggtacggttccggtaggggtcccgaacgggggtacccgtaaaccggg

SEQ ID NO: 246537 - DNA, 536 bp, Homo sapiens
  misc_feature: GYAE6OF01EVW7K.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcagaggtgtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgacagtgagttatatcgaccgccgcacgacacggcgtgtattactgtgcgagagaggtccgttagtttacggacctagtacgtacgttaaaactcctacgtacggtctacggtacgtcgtgggccgagggaccgtaacgg

SEQ ID NO: 246538 - DNA, 653 bp, Homo sapiens
  misc_feature: GYAE6OF01EB438.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttccactggacctggactccggcacgtccgcggcaaggggctggagtattagttggaacgaattcgtatcgccaggtcgggacccgccatcctaaccaaccccgtccctagaaagtacgtcgaagtccagcagtgtccagtccacctaccgtcccaacgaaccctacgttcctcccctagaaccgtagtcgtaacgttattacgtcgacccgccgaccgaacgtaccgaccgggtccgttgttaacttacgtggtacgacggaaggtacggtacggtaccgtttaagttttacggacctaggttaccgttaacgtttaaaacctcccgttaaccgttaccggttacgttacgggtaccggttacggtacggggacccgtacgggggtaacccgtaaccggg

SEQ ID NO: 246539 - DNA, 522 bp, Homo sapiens
  misc_feature: GYAE6OF01DTZZI.9.70.G04.1.454.CMB.1.raw
  modified_base (323)..(323): a, c, t, g, unknown or other
  misc_feature (323)..(323): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttccactggacctggatccggcagtccgcggcaagggctggatatattggacgaatctatgccagtggaccncatcacacccgtcctnaagngtcgagtcagcatgcagtcacncgtccacgaccagttctccctgacagtgagttatatcgaccgccgcagacacggccgtagtacttactgtgcgagagaggtcgttatttaggacctagtcttagttaaaactctacgtacggtctacggtacgtcgtggggccagggaccgtaacgg

SEQ ID NO: 246540 - DNA, 605 bp, Homo sapiens
  misc_feature: GYAE6OF01B0DF5.9.70.G04.1.454.CMB.1.raw
  modified_base (287)..(287): a, c, t, g, unknown or other
  misc_feature (287)..(287): n is a, c, g, or t
  modified_base (349)..(349): a, c, t, g, unknown or other
  misc_feature (349)..(349): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgccatgtctctggtcgactccatcgagaggtgtcttcctacgtggacctggatccggcagtccgccggnaagggctggagtatagtggacaatctatcgccaggtcggaccgcatctaaccacccgtccanaaagcgtacgagtcaagctaatcggtacaggtcgaactcgtcccacgaacctacgtctccctgactagtacgtagttactagtcgaccgccgacacgtacacggtcgtacgtattacgtgtacggacgtaggacggtacggtaccgtttagtttacggacctaagtaccgttaacgttaaaacctccgttaaccgtaccggttacgtacggtaaccgttcggtacggggtacccgtaacggggtaactaacccggg

SEQ ID NO: 246541 - DNA, 781 bp, Homo sapiens
  misc_feature: GYAE6OF01D1IEQ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtgttcactcctcctctggtggcagctcccagagtcgggtcctgtcccaggtgcggctgcgaggagtccgggcccaggactagtgaacgccttcacgacggccctcgtccctcacctgcactgtctctggtcgacctccatcgaggtaggttcggttccgtttcctacgtcggtaccgtggtactcccggctacggtcccgccggacgaaggggactagggtattagttagttacgggaacgtaattcgtaatcgccgtaagggtccgggacccgacctacttacccgtaaaccccgtaacccccggttccctaaccgaaacggtacgtaccggtacgtacacggactagtcgtaccgaggtacccgaacgtaacccgtcccaacgtaaccctacgttccctacccgtagtaaccgtacgtagttaacgttatacggtaccgacccgcccgaaccgaacggacccggaccgggtccgtttagtaacgtttaacgtcgggtacgtacgggaaggtacgggtaccggttaaccggttttaagtttaaccggaaccgtaacgttaaccgttaaaaccggttttaaaaacctccccgtttaaacggttcccggttacggtcggggttaccgttacggggaccggggtacccggtaacggggtaaacccgtaaccggg

SEQ ID NO: 246542 - DNA, 544 bp, Homo sapiens
  misc_feature: GYAE6OF01E1UJ5.9.70.G04.1.454.CMB.1.raw
  modified_base (327)..(327): a, c, t, g, unknown or other
  misc_feature (327)..(327): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgtcctactggacctggactccggcagtccgccggcaagggctggagtatattggacgaatctatgccagtgggaccnccatctaccaacccgtcctacaagacgtcgagtcagcatcgtcagtcgacacgtccacgaaccagttcctccctagacagtgagttatatacgaccgccgcacgacgacggtccgtgtacttacgtgtagcgagacgaggtccgttagtttagaccagtacgtagtaaaactctacgtacgtcgtggtacgtcgtacgggccaggggactaaccggg

SEQ ID NO: 246543 - DNA, 774 bp, Homo sapiens
  misc_feature: GYAE6OF01BID5A.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacgtcgactactcgtctcgtgtctacctcatacgaggtggtcgttccgttacctacgtacgtacgtagaccgtccggacgtaccggtccggccggaacggaacggtcggtaggtaagttagttacggtacggaacgtacttacgtagtacgacgtagggtaccggacccgactactacccgtaaacccgtaccccgtaccgtaacgaacggtacgtacgtacgtacgacgtactagttcgtacgtacgtaccgaaccgtacccgacccgaaagtaaccctttcgttacccctacgaagaacgttggttaacgttaatttacgtcggaccccggacccggtcaacggaaccgtaacccggttaaccgggttagtttaacgttaactttccggtgggtacggaaacgggtaggtaacccgggttcggtttttaaacgttttaagggtacccgaacgttacgttaaaccggtttaaaaacttaacccgtccgtttaacgggtcgttacggtacgggtcccgggttcggggaaccggggaccggtaaaccgggtctaacccgg

SEQ ID NO: 246544 - DNA, 593 bp, Homo sapiens
  misc_feature: GYAE6OF01CD0WW.9.70.G04.1.454.CMB.1.raw
  modified_base (336)..(336): a, c, t, g, unknown or other
  misc_feature (336)..(336): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcagaggtggtcgttcctactggacctggactccggcacggtccgccggcgaagggctggagtatagttggacgtaatctatcgccaggtcgggaccnccatctaccgacccgtcctacaagagtcgagtcagcatcgtacacgtccgacaccgtcccaagaacctacgttcctaccctagacaggttagtagtttatagtcgacccgtccgacacgaccgaccgggccgttgtacttacgtgtgacgaggaggtacggtccgtttaagttacggacctagtacttaaacgttaaacctccgttacgtacggttactcgggtacgtcggtaggggacccgaggggaccgtacggg

SEQ ID NO: 246545 - DNA, 601 bp, Homo sapiens
  misc_feature: GYAE6OF01DFZFY.9.70.G04.1.454.CMB.1.raw
  modified_base (235)..(235): a, c, t, g, unknown or other
  misc_feature (235)..(235): n is a, c, g, or t
  modified_base (355)..(355): a, c, t, g, unknown or other
  misc_feature (355)..(355): n is a, c, g, or t
  modified_base (407)..(407): a, c, t, g, unknown or other
  misc_feature (407)..(407): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctcccagatgggtcctgtcccaggtgcggctgcaggagtcgggcccaggactagtgaagccttcacacggtccctgtccctcacctgctactgtctctggtnactccatcgaggtaggttcggtccgttcctacgtcggacctgggactcccgggcacggtccgccggagaaaggggtctggagtatagttaggacgtaatctagcgccgaggtcgggaccncactctaaccaaccccgttccacgaagcgtcgatcagcatcgtcacgtcacnccgtaccaacgtacctacgtcctccctagacgtagtagtagttactacgtacgaccgcgacacgacgaccggcgttgtacttacgtgtacgacgagacgtacggtcgtttagttacgacctagtacgttaacgttaaactcctaacgtacggtcgtacgggtacgtcggacgggtccgagggtacgtaaccggg

SEQ ID NO: 246546 - DNA, 720 bp, Homo sapiens
  misc_feature: GYAE6OF01C8SZD.9.70.G04.1.454.CMB.1.raw
  modified_base (233)..(233): a, c, t, g, unknown or other
  misc_feature (233)..(233): n is a, c, g, or t
  modified_base (492)..(492): a, c, t, g, unknown or other
  misc_feature (492)..(492): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcatcctcctggtggcagctcccagatgggtcctgtcccaggtgcggctgcaggagtcgggcccaggactagtgaagccttcacaggccctgtccctcacctgcactgtctctggtnactccatcagtaggtggtcgttcctacgtggacctggactcccggctacggtcccggccggacgaaacggggtaccgtgggaacgttagttaagttacgggaaccgtaattccgttaagtcggacccgtaggtaccggggaccccacctaacgttcctaaacccaacccccggttccctaacgaacgtacgtccgaagtccaagtccagtcgtactaggtaccgaaccaccgtacccaaggtaaccctacggtttaccnccccgttagaacgtagtacgtagtttaactacgtaccggacccgaccgacgaacgaccgtaccggaccgttagttaacgtttacggtggttacgacggtaaggacgtacgggttacccgttttaagttacccggaacctacgtaaccgttaaagtttaaaaccctcccgttaacgttaccgggttacttcgggtaacgttcggtacggggccgtaacggggtaacccg

SEQ ID NO: 246547 - DNA, 551 bp, Homo sapiens
  misc_feature: GYAE6OF01B18QM.9.70.G04.1.454.CMB.1.raw
  modified_base (275)..(275): a, c, t, g, unknown or other
  misc_feature (275)..(275): n is a, c, g, or t
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggnagtccgccggcaagggctggagtatattggacgaatctatgaccagtcgggaccgcatcctaccaacccgtccctanaagagtcgagtcagcatgtcagtcgacacgtcccaagaaccagttcctccctgacagtgtaagttatagtcgaccgccgcacgacacggcgtgtacttacgtgtgcgagacggtacggtcgttagtttacggaccagtactacgttaaaacctcctactacggtctacggtacgtcggtgggccgagggaccgtaacgg

SEQ ID NO: 246548 - DNA, 577 bp, Homo sapiens
  misc_feature: GYAE6OF01B6VLX.9.70.G04.1.454.CMB.1.raw
  modified_base (273)..(273): a, c, t, g, unknown or other
  misc_feature (273)..(273): n is a, c, g, or t
  modified_base (352)..(352): a, c, t, g, unknown or other
  misc_feature (352)..(352): n is a, c, g, or t
  modified_base (417)..(417): a, c, t, g, unknown or other
  misc_feature (417)..(417): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcttcctactggacctggatccggnacgtccgcggcaagggctggagtatagttggacgaatctatgccaggtggacccgcatcctaaccaaccccgtccctanaagacgtcgagtcagcatgcagtcacaccgtcccagaaccagttcctcctgactagtgtagttanatcgaccgtccgcgacgacgaccggtccgtagtaacttacgtgttcgacgtagacggtacggtaccgtttaagtttacggacctagtacgttaacgttaaaactccgtaacgtaccgttacgtacggtacgtcggtacgggaccgaggggaccgtaacgg

SEQ ID NO: 246549 - DNA, 540 bp, Homo sapiens
  misc_feature: GYAE6OF01BH8TS.9.70.G04.1.454.CMB.1.raw
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (384)..(384): a, c, t, g, unknown or other
  misc_feature (384)..(384): n is a, c, g, or t
  modified_base (508)..(508): a, c, t, g, unknown or other
  misc_feature (508)..(508): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggctggagtatattggacgaatctatgccaggtggaccncatctaccaacccgtccnaagngtcgagtcagcatgtcagtcgacacgtccagaccngttcctccctgacagtgtagttatactcgaccgccgacgacgacgacggcgtgtacttactgtgcgagaggacggtccgttagtttacggacctagacttagttaaacctccgttactacggtntcggtacgtcgtgggccgaggggacctaacgg

SEQ ID NO: 246550 - DNA, 588 bp, Homo sapiens
  misc_feature: GYAE6OF01BSJ1O.9.70.G04.1.454.CMB.1.raw
  modified_base (472)..(472): a, c, t, g, unknown or other
  misc_feature (472)..(472): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcagaggtggtcgttcctacgtggacctggactccggcagtccgccggacaagggctgggagtatagttggacgaatctatgccaggtcgggaccgccatacctaaccgaaccccgtccctacgaaagtacgtcgagtcaagcatgtcaagtcgacaccgtccaagaacctcgttcctcctgacagtagattatatcgaccgccgacacgacgacggtcgtgtaacttacgngtgacggtagacggaggtaccgtttagttacggactagtactaacgttaaaacctccttaacgtaccggttctacgggtacgtcggtacgggaccggtacggggacctaaaccggg

SEQ ID NO: 246551 - DNA, 544 bp, Homo sapiens
  misc_feature: GYAE6OF01D3EGG.9.70.G04.1.454.CMB.1.raw
  modified_base (530)..(530): a, c, t, g, unknown or other
  misc_feature (530)..(530): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatcctaacaacccgtcctacaagagtcgagtcagcatgtcagtcgacacgtcccagaccagttctccctgacagtgagttatatcgaccgccgcacgacacggccgtgtattactgtgcgagagcggtcgtttatttacggacctagacgtaacgttaaaactcctaacgtacggtctacggtacgtcgtggggaccgnggggaccgtaacgg

SEQ ID NO: 246552 - DNA, 595 bp, Homo sapiens
  misc_feature: GYAE6OF01CQEHT.9.70.G04.1.454.CMB.1.raw
  modified_base (335)..(335): a, c, t, g, unknown or other
  misc_feature (335)..(335): n is a, c, g, or t
  modified_base (356)..(356): a, c, t, g, unknown or other
  misc_feature (356)..(356): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctacgtggacctggactccggcagtcccgccggcaaggggctgggatatagttggacaatctatcgccaggtcgggaccncatcctaccaacccgtcctanaagacgtcgagtcagcatgtcagtcgacaccgtccagaaccctacgttcctccctgactaggtgtagttatagtcgacccgccgacacgaccgacggcgtgtacttacgtgtcgacgagaggtacggtaccgtttagtttacggaacctagtacgttaacgttaaaaccttccgttaacgttacggttcgtacgggtaccgttcggtacggggacccgtacgggggaacccgtaacggg

SEQ ID NO: 246553 - DNA, 570 bp, Homo sapiens
  misc_feature: GYAE6OF01BKM5R.9.70.G04.1.454.CMB.1.raw
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
  modified_base (458)..(458): a, c, t, g, unknown or other
  misc_feature (458)..(458): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagagggtggtcttcctatggacctggatcccggcagtccgccggacaagggactggatatagttggacaatctatgccaggtcgggaccncatctaaccaacccgtcctanaagcgtcgatcagcatgacaatcgacacgtccagaacctgttcctcctgacagtgtagttatatcgacccgccgcaacgtacgaccggtccgtagtaactttacgngtcgacggagagacggtccgtttagtttacggacctagtacttaacgttaaactccgtacgtacggtcgttacgggtaccgtacggtacgggaccggacgggacgtaacggg

SEQ ID NO: 246554 - DNA, 554 bp, Homo sapiens
  misc_feature: GYAE6OF01A2EES.9.70.G04.1.454.CMB.1.raw
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatagttggacgaatctatgccagtgggacccncatctaccaacccgtcctacaagngtcgagtcagcatgtcagtcgacacgtccagaacctagttcctccctgacagtgtagttatagtcgaccgcgcacgacgacggcgtgtattacgtgtgcgagagacggtccgtttagtttacggaccgtagtacgttacgttaaaacctcctacgttacgtcgtacggtacgtcgtagggccgtaggggaccgtaacggg

SEQ ID NO: 246555 - DNA, 569 bp, Homo sapiens
  misc_feature: GYAE6OF01AZLX5.9.70.G04.1.454.CMB.1.raw
  modified_base (274)..(274): a, c, t, g, unknown or other
  misc_feature (274)..(274): n is a, c, g, or t
  modified_base (332)..(332): a, c, t, g, unknown or other
  misc_feature (332)..(332): n is a, c, g, or t
  modified_base (354)..(354): a, c, t, g, unknown or other
  misc_feature (354)..(354): n is a, c, g, or t
  modified_base (393)..(393): a, c, t, g, unknown or other
  misc_feature (393)..(393): n is a, c, g, or t
  modified_base (534)..(534): a, c, t, g, unknown or other
  misc_feature (534)..(534): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcttcctactggacctggatccggnacgtccgccggcaagggctgggagtatagttggacgaatctatgccaggtcgggaccnccatccaccaacccgtccctanaagagtcgatcagcatgcagtcgacacgtccacgaaccngttcctcccgtagacaggttagtagttatactcgaccgccgacaacgaccaccgggtccgtagtaacttacgtggtacgacgagagacgtacgtttagtttacggacctagtacttaacgttaaactccttacgtacggtntcgggtactacggtgggaccgagggaacctacggg

SEQ ID NO: 246556 - DNA, 534 bp, Homo sapiens
  misc_feature: GYAE6OF01BUIZ2.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggctggagtatattggacgaatctatgccagtgggaccgcatctacaacccgtccctcaagagtcgagtcagcatgtcagtcgacacgtcccagaacccagttctccctgacagtgagttatatgacccgccgcacgacaccggcgtgtattactgtgcgagagacggtccgttagtttaggaccagtctagttaaaactcctacgtacgtctacggacgtcgtaggggccaggggaccgtaacgg

SEQ ID NO: 246557 - DNA, 598 bp, Homo sapiens
  misc_feature: GYAE6OF01CWJL2.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctccatcagaggtggtccttcctactggacctggactccggcagtcccgccggcaagggactggatatattggacgaatctatgccaggtcgggaccgccatcctaccaacccgtcccctacaaagcgtcgagtccagcatgtcagtcgacacgtacccacgaacctagttcctccctagactagtagagttatatcgaccgccgcacgacaccggcgttagtacttacgtgtgacgagaggacggtaccgtttagttttacggacctagtaccgttaacgttaaaaccttaccgtaacgttaccgggttacgtacgggtaccgttccggtacggggacccgagggggaacccgtaaaccggg

SEQ ID NO: 246558 - DNA, 547 bp, Homo sapiens
  misc_feature: GYAE6OF01CLQKI.9.70.G04.1.454.CMB.1.raw
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (467)..(467): a, c, t, g, unknown or other
  misc_feature (467)..(467): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttccactggacctggatccggcagtccgccggcaaggggctggagtatagttggacgaatctatgccaggtcgggaccncatctaccaacccgtcctnaagntcgagtcagcatgtcagtcgacaccgtcccacgaaccacgttcctcccgtgactagtagtagttatacgtcgaccgccgacacgacaccggcgtagtattactgtgcgagagnggtacgttagttacgacctagtacgtacgttaaactcctacgtacgtctcggtacgtcgtgggaccgagggccgtaacgg

SEQ ID NO: 246559 - DNA, 561 bp, Homo sapiens
  misc_feature: GYAE6OF01EJPG8.9.70.G04.1.454.CMB.1.raw
  modified_base (233)..(233): a, c, t, g, unknown or other
  misc_feature (233)..(233): n is a, c, g, or t
  modified_base (327)..(327): a, c, t, g, unknown or other
  misc_feature (327)..(327): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttctactggacctggatccggcagtccgcggcaagggctggagtatattggacgaatctatgccaggtcgggaccnccatcctacaacccgtcctanaagngtcgagtcagcatgtcagtcgaacaccgtacccacgaacccagttcctccctgacagtgaagttatatcgacccgccgcgacgacaccggtccgtgtacttactgtgcgagaggacggtcgttagtttacggacctagtcgttaacgtttaaaacctccttactaccggtcgtacggtacgtcggtagggaccgaggggaccgtaacgg

SEQ ID NO: 246560 - DNA, 630 bp, Homo sapiens
  misc_feature: GYAE6OF01DPZZJ.9.70.G04.1.454.CMB.1.raw
  modified_base (234)..(234): a, c, t, g, unknown or other
  misc_feature (234)..(234): n is a, c, g, or t
  modified_base (354)..(354): a, c, t, g, unknown or other
  misc_feature (354)..(354): n is a, c, g, or t
  modified_base (399)..(399): a, c, t, g, unknown or other
  misc_feature (399)..(399): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtnactccatcagaggttggtcttcctacgtcggacctggactccggcacgtcccggcggacgaaggggtactgggtaactattagttggaacgaattcctaatcgaccgaggtcgggacccncatcctaaccaacccgtccagaacgagtcgagtcagcatcgtacngtacgactacgtccacgaacctgttcctacctgactagtagtacgttatacgtacgtacccgcgtacacgacgaccggtcgtagttactacgtgtacgacgagtaggtacggttccgtttagtttacggaacctagtacgtttaacgttaaaacccttcgttaaccgttaccggttacgtacggtaccggttacggtaccggggtaccggtacgggggtaacctaaccggg

SEQ ID NO: 246561 - DNA, 551 bp, Homo sapiens
  misc_feature: GYAE6OF01B98X9.9.70.G04.1.454.CMB.1.raw
  modified_base (330)..(330): a, c, t, g, unknown or other
  misc_feature (330)..(330): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgactccatcagaggtggtcgttcctactggacctggatccggcagtccgccggcaagggctggagtatattggacgaatctatgccagtcgggaccnccatcaaccaacccgtccctcgaagcgtcgagtcagcatgtcagtcgacacgtcccagaacccagttcctccctgacagtagtagttatatcgacccgcccgcacgacgaccggtccgtagtattacgtgtgcgagagagtccgttagtttacgactagacttaacgttaaactcctacgtacgttctggtacgtcgtggggccgaggggaccctaacggg

SEQ ID NO: 246562 - DNA, 569 bp, Homo sapiens
  misc_feature: GYAE6OF01ATNZK.9.70.G04.1.454.CMB.1.raw
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctgggatatattggacgaatctatgccaggtcgggaccncatctaaccacccgtcctnaagngtcagtcagcatgtcagtcgacacgtccacgaaccagttcctccctgtacagtgtagttatatcgaccgccgcacgacacggccgtgtacttacgtgtgcgagacgtacggtaccgtttagtttacggacctagtacgttacgttaaaaactcccgttaacgttaccggtacgttacggtaccgttcggtaggggccgtaggggaaccgtaacggg

SEQ ID NO: 246563 - DNA, 733 bp, Homo sapiens
  misc_feature: GYAE6OF01DZTSV.9.70.G04.1.454.CMB.1.raw
  modified_base (342)..(342): a, c, t, g, unknown or other
  misc_feature (342)..(342): n is a, c, g, or t
  modified_base (363)..(363): a, c, t, g, unknown or other
  misc_feature (363)..(363): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggccaggactagtgaagccttcacacggtccctgtccctcacctgcactgtctcgtggtcactcatcaggtcggtgtcgttcctagtcggacctggactccggcacgtccgcggacgaagggctggagtattagtaggaacgtaatctagtcgccgaggtcgggaccncatctaaccaacccgtcctanaaaggtacgtcgacgtacagactatcggtacacgttaccgaacgtacccgtacccaacgtaaccctacgttaccctacccgtagtaacgtaggttacgtaagttaacgttacgtacgaacccgccgaaccgtacggtaaccgacgggtaccgttacgttaacgttacggtggtacggtacgtaagggtaacggtaacgggtttacgttttaaacggttttaccggaaaccgttaacggttaaccgtttaaaaccgggtttaaaaacccttacccggttaaaacggtttacccgggttacgttaacgggtaccgggttaccgggtaccgggggtaacccgggtaaaccggggaaacccgttaaacccgggg

SEQ ID NO: 246564 - DNA, 778 bp, Homo sapiens
  misc_feature: GYAE6OF01D3E4A.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactaggtgaacgtccttcacgacggcccttgtcccctcacctgccactgtcctcgtggtcacctccatcgaggtaggttcggttccgttcctaacgtcggaccgtggacgtcccgggactacgggtccccggaccgggacggaaacgggggtaccttaggggtaagttaacgttaggtttacggaaacgtaaactttccgtaagtcggacccgtaagggttccggggaaccctccctaacgttaccgtaaacccgtaaaccccccggttccctaaagaaacgggacgtttacgaacgtccgaagcctaagtcgttacaacgttaccggaactaccgtacccgaacgtaaccctacgttcctaccctagaccgtagtacgtagttactataccgaccgtacgacgaacgaccgacggtacgtacgttacgttacgtggtacgacggaaggtacgtacgggttaccgtttaaggtttaacggaccgtaacgtaacgtttaaacggttaaaacccttccggtaaacggttaccggttacggtaccgggttacggttacgggtacggggaaccgggtaaccgggaaaccgtaaccggg

SEQ ID NO: 246565 - DNA, 580 bp, Homo sapiens
  misc_feature: GYAE6OF01CS40S.9.70.G04.1.454.CMB.1.raw
  modified_base (332)..(332): a, c, t, g, unknown or other
  misc_feature (332)..(332): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgactccatcagaggtgtcgttcctactggacctggatccggcacgtccgccggcaagggactgggatatattggacgaatctatgccaggtcgggaccncatcctaaccacccgtcctacgaagacgtcgagtcagcatgtacagtcgactaccgtcccaacgaacctacgttcctccctagacagtgtagttatagtcgacccgccgacacgacaccggtcgtgtacttactgtgcgagaggcggtacgtttagttacgacctagtacttaacgttaaaacctccgttaacgttaccggtacgtacgggtaccgttcggtggggacccgagggggaccctaacggg

SEQ ID NO: 246566 - DNA, 859 bp, Homo sapiens
  misc_feature: GYAE6OF01CI6A9.9.70.G04.1.454.CMB.1.raw
tcagtgatacgtctcacgaccggtgctcgatttagtgtagtgtgaagggaaagggcctgtagaaggcttcactagtcctggaccctcctgtgacaaagaacatagaaacatctggtggttcactccctcctccgtggtgcagcctacccagagtcgggtcctcgtcccgaggtcgcggctgcgaggacggtccgggacccaggtactagtacgaacgtcccttacacgacggcccttcgtcccctcacctgcctacgttgtccttacgtggtacacctcatacgagggtacgggttcggttccgttacccgtacgtcggtaccgttaggtacgtcccggacgtaccggtccccgggacggaccggaaaggggtcttagggtaagttacgttagttacgggaacgtaaacttcgttaagcggaccgtagggttacgggacccgtacctaacttaccgtaaaccccgtaaccccgttcctaacgaaaggtacggtacgtaacgtacaacggtactacgttcggacgtaaccgtaccgaacccgtaacccgtacccctaaaccggaaccgttaaccgtttccctaccccgtagtaaccgtaaggttaacgttaacgtttaactaacgttaccggacccgacccgtacgaacgtaccggaccgggtacgttagttaacgttacgtcgggacggtacggaacggtacgggttaccgggttacccgttttaacggtttacggaaaccgtaacgttaaccgtttaaaaaccggttaaaaccttcccggttaacgttaccgggttacggtacgggttaccggtaccggggtcgggaaccgggtaaaccggggtaacgtaaacccggg

SEQ ID NO: 246567 - DNA, 600 bp, Homo sapiens
  misc_feature: GYAE6OF01DJQTB.9.70.G04.1.454.CMB.1.raw
  modified_base (331)..(331): a, c, t, g, unknown or other
  misc_feature (331)..(331): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgactccatcgagaggtgtccgttccactggacctggatccggcagtcccgcggacaagggctggagttatgttggacgaatctatgccagtgggaccncatctaaccaacccgttccacgaagcgtcgagtcagcagtgtcagtcgacaccgtaccaacgaacctacgtttcctaccctacgactagtgtaagttatacgtacgaccgccgacacgaccgacggtccgtagttacttacgtggtcgtacgagaggacggttcgttaacgtttacggaccgtagtacgttaaacgttaaaaccgtccttaaccgtacggttcgtacgggtacgttcggtacggggccgtaacgggaccgtaaaccggg

SEQ ID NO: 246568 - DNA, 619 bp, Homo sapiens
  misc_feature: GYAE6OF01CR8N1.9.70.G04.1.454.CMB.1.raw
  modified_base (336)..(336): a, c, t, g, unknown or other
  misc_feature (336)..(336): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgacagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcacgtccgccggcaaggggctgggagtatagttggaacgaatctatcgccaggtcgggaccnccatctaccaacccgtcctacaagagtcgagtcagcatgtacacgtcgaccacgtaccccaagaaccctagttcctacccctagacctaagtagtagtttaatactacggacccgtccgacgacgaccgaccgggtccgtagtaacttacgtggtgacggagaggacggtccgtttaagtttacggacctagtaccgttaaacgttaaaaccttccgttaacgttaccggttcgtcgggtaccgttcggtacgggggacccgtaagggggacccgtaaccggg

SEQ ID NO: 246569 - DNA, 623 bp, Homo sapiens
  misc_feature: GYAE6OF01ECW34.9.70.G04.1.454.CMB.1.raw
  modified_base (346)..(346): a, c, t, g, unknown or other
  misc_feature (346)..(346): n is a, c, g, or t
  modified_base (367)..(367): a, c, t, g, unknown or other
  misc_feature (367)..(367): n is a, c, g, or t
  modified_base (588)..(588): a, c, t, g, unknown or other
  misc_feature (588)..(588): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctcgtggtcactccatcagaggtggtccttcacgtcggacctggactccggcacggtccgccggacaaggggctgggaagttatagttcggaacgtaatctagtcgccaggtcgggaccncatcctaaccaacccgtccanaagcgtcgatcagcatcgtcacgtccgaactaccgtacccaacgaacctcgttcctacccgtgaaccgtaggtacgtaagtttatacgtaccggacccgtccgacgaacgaccgaccgggtccgttagttacttacgtgtcggacgaggtacggtacggttacgtttaagttacggaccctaagtaccgttaacgtttaaaacctcttaacgtacgttcgnggtaccgtcggtacgggctaacggggactaaccgg

SEQ ID NO: 246570 - DNA, 764 bp, Homo sapiens
  misc_feature: GYAE6OF01DRW0W.9.70.G04.1.454.CMB.1.raw
  modified_base (254)..(254): a, c, t, g, unknown or other
  misc_feature (254)..(254): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcaggagtccgggcccaggactagtgaacgccttcacacggccctcgtcccctcacctgcactgtctcgtggtcactccatcgaaggnggtcgtcgttcctacgtggacctggactccggcacggtccccggaccggacgaaagggggacctagggtaacgttaagttagtttacgggaaacctaaacgttccttaacgtcggaccccgtaaggggttacccggggaacccctaccctaacgttacccttaaaccccgtaacccccggttcccctaagaaaacgggtcgtacggtaacgtacgacggcttaaaggtcgtacgagtcccgaacgaccgtacccaacgtaaccgtacgttccctaccgtagaccgtaggtagtaagttactaacgtcggacccgccgacgaacggaacccgtaccgggtccgttagttaacttcggtacggtcgtaacgggagtaacggtacggttaccggtttaagtttaacggaacctagttaaccgttaaacggtttaaaaccctccgttaaccgtaacggttccgtacgggtacggtacccgggtagggacccggaacgggaacccgtaaaccggg

SEQ ID NO: 246571 - DNA, 833 bp, Homo sapiens
  misc_feature: GYAE6OF01C63SZ.9.70.G04.1.454.CMB.1.raw
  modified_base (233)..(233): a, c, t, g, unknown or other
  misc_feature (233)..(233): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactcatcagaggtgtcgttcctactggacctggactccggcacgtccgcggcaagggactggatatagttgggacgaatctagtgaccgtaggtcgggaccgcacgttcctaaaccgaaccccggttccctacgaaaggtacggttaccggaagttccgaagacctagttcggtaccgtaaggttcccggaaacccgtacccggttacccccgaaacggtaaacccccgtttaacggtttccccgttacccccgttacggtaacccgtaaggtttacgggtaaacggtttttaaacgtaacggtttacccgggaacccccggtaccccggtaaccgtaaccgggaacccgtaacccgggggttaccccggtttaacggtttaaccgttttaaccggttggggttacggaaccgggtaaagggttaacgggtacggggttacccggttttaacgttttaccggaaacgggtaaccctaacgggtacccgtttaaaacgtttaaaaacccgttccccgttaaacggttaacccgggttacgttaccggggtaaaccggttccgggttaccgggggtacccgggtaacggggggtaaaccccg

SEQ ID NO: 246572 - DNA, 910 bp, Homo sapiens
  misc_feature: GYAE6OF01DUUPN.9.70.G04.1.454.CMB.1.raw
tcagtgatacgtctcacgaccggtgctcgatttagtgtagtgtgaagggaaaggcctgtaggaacggaaccttcacctacgtccgtggaacctccctgtgcaagaacatcgaaacactctggtgggttccagtcctcctcctcggttggtcgaggctcccgagagtgggtacctggtcccacggtcgcccggcgttgaccgtagggagtccgggcccgaggacgtaaggtgaaggccttcacgacggccctagtccctcgacctgactactgtctctcggtgactccatctagtagggtgtcgttccttaccgtcggtaaccgtggtatccggtcgtaggtcccggaccgggacgaaaccgggggtacgtagggggtacgttagttaggtttacggggaacgtaaaggtccttaaggtcggtacccgtaaggggttaccggggtaacccggaaccctaaaagttacccgtaaacccggtaaacccccggtttcccggtaaacgaaaacgggttaacggttcccggaaacggggttacccaaaggggtaccctaaacgtttaccgggttacccgtaaaacgggttcccggaaaacccccggtacccgggttaacccccgaaaccggtaaaaccccggttaccggtttaccccgtaaccccgttaacgtaaacccggtaacggttacggtaaacggttttaagttaaccggtaacggggaaccccggcccggtaccgtaaccggaaccgttacccgggtaccgttacgttaaccgttaccgtacggtacgtaaccggtaagtacggacggttaccgttaagtttaacggaccgtaagtacgttaacgttaaacctccgttacgtacggtcgtacggtaccgttacggtaggggccgtagggaccgtaacggg

SEQ ID NO: 246573 - DNA, 671 bp, Homo sapiens
  misc_feature: GYAE6OF01CWGKP.9.70.G04.1.454.CMB.1.raw
  modified_base (217)..(217): a, c, t, g, unknown or other
  misc_feature (217)..(217): n is a, c, g, or t
  modified_base (326)..(326): a, c, t, g, unknown or other
  misc_feature (326)..(326): n is a, c, g, or t
  modified_base (386)..(386): a, c, t, g, unknown or other
  misc_feature (386)..(386): n is a, c, g, or t
  modified_base (478)..(478): a, c, t, g, unknown or other
  misc_feature (478)..(478): n is a, c, g, or t
tcagtgatacgtctcacgaccggtgctcgatttagtgtagtgtgaagggaaagggcctgtgaaggcttcactagtcctggacctcctgtgcaaggaacatgaaacatctgtggttcatcctcctcctggtggcagctcccagatgggtcctgtcccaggtgcggctgcaggagtcgggcccaggactagtgaacgccttcaaccgcgtcctcgtccncacgtcgactcgttctctgtaggctacctcactacgaggtggttcgttcgttcctaggcgtcgtagcgtccgcgtacgccggcgagacgtcgtgatatgtacgatactntgcgcgtggaccggccacctactacccaaccgtacccgtaccaacgtaaggccggtacgngtaccgatcgagttcgacggcgtacccgaacgttacccgaccgtaacgtaaccgttcttcccgtaccgtagtacgtacggtagttacgttancgtaccggaccgacacgtacgactaccgggtcttaggttacctggtcggcgacggacggtacggttccgttttaagtttaccgggttacgaccgttagtaaaccggttttaaaaacctaacccgttcgttaaccgggttacgttcggtacggtaccgttcggggacgggaccggtaacgggtaaccgtacccg

SEQ ID NO: 246574 - DNA, 643 bp, Homo sapiens
  misc_feature: GYAE6OF01DXN5U.9.70.G04.1.454.CMB.1.raw
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtccgccggcgaagggctggagtatagttggacgaatctatgccaggtcgggacccgccatctaccaacccgtccctanaagngtcgagtcagcatgtcagtcgacacgtccacgaccagttctcctgactagtgtacttatacgtacgacccgtcccgacacgtaccgaccgggtccggttagttacttaccgttggttacggacgaacggtaaggtacgggttcccggttttaatttttaacgggaaccctaaggtaccgtttaaacgtttaaaaacctcccgttaaacgttacccggttacgttacgggtaccgggttaccggttacgggggacccggtaacgggggtaacccgtaaaccggg

SEQ ID NO: 246575 - DNA, 556 bp, Homo sapiens
  misc_feature: GYAE6OF01A8KM4.9.70.G04.1.454.CMB.1.raw
  modified_base (326)..(326): a, c, t, g, unknown or other
  misc_feature (326)..(326): n is a, c, g, or t
  modified_base (449)..(449): a, c, t, g, unknown or other
  misc_feature (449)..(449): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcactggacctggatccggcagtccgccggcaagggctggagtatattggacgaatctatgccagtgggaccnccatctaccaacccgtccctcaagagtcgagtcagcatgtcagtcgacacgtcccagaaccacgttcctccctgacagtagtagttatatcgaccgccgacacgacacgggcgtagtattacngtacgcgagaggtacggtaccgttagtttacggacctagacgttagttaaaacctccgttacgtacggtctacgggtactcggtagggcccgtagggaccgtacggg

SEQ ID NO: 246576 - DNA, 576 bp, Homo sapiens
  misc_feature: GYAE6OF01EWIM5.9.70.G04.1.454.CMB.1.raw
  modified_base (332)..(332): a, c, t, g, unknown or other
  misc_feature (332)..(332): n is a, c, g, or t
  modified_base (353)..(353): a, c, t, g, unknown or other
  misc_feature (353)..(353): n is a, c, g, or t
  modified_base (390)..(390): a, c, t, g, unknown or other
  misc_feature (390)..(390): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcacgtccgccggcaagggctggagtatagtggacgtaatctatgccaggtcggaccncatcctaccaacccgtcctanaagcgtcgagtcagcatgcagtcacacgtccagaccngtctcctgacagtgtagttatacgtcgaccgccgacacgaccgacggtcgtgtacttacgtgtcgcgagaggtacggtaccgtttaagtttacggaccgtagtacgttaacgttaaaaccttccgtaacgttacggttcgtacggtaccggtcggtacggggacccgtaggggaaccgtaaccggg

SEQ ID NO: 246577 - DNA, 791 bp, Homo sapiens
  misc_feature: GYAE6OF01BR4OG.9.70.G04.1.454.CMB.1.raw
  modified_base (233)..(233): a, c, t, g, unknown or other
  misc_feature (233)..(233): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcaggaggtggtcgttcctacgtggacctggactccggcacgtccgccggcaagggctggatatagttggacgaatctatcgccgaggtcgggacccgcctagtacctaaccgaaccccggttcctacgaaaacggtcggttaccgaacggttccaacggtccctaaagttcggtacctaacggtacccgaaaccgtaccccggttaccccaaacggtaaaccccgttaacggttttcccctaccccgttagtaaccgttaaggtacggttaaacggtttaacttaaccgttccggaaccccggtacccggtaacaaacgggtaacccgtaaccggggttcccgtttaggttaacttttaccggtgggttacggtacggaaggtaacggggtaccggttacccggttttaaggttttaaaccgggaacccgtaacggttaccgtttaaacggtttaaaaacccttccgttaaacggttaccggttacgtacggggttaaccgttaccgggttacgggggaacccggtaacgggggtaacccgttaaaccggg

SEQ ID NO: 246578 - DNA, 682 bp, Homo sapiens
  misc_feature: GYAE6OF01D1VA4.9.70.G04.1.454.CMB.1.raw
  modified_base (381)..(381): a, c, t, g, unknown or other
  misc_feature (381)..(381): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtccgggcccaggactagtgaacgtccttcacgacggcccttcgtcccctcacctgcctactgtctcgtggtcacctccatcgaggtaggttcggttccttcctacgtcggacctggacttcccggcacggtcccggccggacgaaaggggtctgggaagttattaggttcgggaacgtaattcgtagtcgaccgtagggtcgggacccncctatcctaacccgaaccccgtcctaagaaggcgtcgacgtcagtcctagttcggtaccacggtaccgaacctacccggtacccgaacgtaaccctcgtttccctacccgtagaacgtaggttacgtaagtttactacgtacggacccgccgacaacggaccgaccggtccgttagttaacttacgtggtacgacgaagtacggtacggttacgtttagttacggacctagtacttaaacgttaaacctcgttacgtacggtcgtacggtaccgtcgggacgggccgtagggaccgtacgg

SEQ ID NO: 246579 - DNA, 552 bp, Homo sapiens
  misc_feature: GYAE6OF01CG8PF.9.70.G04.1.454.CMB.1.raw
  modified_base (327)..(327): a, c, t, g, unknown or other
  misc_feature (327)..(327): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaaggggctggagtatattggacatctatgccagtgggaccncatctaccaacccgtcctcaagacgtcgagtcagcatcgtcagtcgacaccgtcccagaacctagttcctccctgacagtgtagttatatcgacccgccgcacgacacggccgtgtacttacgtgtgcgagagaggtccgtttagtttacggacctagtctaacgttaaaactccttaactacggttcgtacggtacgtcgtggggaccgaggggacctaacggg

SEQ ID NO: 246580 - DNA, 565 bp, Homo sapiens
  misc_feature: GYAE6OF01EV6LV.9.70.G04.1.454.CMB.1.raw
  modified_base (334)..(334): a, c, t, g, unknown or other
  misc_feature (334)..(334): n is a, c, g, or t
  modified_base (424)..(424): a, c, t, g, unknown or other
  misc_feature (424)..(424): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtccgttcctactggacctggatccggcacgtccgccggcaaggggctggagtatagttggacgaatctatgccaggtcgggaccncatcctacaaccccgtccacaagagtcgagtcagcagtgtcagtcgaccaccgtacccagtaacccagttcctccctgacagtgagttanatcgacccgccgcagaccacgggctgtattacgtgtcgcgagaggtacggtccgtttaagtttacggacctagtacttaacgttaaaactccgttacgtacggtcgtacggtacgtcgaggggccgagggaccgtaacggg

SEQ ID NO: 246581 - DNA, 594 bp, Homo sapiens
  misc_feature: GYAE6OF01ADYDN.9.70.G04.1.454.CMB.1.raw
  modified_base (233)..(233): a, c, t, g, unknown or other
  misc_feature (233)..(233): n is a, c, g, or t
  modified_base (328)..(328): a, c, t, g, unknown or other
  misc_feature (328)..(328): n is a, c, g, or t
  modified_base (413)..(413): a, c, t, g, unknown or other
  misc_feature (413)..(413): n is a, c, g, or t
tcagtgatacgtctcacgaccggtgctcgatttagtgtagtgtgaagggaaaggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtnactccatcagacggtggtcgttccactggacctggatccggcagtccgcggcaagggctggatatatcggacgaatctatgccaggtcgggaccnccatctaaccaaccccgtccctacaaggtacgtcgacgtcacgcaagtgtacagtccgaccacgtcccaagtaaccacgtttccnccctagaccgtagtgtagttatactcggacccgccgacacgtacgaaccgggtcgtgttaacttacgtgtcgaccgagagtacggtccgtttagttacggacctagtacttaagttaaaacctcgttaccgttacggtcgtacggtaccgtcggacggggtaccaaggggaccctaacggg

SEQ ID NO: 246582 - DNA, 597 bp, Homo sapiens
  misc_feature: GYAE6OF01AEFSQ.9.70.G04.1.454.CMB.1.raw
  modified_base (274)..(274): a, c, t, g, unknown or other
  misc_feature (274)..(274): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttctactggacctggatccggnacgtccgccggcaagggcctgggagtactagttggaacaatctatcggaccaggtcgggaccgtccatcctacaaccccgtcctacaagcgtcgagtcagcagtgtcagtcgactacgtcccagaaccagtctccctgactagttagttactatcgaaccgccacacgacgacggccgtacgtacttaacgtgtcggtcgaagacgtacggtacgttaacgtttacggacctagtacgttaacgttaaaacctaccttaacgtacggttacgtaggtaccgttacggtacgggtaccgaacggggtaccgtaacgggtacccg

SEQ ID NO: 246583 - DNA, 608 bp, Homo sapiens
  misc_feature: GYAE6OF01AX42W.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcagaggtggtcgttcctacgtggacctggactccggcacgtccgccggcgaagggactggagtatagttggacgaatctatcgccaggtcgggaccgcatcctaccgaacccgtccctacgaagacgtcgagtcagcatcgtcagtcgacaccgtaccacgaacctacgttcctccctgacgtagtgtagttatacgtcggaccgccgacgaacgacaccggtcgtagtaacttacgtgtcgacgagacggtacggtaccgtttagtttacggacctagtaccgttaacgttaaaaccttccgttaacgttaccggtcgttacgggtacgttacggtacggggtacccgacgggggtaacctaaccggg

SEQ ID NO: 246584 - DNA, 698 bp, Homo sapiens
  misc_feature: GYAE6OF01CAE6N.9.70.G04.1.454.CMB.1.raw
  modified_base (343)..(343): a, c, t, g, unknown or other
  misc_feature (343)..(343): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcgagaggtgtcgttcctacgtggacctggactccggctacggtccgccggcgaaaggggctagggacgttatagttaggacgaatctatgccaggtcgggaccnccagtcctaaccaaccccgtcctacgaagacgttacgagtcagcattcgtacaggtccgacaccgtccaacgaacctcgttccacccgttagaacgtgtacggaagtttacagttaccggacccgtacccgacgaacggtacccgtaaccgggtcggtttacgttaacgttaccttcgggtacggtacccggaaggtaacggtaccggggttacccgtttttaaaggtttaaccgggaacccttagggttaaccctttaaacgggtttaaaaccttccccgtaacgtttacgggccgttacgggtaaccgttcgggaccgggggtaaccccgaagggggtaacccgttaaccggg

SEQ ID NO: 246585 - DNA, 657 bp, Homo sapiens
  misc_feature: GYAE6OF01CM2AB.9.70.G04.1.454.CMB.1.raw
  modified_base (608)..(608): a, c, t, g, unknown or other
  misc_feature (608)..(608): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggtttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactcggacctggactccggcacggtcccgccggcgaaggggactgggagttatagttgggaacgtaatctatcgccgaggtcgggacccacctaatacctaaccgaaccccgtccctacgaaacggtacgtcgacgtcacgcagtcgtacagtccgacaccgtcccaagaaccctagttccctcccgtagactaggtagtagttatacgcgtaccccgcgacgaacggaccgaccgggtcgttagttacttacgttgtacggacgtaacggacggtacggtccgttttaagtttacggaccgtaggtaccgtttaaacgttaaaaccttcccgttacgttaacccggttntacgggtaccgttcgggacggggaccggacggggtaacccgtaaccggg

SEQ ID NO: 246586 - DNA, 553 bp, Homo sapiens
  misc_feature: GYAE6OF01C2GHA.9.70.G04.1.454.CMB.1.raw
  modified_base (232)..(232): a, c, t, g, unknown or other
  misc_feature (232)..(232): n is a, c, g, or t
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (395)..(395): a, c, t, g, unknown or other
  misc_feature (395)..(395): n is a, c, g, or t
  modified_base (419)..(419): a, c, t, g, unknown or other
  misc_feature (419)..(419): n is a, c, g, or t
tcagtgatacgtctcacgaccggtgctcgatttagtgtagtgtgaagggaaaggcctgtgaaggcttcactagtcctggacctcctgtgcaagaacatgaaacatctgtggttcatcctcctctggtggcagctcccagatgggtcctgtcccaggtgcggctgcaggagtcgggcccaggactagtgaagccttcacaggccctggtccctcacctgcactgtctctggtnactccatcagaggtgtcttctactggacctggatccggcagtccgcggcaagggactggatagtagtggaacgaatcgtancgaccaggcgggaccncatcctacaacccgtccanaagngtcgagtcagcatgcagtcgacaccgtccaagaacctagttcncctgacagtgagttatatcgaccncgacagacgacgtcgtgtaattacgtgtgacgagagaggtaccgtttagtttaggacctagtacttaacgttaaaaccttccgtaactacggttcgtaggtaccgtcgtagggaccgaacggggacctaaacgg

SEQ ID NO: 246587 - DNA, 549 bp, Homo sapiens
  misc_feature: GYAE6OF01DV4DF.9.70.G04.1.454.CMB.1.raw
  modified_base (233)..(233): a, c, t, g, unknown or other
  misc_feature (233)..(233): n is a, c, g, or t
  modified_base (325)..(325): a, c, t, g, unknown or other
  misc_feature (325)..(325): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaagactagtgaagccttcacaggccctgtccctcacctgcactgtctctggtnactccatcagaggtgtcgttcctatggacctggatccggcagtccgcggcaagggctggagtatattggacgaatctatgccagtggacccnccatcctacaacccgtcctacaagagtcgaagtcagcatgtcagtcgacacgtccagaccagttctcctgacagtgagttatatcgaccgccgcagaccacggcgtagtattactgtcgcgagagacggtcgttagtttacggacctagtacgttaacgttaaaacttcctaacgtacggttacgtacggtacgttacgtaggggaccgaggggaccgtaacgg

SEQ ID NO: 246588 - DNA, 677 bp, Homo sapiens
  misc_feature: GYAE6OF01C81N5.9.70.G04.1.454.CMB.1.raw
  modified_base (370)..(370): a, c, t, g, unknown or other
  misc_feature (370)..(370): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagagtgggtcctgtcccaggtgcggctgcaggagtccggccaggactagtgaagccttacacgacggccctgtccctcacctgaccactgtctctggtcgactccatcgaggtaggttcggtccgttacctacgtcggacctggacgtccggcgacggtccgccggacgaaggggtacgtggataagttcgtaggaacgtaatcgtaagtcgaccgagggtcgggaacccncaactccgtaaccgaaccccgttacctaacgaagtacgttacgaacgtcagctatcgtacgacgttacgactaccgtacccaacgaaccgtacgttcctacccgtagacgtacgtagtagttactacgtcgacccgtacgacacgacgtaccgacgttagtacttacgtgtacgacgtacggtacgacggttaccgtttaagtttaccggaacctagaacccgtttaaagttaaaaccctcgttaaccgtaccggttacgtacgggtaccgtcggaaccggggtcggaacggggtaccgtaaccggg

SEQ ID NO: 246589 - DNA, 914 bp, Homo sapiens
  misc_feature: GYAE6OF01EDMDV.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctcgtggtcgacctccatcgaggtagggttcggttccgttccctaacgttcgggaacccgttgggaaccttccccgggactaaccggttcccccggacccgggtaacgaaacgggggtaccttaggggaacggttaacgttaaggtttacggggaaacggtaaaacgttccgttaaagttcggaccccgtaagggttaccgggggaacccctacccgtaacttaccccgtaaacccgtaaacccccggttccccgttaacgaaaacgggtacgttaccggaacgttaccgaaggtactaaacgtttcggtaccgtaaacggttacccggaaaccgtaacccgggttacccccgtaaacggtaaacccccgttacggttttcccccgttaacccccgttaacggtaaaccggtaaggttacggttaaacgttttaactaacggttccggaaccccgtacccggaacgaaccggtaacccgtaccgggtaccgtttagttaacctttaccggtgttcggtaacggaacgggtaacggtaaccgggttaccgttttaaaggtttaccggaaaccccgtaagttaacccgtttaaacggtttaaaaacccttcccgttaacggttaaccggtcgttaccgggtaaccgttaccgggtacgggggacccgtaaccggggtaccgtaaaccggg

SEQ ID NO: 246590 - DNA, 708 bp, Homo sapiens
  misc_feature: GYAE6OF01C2WPG.9.70.G04.1.454.CMB.1.raw
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctctggtgcagctcccagatggtcctcgtcccgaggtgcgctgcgaggcggtccgggccaggactaagtgaagtccttcaacgcggtccctcgtccctacacctgctctgttctcgtgggtacacctaccgatcgaaggtgggttcggttccgttacctaacgtcgggaaccctgggaaccgtcccgggactacggccggcccgggaagtaaagggggtactaggggaattaagttggtacggaacgtaaatcttaagngaccctaagggtccgggaccnctaacttccgtaacccaaccccggttccaagaaacgcgtccgtaaagtccacggtactaatcggtaccaaagtccgaaccctaccgtacccaacgaacctacgttcctaccgacgaacgtagtagtaagtatacgtcgaccgcgacacgacgaacggtccgtagtacttacgtaggtacgacggaagacggtacggttaaccgtttaacgttaacggaaccgaagttaacgtaaacgttaaaaccgtccttaacgttacggtcgtacggtacgtacggtacgggaccggtacgggaaccgtaacgg

SEQ ID NO: 246591 - DNA, 566 bp, Homo sapiens
  misc_feature: GYAE6OF01AF76N.9.70.G04.1.454.CMB.1.raw
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (350)..(350): a, c, t, g, unknown or other
  misc_feature (350)..(350): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgggcagctcccagatgggtcctgtcccaggtgcggctgcaggagtcgggcccaggactagtgaagccttcactggccctgtccctcacctgcactgtctctggtgactccatcagaggtggtcgttcctactggacctggatccggcagtccgccggcaagggctggagtatattggacgaatctatgccagtgggaccncatctacacccgtcctnaagngtcgagtcagcatgcagtccgacacgtccagaccagttcctccctgactagtgtagttatatcgaccgccgcacgacgaccggccgtgtacttacgtgtcgcgagaggtacggtccgtttagtttacggacctagtacgttacgttaaaacctccgttaacgttaccggttctacgggtaccgttcggtacggggccgtaggggacccgtaacggg

SEQ ID NO: 246592 - DNA, 581 bp, Homo sapiens
  misc_feature: GYAE6OF01A2EIF.9.70.G04.1.454.CMB.1.raw
  modified_base (236)..(236): a, c, t, g, unknown or other
  misc_feature (236)..(236): n is a, c, g, or t
  modified_base (354)..(354): a, c, t, g, unknown or other
  misc_feature (354)..(354): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgccactgtctcgtggtnacctccatcaggtaggtcggtcgttcctagtggacctggactccggcacggtccggccggacaaggggctagggaacgttatagttcggaacgaatctagtcgccaggtcgggacccnctatcctaaccaacccgtcctagaagtcgtcgagtcaagcagttcgtacagtcgaccacgtccagacctacgttctacccgtagacgagtgtagttatagtcgaccgccgcacgacacggtcgtgtacttacgtgtgacgagagacggtcgttagttacgacctagtacgttaacgttaaactctacgtacgtctacggtacgtcgtacgggcgagggccgtaacgg

SEQ ID NO: 246593 - DNA, 698 bp, Homo sapiens
  misc_feature: GYAE6OF01A5Q60.9.70.G04.1.454.CMB.1.raw
  modified_base (232)..(232): a, c, t, g, unknown or other
  misc_feature (232)..(232): n is a, c, g, or t
  modified_base (282)..(282): a, c, t, g, unknown or other
  misc_feature (282)..(282): n is a, c, g, or t
  modified_base (327)..(327): a, c, t, g, unknown or other
  misc_feature (327)..(327): n is a, c, g, or t
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccaggactagtgaagccttcacaggccctgtccctcacctgcactgtctctggtnactcatcagaggtggtcgttcactggacctggatccggcagtccgccggnaagggctggagtactattggacgaatctatcgccaggtgggaccncatccaccaacccgtcctacaagngtcgaagtcagcatgtcagtcgactacgtcccagaaccacgttcctcccttacgactagtgtaacgttatacgttacgacccgtaccgccgaacggaccgaacccgggtccggttacgttaacgtttaccgttgggtacggtaccggtaaggtacgggtaacgggttacccggttttaagtttttaaccggggaacctaacgggttacctttaaacgggttttaaaaaaccctccccggtttaaaccggttaacccgggtttacggttaaccggggtaacccgtttaccgggttacgggggggtaaccccgtaaacggggggggtaaaccccgttaaaacccggggg

SEQ ID NO: 246594 - DNA, 561 bp, Homo sapiens
  misc_feature: GYAE6OF01CJQPR.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggctggagtatattggacgaatctatgccaggtgggaccgcatctaccaacccgtcctcaagacgtcgagtcagcatgtcagtcgacacgtcccacgaacctacgttctccctgacagtgagttatatcgacccgccgcacgacaccggcgtagtattacgtgtgcgagaggacggtccgtttagtttacggacctagtacgttacgttaaaacctccgttaacgtaccgttcgtacggtacgttcgtagggcccgaggggtaccgtaacggg

SEQ ID NO: 246595 - DNA, 727 bp, Homo sapiens
  misc_feature: GYAE6OF01EUG9P.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtcgacctccatcaggagggttgttaccgttcctacgtcggaccctggacgtccggcaggtcccggccggacaagggggctggagtacttaggttacggaacgtaatctagtcgacccgtaggtaccgggaccgtcctaactacctaaacccgtaaccccgttacccctacgaaacggtacggtaccgtaagtccgagactagtcggtacgagtaccgaaccgtaccgtacccgaacgtaaccctacgttcctacccgtacgaacgtagttagagtttacgtacgttacgaccgtccgacgacggtacgaccgggtccgttagttaacgttacgtcggtacgacggtaggaacggtacgggttaccgtttaacgtttaacggtaccgtaacgttaccgttaacgtttaaaaacccgttccgttaaaccgttaccggttacggtacggttaccggttacggtaccgggggtaccggaacggggtaccgtaaaccggg

SEQ ID NO: 246596 - DNA, 715 bp, Homo sapiens
  misc_feature: GYAE6OF01D3RZ9.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctcccagatgggtcctgtcccaggtgcggctgcaggagtccgggcccaggactagtgaacgtccttcacgacggccctgtccctcacctgcactgtctcgtggtcactccatcgaggtaggtcggttccttacctacgtcgggacctgggactcccgggacacggtccccggaccgggacgaaacggggtacttgggaaagttatttaaggtttcgggaaacctaaattctaacgtcggacccgtagggtccgggaccccactacgttacctaacccgtaacccccgtccctaagaaacggtacgttaccgagtaccaaggtcaagttcgacctacggtcccgaaccgtacccgtacccgaacgtaaccctacgttccctacccgtacgtactaggtagtaacgttatacgtacgacccgaccgacgacgaccgaccggtccgttagttaacttcgtgtacggacgtaggtacggtacggttaccgtttaagtttacggacctagtacgtaacgtttaaacctccgttaacgtacggtcgtacgggtaccgtacggacgggaccggaacgggaccgtaacgg

SEQ ID NO: 246597 - DNA, 664 bp, Homo sapiens
  misc_feature: GYAE6OF01CCVH4.9.70.G04.1.454.CMB.1.raw
  modified_base (333)..(333): a, c, t, g, unknown or other
  misc_feature (333)..(333): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcagaggtgtcgttcctactggacctggactccggcagtccgccggcaaggggctgggagtatagttggaacgaatctatgccaggtcgggaccncatctaccaacccgtcctnaaaggngtcgagtcaagctatcgtcagtccgactaccgtcccagaacctacggttcctaccctcgaccgagtacgtagtttactacgtacgacccgccgacgacgaaccgaccgggtcgtacgttaactttacgtacggttcgaccggtaaggtacgggtaacgggttacccgttttaaagttttaacgggaaacccgttagtaccgtttaacggtttaaaaacccttacccgttaaccgttaccgggttaccttacgggtaccggttaccggtacgggggacccggtaacgggggtaacccgtaaaccggg

SEQ ID NO: 246598 - DNA, 615 bp, Homo sapiens
  misc_feature: GYAE6OF01D5X2W.9.70.G04.1.454.CMB.1.raw
  modified_base (233)..(233): a, c, t, g, unknown or other
  misc_feature (233)..(233): n is a, c, g, or t
  modified_base (360)..(360): a, c, t, g, unknown or other
  misc_feature (360)..(360): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctactggacctggatccggcacgtccgccggcgaagggctggagtatagttggacgtaatctatgccaggtgggacccgccatcctaaccaaccccgtcccctanaaacgagtcgagtcagcatgtcagtccgacaccgtccaacgaacccagttcctccctagacctagtgagttatacgtcgacccgccgacacgaccgacgggtccgtagtacttacgtggtgacgagaggtacggtaccgtttaagtttaacggtaccgagttaccgttaacgttaaaacccttcccgttaaccgttacgggttcgtacgggtacggttacggtacggggaccggaacggggtacccgtaaacggg

SEQ ID NO: 246599 - DNA, 762 bp, Homo sapiens
  misc_feature: GYAE6OF01C7XDU.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcacctccatcaggtggtgttccgttcctactcggacctggacgtcccggactacggtccggccggacgaaaggggccttaggggaacgttaagttacgttacgggaaccgtaattccttaagtccggaccgtaagggtccggggacccctaccgaacttacccgtaacccgtaaacccccgttccccgtacgaaacggtacgttaccggaaggtccaaggtactaacgtttcggaccgtaacggtaacccgtaacccgtacccgttaccccgaacggtaaaccctaaccggtttccctaccccgttaggaaaccgtaggttaacggttaacgttaacgttaacgtccggaacccggtacccgacgaacggaacccggtaccgggtaccgttacggttaactttacggtaggttacgacggaggtaacggtacggtaccgttttaacgtttacgaccgtagtaccgttaacgttaaactccttacgtacggtcgtacggtacgcggtacgggacgacggggtaacctacgg

SEQ ID NO: 246600 - DNA, 532 bp, Homo sapiens
  misc_feature: GYAE6OF01EARRV.9.70.G04.1.454.CMB.1.raw
  modified_base (234)..(234): a, c, t, g, unknown or other
  misc_feature (234)..(234): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (512)..(512): a, c, t, g, unknown or other
  misc_feature (512)..(512): n is a, c, g, or t
tcagtgatacgtctcacgaccggtgctcgatttagtgtagtgtgaagggaaagggcctgtgaaggcttcactagtcctggacctcctgtgcaagaacatgaaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctactggacctggatccggcagtccgccggcaagggctggagtatattggacgaatctatgccagtgggaccncatctacaacccgtcctanaagcgtcgagtcagcatgtcagtcacacgtcccagaaccagttctccctgacagtgagttatatcgaccgcgcagacacggcgtgtattactgtgacgagagaggtccgttagtttacggaccagtctaacgttaaaactccgtaactacgtctacggtcgtcgngggccgagggaccgtaacgg

SEQ ID NO: 246601 - DNA, 677 bp, Homo sapiens
  misc_feature: GYAE6OF01DKVDU.9.70.G04.1.454.CMB.1.raw
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatccctcctcctggtggcagctcccagatgggtcctgtcccaggtgtggctgcaggagtcgggcccaggactagtgaagccttcacaggccctgtccctcacctgcactgtctctggtgactccatcagaggtgtcgttcctactggacctggactccggcagtccgccggacaagggctgggagtatagttggacgaatctatcgccgtaggtcgggacccnccaatcctaaccaacccgtccctanaagtagtcgagtcagcatgcagtcgactaccgtacccaacgaaccctacgttcctaccctagtaccgagttagtaacgtttatacgtaccggacccgcccgaccgaacgaccgaccgggtccgttacgttaactttaccgttgggtcgacggacggtaacggtacggttaccggttttaacgttttaacgggaccgtaaggtaccgttaaacggtttaaaaacccttcccgttaaaccgttaccgggttaccgttacgggtaaccggttacggtacgggggtacccggtacggggtaacccggtaaaccgggg

SEQ ID NO: 246602 - DNA, 572 bp, Homo sapiens
  misc_feature: GYAE6OF01BHP7V.9.70.G04.1.454.CMB.1.raw
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcaggaggtggtcgttcctactggacctggatccggcagtccgccggnaagggctggatatattggacatctatgccaggtcgggaccncatcctacaacccgtcctanaagcgtcgagtcagcagtgtcagtcgacacgtcccagaacctgttcctccctagacagtgtagttatacgtcgacccgacgcacgaccgacggccgttgtacttacgtgtcggacgagagtacggtaccgttagtttacggacctagtacgttaacgttaaacctccgttaacgttaccggtcgtacggtacgtcggtacgggccgtacggggaccgtaacgg

SEQ ID NO: 246603 - DNA, 641 bp, Homo sapiens
  misc_feature: GYAE6OF01AKE0I.9.70.G04.1.454.CMB.1.raw
  modified_base (362)..(362): a, c, t, g, unknown or other
  misc_feature (362)..(362): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtgactccatcaggtaggttcggtccgttcctacgtggaccgtggactccggcacggtcccgccggcgaaacgggactgggagttagtagttcgggaacgtaattcctagtgacccgtaggtcgggacccncctaatcctaaccgaaccccgtcctacgaaagtcgtcgagtcagcagtcgtcagtccgactaccgtccaagacctacgttcctccctagaactagttagtaacgttatacgtcggacccgccgtacaacgaccgaccgggtaccgttgttaacgttcgtggtcgacggagaggtacggtcgtttaagttaccgggacctacggtacgttaaacgttaaactcccgtaactaccgggtatcgggtacctcggtagggacccgtaacggggacctaacggg

SEQ ID NO: 246604 - DNA, 690 bp, Homo sapiens
  misc_feature: GYAE6OF01CJB30.9.70.G04.1.454.CMB.1.raw
  modified_base (105)..(105): a, c, t, g, unknown or other
  misc_feature (105)..(105): n is a, c, g, or t
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggcctgtgaaggcttcactagtcctggacctcctgtgcaagaacatgaaacntctgtggttcatcctcctcctggtggcagctcccagatgggtccctgtcccaggtgcggctgcaggagtcgggccaggactagtgaagcttcacnggccctgtccctcacctgcactgtctcgtggnactccaatcgaggtaggtcggtcttcctagtcggacctggactccggcacgtccggcggacaagggctggatatgtggacaatctatgccaggtcgacncatctaccacccgtcanaagntcagtcagctatgcagtcgaacctaccgtacccaacgtaacctacgtttaccctacccgttacgaaccgttaaggttaggtaagtttaacgtaagttcggtaaccgtcgacccggaccaacggaacccgtacgggtacccgttaggttaacgtttaacgttcggttagacgggtaacggtagggtacggtaccggttttaacgtttaaacgggacccgtaacggttaccgttaaacgtttaaaaacccgttcccgttaaccggttaacccggttaccgtttacggggtacccggttacgggtttacccggggaccgggttaacgggggtaaaccccgg

SEQ ID NO: 246605 - DNA, 577 bp, Homo sapiens
  misc_feature: GYAE6OF01AFCXZ.9.70.G04.1.454.CMB.1.raw
  modified_base (332)..(332): a, c, t, g, unknown or other
  misc_feature (332)..(332): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcaggtccgccggcaagggctggagtatattggacgaatctatcgccaggtcgggaccnccatcctaaccaacccgtcctacaagagtcgaagtcagcatgcagtcgacaccgtccacgaacctagtcctccctagacagtgagttatatcgaccgccgcagacacggtcgtgttacttatgtgacgagagacggtccgtttaagtttacggacctagtaccttaacgttaaaaacctcctaacgttaccggtcgttacgggtaccggttcgtacggggacccgtaaggggacccgtaaacggg

SEQ ID NO: 246606 - DNA, 604 bp, Homo sapiens
  misc_feature: GYAE6OF01ATNCO.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcagaggtggtcgttcctacttggacctggatccggcagtccgccggcaaaggggcctgggagtatagttggaacgaatctaatgccaggtggaccgccagtccaccaacccgtccctacaaagcgtacgagtcaaggctaagtgtacagtccgaacctaccgtcccagaacctagttcctccctgacagtgtaagttatatcgaccgccgcagacaccgggcgttagtacttacgtgtacgacgtaggagtacggttaccgtttagtttacggaacctagtacgttaacgttaaaacctccgttacgtaccggttagtcggtaaccgttcggtacggggcccgaagggggtaccgtaaccggg

SEQ ID NO: 246607 - DNA, 642 bp, Homo sapiens
  misc_feature: GYAE6OF01AIULZ.9.70.G04.1.454.CMB.1.raw
  modified_base (235)..(235): a, c, t, g, unknown or other
  misc_feature (235)..(235): n is a, c, g, or t
  modified_base (350)..(350): a, c, t, g, unknown or other
  misc_feature (350)..(350): n is a, c, g, or t
  modified_base (378)..(378): a, c, t, g, unknown or other
  misc_feature (378)..(378): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctcgtggtnactccatcagaggttggtccgttcctacgtggacctggactccggcaggtcccggccggacgaagggactggtagtatagttggaacgtaatctatcgaccgaggtcgggacccncgtactacctaaccaaccccgtccctanaaacggagtccgaagtcagcagtcgtcagtccgacgaccgtcccaacgtaaccctagttccctccgtagacctaggtgtagttatacgtcgacccgcgacacgaccgccgggtcgttagtacttacgtggtcgacgaggtacgacggttaccgtttagtttacggacctagtaccgttaaacgttaaaacccttccgtaacgttacggttacgtacgggtaccggttcggaccggggaccgtaaccggggtaacgtaacccggg

SEQ ID NO: 246608 - DNA, 654 bp, Homo sapiens
  misc_feature: GYAE6OF01AXKTA.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcaggaggtggtccgttcctacgtcggacctggactccggcacgtccgccggcaagggctggagtatagttggacgtaatctatcgccgaggtcgggaccctcactcctaaccgaacccgtcctacgaagacgtcgactcgaagcctagtcgtacctaggtccgaaccgtaccgtacccgaacgtaacccgtacgtttcccgtaccccgtagaaccgtaggtacgttaacgtttattaacgtccggacccgccggacaacgaccgaccggtcggttacgttacttacgtggtcgacgacggacgtacggttacgtttagttaacggacctagtacgttaacgttaaacctccgttaacgtaccggttgtacggtacggtaccggtacggggaccgtacggggaaccgtaaccggg

SEQ ID NO: 246609 - DNA, 667 bp, Homo sapiens
  misc_feature: GYAE6OF01EXMFH.9.70.G04.1.454.CMB.1.raw
  modified_base (350)..(350): a, c, t, g, unknown or other
  misc_feature (350)..(350): n is a, c, g, or t
  modified_base (375)..(375): a, c, t, g, unknown or other
  misc_feature (375)..(375): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctcgtggtgactccatcagaggttgtcgttcctactcggacctggactccggcagtcccggccggcgaaaggggctgggagtattagttcgggaactaactctaatcgccgaggtcgggacccnccatcctaaccaaccccgttcctanaagctcgagtcagcagtgtacagtccgacaccgtacccaacgtaacctacgttcctacccgtacgaactaaggtacgtaacggttaacttacgtaccggacccgacccgacgaacgaccggaaccggtccgttacgttaacttaacggtgtacggacgtacggtaacggtacggtaccgttttaaggtttaccggaccgtaacgttacgttaaacgttaaaaccgttccttaacgttacggtacgtacggtaccggtacggtacgggaccggtaagggtaccgtaaaccggg

SEQ ID NO: 246610 - DNA, 563 bp, Homo sapiens
  misc_feature: GYAE6OF01DUFRH.9.70.G04.1.454.CMB.1.raw
  modified_base (214)..(214): a, c, t, g, unknown or other
  misc_feature (214)..(214): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctnacctgcactgtctctggtgactccatcagaggtgtcgttcctactggacctggactccggcagtccgcggcaagggctggagtatagttggacgaatctangcagtgggaccncatctacaacccgtcctacaagagtcgagtcagcatcgtcagtcgacacgtccacgaccagttctcctgacagtgagttatactcgaccgcgcagaccacggccgtagtattacgtgtgacgagagaggttccgttagtttacggactagtacgttaacgtttaaaactccttacgttaccggttcgtacgggtacgttacggttcggggacccggaggggtacccgtaaaccggg

SEQ ID NO: 246611 - DNA, 680 bp, Homo sapiens
  misc_feature: GYAE6OF01BM8HW.9.70.G04.1.454.CMB.1.raw
  modified_base (285)..(285): a, c, t, g, unknown or other
  misc_feature (285)..(285): n is a, c, g, or t
  modified_base (343)..(343): a, c, t, g, unknown or other
  misc_feature (343)..(343): n is a, c, g, or t
tcagtgatacgtctcacgaccggtgctcgatttagtgtagtgtgaagggaaagggcctggtgaaggcttccactagtcctggacctcctgtgcaagaacatgaaacatctgtggttcatcctcctcctggtggcagctcccagatgggtccttgtcccaggtgcggtctgcaggagtcgggcccaggactagtgaagccttcacagggccctgtccctcacctgcgactgtctctggtcactccatcagtaggtggtacttccacttcggacctggtactccggnagtccgcggtacgaagggactggagtatagtggacgaatctatgcctaggtcggaccncctatactaaccgaacccgtcctacgaaagacgtacgagttacagcctaagttgtacgaggtccgaacgtaccgtacccgaacgtaaccctacgttccgtaccccgtagaaccgtagtacgtaagttaactagtccgaccgtccgtacgtaacgaccgaccgggtccgttacgtacgttacgtaggttacgcgaaggacggtacggtaccgtttaagtttaacggacccgttaagtaccgttaaaggtttaaaaccctcccggttaacgttaaccgggttacgtaccggtacggttaccgggttaggggacccgtaacgggggacccgtaaaccggg

SEQ ID NO: 246612 - DNA, 661 bp, Homo sapiens
  misc_feature: GYAE6OF01CY1B7.9.70.G04.1.454.CMB.1.raw
  modified_base (377)..(377): a, c, t, g, unknown or other
  misc_feature (377)..(377): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcaggagtccgggcccaggactagtgaacgccttcacacggccctgtccctcacctgctactcgtctcgtggtacactccatcgaaggtaggttcggttccgttacctacgtcggacctggactccgggctagttccggccggagaaacggggacctgggagttaatgttaggaaccgtaattccgtagtacgccgtaaggtcgggacccncactacctaacccaaaccccgtcctacgaagtacggtcgaagtcagtactaactgtaaccgaagtccgaacctacccgtacccgaaacgtaacccttacgttacctcccgtagaccgtagtagtaagttaactacgtacgacccgcgacgaacgacgaccggtcgtagtattacgtgtcgacggtagacggtacgtcgtttaagttacggacctagacgttaaacgttaaacctcgtaacgtacgtcgacggtacgtacggaggacccgaagggacctaacggg

SEQ ID NO: 246613 - DNA, 574 bp, Homo sapiens
  misc_feature: GYAE6OF01BK5OU.9.70.G04.1.454.CMB.1.raw
  modified_base (332)..(332): a, c, t, g, unknown or other
  misc_feature (332)..(332): n is a, c, g, or t
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatagttggacgaatctatcgccaggtcgggaccncatcctaccaacccgtcctacaagngtcgagtcagcatgtcagtcacacgtccagaccagttcctcctagacagtgtagttatagtcgaccgccgacacgacgacggtcgtgttattacgtggtcgacgagaggtacggtccgtttagtttacggacctagtacgtaacgttaaaacctccgttacgttaccggtcgttacggtacggttacggtacggggaccgtaggggaccgtaacggg

SEQ ID NO: 246614 - DNA, 669 bp, Homo sapiens
  misc_feature: GYAE6OF01C5HZB.9.70.G04.1.454.CMB.1.raw
  modified_base (233)..(233): a, c, t, g, unknown or other
  misc_feature (233)..(233): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagtaggtggtcgttcctatcggacctggatccggcagtccgccggcgaagggctgggacttatagttggacgtaatctatcgccaggtcgggaccaccactctaaccaacccgtccctacgaaagcgtcgagtcagcagtcgtacagtcgaacctaccgtacccgaacgtaacccgtacgtttaccctcccctaggaacctagttagtagtttactactacgtacccggccgtaccgaacgaccgaccgggtccgtacgttaactttacgtagtcggcgtaggtacggtacggtacggttttaacgtttaacgggaccgtagtacgttaacgttaaaaaccttcccgttaaccgttaacccgggttacgttacgggtaacgttaccgggttcggggaaccggtaacgggggtaacccgttaaaccggg

SEQ ID NO: 246615 - DNA, 871 bp, Homo sapiens
  misc_feature: GYAE6OF01EI1P4.9.70.G04.1.454.CMB.1.raw
  modified_base (236)..(236): a, c, t, g, unknown or other
  misc_feature (236)..(236): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctcccagatgggtcctgtcccaggtgcggctgcaggagtcgggcccaggactagtgaagccttcacacggccctcgtccctcacctgcacttgtctcgtggtnactccatcaggtaggtcggttccgttcctacgtcggtaccgtggacgttcccggacgtaccggtcccggacccgggacgaaagggggtaccttaggggaagttaagttaacggtttcgggaaaccggttaaacttccgttaacgtccggtaccccggtaagggtttacccgggggaacccccggtaccttaaaccgttacccgttaaaaccccgaaacccccccggtttaccccgttaacgaaaacggggtacggttaccgggtaacgttaccgaacgtactaacgttcggtaaccgtacggtacccgaacccgtaacccgtaccccgaaacgtaacccgttacggtttaccccttaccccgttaggaaccgttaaggttacggtaacgtttaacgtacgttaccggaccccggtaccgacgaaacggtaaccgtacccgggtaccgttagtttaaccgttacggttcggtacggtaaccggaaggttaacgggtaccggttttaaccggtttaaaggtttaaccggaccgtaagttaaccgttaaacgttaaaacccttccgttaaccggttaccggttacgtacgggtaaccgttcgggaccggggtaccggtaaccgggaaccgttaaccgg

SEQ ID NO: 246616 - DNA, 774 bp, Homo sapiens
  misc_feature: GYAE6OF01B2UY3.9.70.G04.1.454.CMB.1.raw
  modified_base (215)..(215): a, c, t, g, unknown or other
  misc_feature (215)..(215): n is a, c, g, or t
  modified_base (392)..(392): a, c, t, g, unknown or other
  misc_feature (392)..(392): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtcgcggctgcaggagtccgggccaggactagtgaagccttcacaggccctgtccctnacctgcactgtctcgtggtcgacctccatcaggtaggtcggtcgttccctacgttcgggaccctgggaacttcccgggactacggttcccggccggacgaaaggggtacctgggaacgttacttagtttcgggaacgtaattccgtaagtcggaccctaagggtcggggtaaccccnccgtaagttcccgttaaaccaacccccggtttccctacggaaacggtacggttccggaaggttcccaacggtcctagttcggtaacctaccgggtccgtaacccgtaaccgttacccccgaaggtaaaccctcggtttcccctacccgttagaaccgtacggtgtaacgtttactacgtcggaacccgcgaacgtacgacggacccggtcgttacgttaacgttaccgtggttaccgacggtaacggtaacggtacgggttacccgttttaggtttaaaccgggacccgtaaggttaccgttaacggttaaaaccttccgtaacgttaccggttacgtacggtacgtcggtacgggtacccgaggggtaacccgtaaccggg

SEQ ID NO: 246617 - DNA, 706 bp, Homo sapiens
  misc_feature: GYAE6OF01CQ2KC.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgccttcacacggccctgtccctcacctgccactgtctctggtgacctccatcaggtgggttcggttcgttcctacgtggaccctggacgtcccggactacggtcccggccgggacaaagggggtcctagggaattaagtagttacgggaacgtaattccgtaagtcgacccgtagggtcgggaccccgcctaactcctaacccgaaccccgttcccctagaaacggtacgtccggaagtccaaggcctaacgttcgtaccgtaacggtccgaacctacccgtacccaacgtaaccctacgttccctacccgtagacctaaggtacgtaagtttactacgtaccgacccgtccgacaacggaccgtaccggtccgttagtaacgtttacgtcgtacggacgtaggtacggtacggttaccgtttaagttaacggacctagtacgttaacgtaaaccttcgtaacgttacggtacgtacggtacgtcggtacgggccgtaacgggaccgtaccgg

SEQ ID NO: 246618 - DNA, 681 bp, Homo sapiens
  misc_feature: GYAE6OF01ELPIC.9.70.G04.1.454.CMB.1.raw
  modified_base (234)..(234): a, c, t, g, unknown or other
  misc_feature (234)..(234): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtnactcatcagaggtgtcgttcctacgtcggacctggactccggcacggtcccgccggacgaacggggtcgtgggaagttagttagttacgggaacgtaattccgtaagtcgaccgtagggtcgggaccctacctaagttaccctaacccgaaccccgtccctacgaaagcgtacgacgtcaagctagtcgtacacgtacgaaccaccgttacccaacgtaaccctacgtttccctacccgttagaaccgtaggtgtaacgtttatacgtacgacccggtccacgaacggtaccgacgggtacctagttaacttacgtggtcgacggacgtagtacggtaccgtttaagtttacggactacgtacgtttaaacgttaaacccgtcttaacggtaccgttcgtacgggtaccgttacgggtacgggacccgtaggggaacccgtaacggg

SEQ ID NO: 246619 - DNA, 531 bp, Homo sapiens
  misc_feature: GYAE6OF01E2N8U.9.70.G04.1.454.CMB.1.raw
  modified_base (329)..(329): a, c, t, g, unknown or other
  misc_feature (329)..(329): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccnccatctacaacccgtccctcaagagtcgagtcagcatgtcagtcgacacgtcccagaaccagttcctccctgacagtgattatatgaccgccgcagaccacggcgtgtattactgtgcgagagacggtccgttatttaggaccagtctagttaaaactcctactacggtctcggtacgtcgtggggccaggggaccaacggg

SEQ ID NO: 246620 - DNA, 815 bp, Homo sapiens
  misc_feature: GYAE6OF01CEOLR.9.70.G04.1.454.CMB.1.raw
  modified_base (234)..(234): a, c, t, g, unknown or other
  misc_feature (234)..(234): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccccagatgggtcctgtcccaggtgcggctgcaggagtcgggcccaggactagtgaagccttcacaggccctgtccctcacctgcactgtctctggtnactccatcagaggtggtcgttcctactggacctggatcccggcacgtcccgccggcaaggggacttagggagttactagttcggaaccgtaatccgtatgccctaggtggggacccgccagttcctaaaccaacccccgttcccctacgaaaacggacgttaccgacggttaccaaacggtccaaagtttcggtacctaacgggttcccggaaaccgtaaccccgggttaccccaacccggtaaaccccgtaacgggtttaccccttacccccgttacggaaccgttaacggttacggtaaaggtttttaacttaacgttaccggaaccccggtcccggaccgtaaccggaacccgtaacccgggtacccgggtttacggttaaccgttttaacgttcggttacggtaccgggaagtaacgggtacgggttaacccggtttaagtttttaaccgggacccgtaaggtaccgtttaacggttaaaaaaccttacccgttaaccgttaaaccgggttccgttacgggtaaccgggttaccggttacgggggaacccggtaacgggggtaacccgtaaacgggg

SEQ ID NO: 246621 - DNA, 603 bp, Homo sapiens
  misc_feature: GYAE6OF01EJFNM.9.70.G04.1.454.CMB.1.raw
  modified_base (333)..(333): a, c, t, g, unknown or other
  misc_feature (333)..(333): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctccatcagaggtggtcgttcctacgtggacctggactccggcacgtccgccggcaagggctggagtatagttggacgaatctatgccagtgggaccncatccacaacccgtcctacgaagcgtcgagtcagcatcgtcagtcgacaccgtcccaagaacctacgttcctcccgtagactagtagtagttatacgtcgacccgcgacacgacgacggtccgtagtacttacgtcggtcgacggaggtacggtacggtccgtttaagtttacggacctagtacgttaacgttaaaacctcccgttaacgtaccgggttacgtacgggtaccgttcggtacggggccgtaacgggggaacccgtaacggg

SEQ ID NO: 246622 - DNA, 596 bp, Homo sapiens
  misc_feature: GYAE6OF01D4HY0.9.70.G04.1.454.CMB.1.raw
  modified_base (364)..(364): a, c, t, g, unknown or other
  misc_feature (364)..(364): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggcacgtcccgccggcaaggggactgggagtatagttggaacgaatctatgccaggtcgggaccgccatctaaccaaccccgtcctacaagngtcgagtcagcatgtcagtccgacaccgtcccaagaaccagttctaccctgacgtagtgtagttatatcgaccgccgcagacgacggcgtgtattacgtgtacgcgagacgacggtccgtttagtttacggaccgtagtaccgttaaagttaaaaccttcccgttaaacgttaccgggtcgttacgggtaccggttcgtacgggggacccgtaagggggacccgtaaacggg

SEQ ID NO: 246623 - DNA, 587 bp, Homo sapiens
  misc_feature: GYAE6OF01A95AT.9.70.G04.1.454.CMB.1.raw
  modified_base (334)..(334): a, c, t, g, unknown or other
  misc_feature (334)..(334): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactcggacctggactccggcacgtccgccggcgaagggctggagtatagttggacgatctatcgccagtcgggaccncatctaccaaccccgtccacgaagcgtcgagtcagcatgtcagtcgacacgtcccaagacctcgttctcctgactagtcgtagttactacgtcgacccgtccgcgaacgaccgaccgggtccgttagttaacgttcgtggtcgacgaggacgtacggtccgtttaagtttacggacctaggtacttaacgttaaaactccgttaacgtacggtcttacgggaccgttcggagggccgaagggaccgtaacggg

SEQ ID NO: 246624 - DNA, 723 bp, Homo sapiens
  misc_feature: GYAE6OF01DJ6YU.9.70.G04.1.454.CMB.1.raw
  modified_base (339)..(339): a, c, t, g, unknown or other
  misc_feature (339)..(339): n is a, c, g, or t
  modified_base (550)..(550): a, c, t, g, unknown or other
  misc_feature (550)..(550): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaacgccttcacgacggccctgtccctcacctgcactgtctcgtggtcactccatcgagaggtcgtcgttcctactggacctggactccggcacggtccggccggacgaaggggtctaggagtattagttacggaacgtaactcgttancgaccgtaggtccggggaccctcaacgttacctaacccgtaaaccccgttcccgtaaagaacggtacgttaccggacgtaccgaacggactaacgtcgttacgaacggtaccgaaccctaccgtacccgaacgtaaaccctcggttaccctcccgtagacgtaagtgttaagttactagtccgaaccggcgactagaccgcggtaccgttnttaacgttacgtcggtacgacggaacggtacggtacgggttaccgttttaacggtttaaccgacccgtaaacgttaccgttaaaacgtttaaaaccccgtaccgtttaaccgtacgggttcgtacgggtaccggttcggaccggggaccgtaaaccggggaccgttaaaccgg

SEQ ID NO: 246625 - DNA, 604 bp, Homo sapiens
  misc_feature: GYAE6OF01C3FPJ.9.70.G04.1.454.CMB.1.raw
  modified_base (241)..(241): a, c, t, g, unknown or other
  misc_feature (241)..(241): n is a, c, g, or t
  modified_base (510)..(510): a, c, t, g, unknown or other
  misc_feature (510)..(510): n is a, c, g, or t
  modified_base (528)..(528): a, c, t, g, unknown or other
  misc_feature (528)..(528): n is a, c, g, or t
  modified_base (587)..(587): a, c, t, g, unknown or other
  misc_feature (587)..(587): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagagtgggtcctcgtcccaggtggcggctgcaggaggtcgggcccgaggactagtgagccttcacacggccctcgtccctccacctcgcactgtctctggtnacgggggggggggggggggggggggggggggggtccactcagaggtggtcggtttcccgttacctggacctggatccggccagtccgcccggccaagggactgggagtatattggacggaatctatgccagtggggaccggcccactctacaacccgtccccctccaacgagtcgagtcagcatgtcagtcgacacgtccccagaacccaggttctcccctgacagtgagttatatgaccgcccgcagacaccgggccgtgactttacngtgcgagagaggccgttntttaggacccagtctgtttaaaaactcctacttacggtcctgggacctctgggggcccngggggaccctaacgggg

SEQ ID NO: 246626 - DNA, 560 bp, Homo sapiens
  misc_feature: GYAE6OF01D98MP.9.70.G04.1.454.CMB.1.raw
  modified_base (329)..(329): a, c, t, g, unknown or other
  misc_feature (329)..(329): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtcgggaccncatctaaccaaccccgtcctacaagacgtcgagtcagcatgtcagtcgacacgtcccagaaccagttctccctgacagtgaagttatatcgacccgccgacacgacgaccggcgtagttacttacgtgtgcgagagacggtcgtttaagtttacggaccagtacttacgttaaaactcctaacgttacggtcgtacggtacgtcgtacggggaccgaggggaccgtaacgg

SEQ ID NO: 246627 - DNA, 905 bp, Homo sapiens
  misc_feature: GYAE6OF01ENOSC.9.70.G04.1.454.CMB.1.raw
  modified_base (200)..(200): a, c, t, g, unknown or other
  misc_feature (200)..(200): n is a, c, g, or t
  modified_base (361)..(361): a, c, t, g, unknown or other
  misc_feature (361)..(361): n is a, c, g, or t
tcagtgatacgtctcacgaccggtgctcgatttagtgtagtgtgaagggaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacnggccctgtccctcacctgcactgtctcgtggagtacctccatcgaggagggttcggttccgtttcctagtccgggacccgttgggtaccgtcccgggactcggtccccggccggacggtaaagggactttgggaagttaattaggttaggtaaccgtaacntttacgtacgtcgaccgtagggtaccggacccctctaacgttacccgtaaacccgtaacccccgttcctaacgaaaggtccgtacggtaacgtaccgaacggtacctaaggtttccggtaacccgtacggtacccgaacccgtaaccccggtaacccccgtaaaccgtaaccccgttaacggtttccccttaccccgttaacggtaaccgtacggttaacggttaacgtttaaccgttaacggtacccggaacccccggtacccgtaaccggtaaccggtaacccgggtaacccgggttacccggtttaacggtttaaccgtttaaccgggttacggtacgggtaaacggtaacgggtaacgggttaccgggtttacccgttttaaacggtttaaccggtaaacccggttaacgttaccgtttaaaaaccggtttaaaaacccgtttccccggttaaaccggttaaccgggttccggttaaccggggttaacccgttaccgggggttacccggggtaacccggggtaacccggggtaaacccgg

SEQ ID NO: 246628 - DNA, 697 bp, Homo sapiens
  misc_feature: GYAE6OF01CV47B.9.70.G04.1.454.CMB.1.raw
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
  modified_base (361)..(361): a, c, t, g, unknown or other
  misc_feature (361)..(361): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatggtcctgtcccaggtgcggctgcgaggagtccgggcccaggtactagtgaagccttacacgacggccctgtccctacacctgccactgtctcgtggtnactccatcgaggaggtggttcttcctagtcggtacctggactcccggnacggtccgccggagaagggactggattaagtagttacggactaagttctagtcgccgtaaggtcgggacccnctaactctaacccgacccgttccacgaagtcgcgtagtccagaccagttgcctagtacccgacacccgtacccaacgtacctacgttccctaccgtacgaccgtagtacgtaagtttactagtaccgaccgacgacccgaagacccgaccgggtacccgttggttaaccttacgtcggtacggtaccggaggtaacggtacggttaccgtttaacgttaacggaaccctaggtaacccgtttaacggttaaaacccttccgttaccggttaccggtttacgacggttaccgggttaccggtacgggggacccggtacgggggaaccttacccgggg

SEQ ID NO: 246629 - DNA, 807 bp, Homo sapiens
  misc_feature: GYAE6OF01BF1GZ.9.70.G04.1.454.CMB.1.raw
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
tcagtgatacgtctcacgaccggtgctcgatttagtgtagtgtgaagggaaaggcctgtgaaggcttcactagtcctggacctcctgtgcaagaacatgaaacatctgtggttcatcctcctctggtggcagctcccagatggtcctgtcccaggtgcggctgcaggagtcgggcccaggactagtgagccttcacnggccctgtccctnacctgctactgtctcgtggtcactcatcgagaggtgtcttccatcggacctgggactccggactacggtcccgcggacgaacgggtcctgggtaagttagtacgttcggaactaagttcgtaagtcggaccgtaaggggttacgggaccctacctaacgttacccgtaaccgtaaacccccgttccgtaagaaacggtacggttccgaaggtaccaagtaccgtaagtttcggtccgtaacgttcccggtaaaccgtacccggttacccgaaacgtaacccgtttacgttaccccgttacccgttaagggaaccgttaggttaacggttaacgtttaccgttaacggtacccggaaccccgggttcgtaaccgtaaccggtaacccggtacccgggttacgttaaccggttacttaccggttcgggttacgaccgggtaacggtaacggtacggttaaccggttttaaggtttaaccggacccgtaaggttaccggttaaaccgttaaaaccttcccggttaccggttaaccggttcgttaaccgggtaccggttacggtaaccgggggtcgtaaccgggggtaccttaacccgggg

SEQ ID NO: 246630 - DNA, 652 bp, Homo sapiens
  misc_feature: GYAE6OF01ET9JV.9.70.G04.1.454.CMB.1.raw
  modified_base (441)..(441): a, c, t, g, unknown or other
  misc_feature (441)..(441): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggacacgtccgccggacaaggggctgggagtatagttggacgtaatccgtatcgaccgaggtcgggacccgccatccgtaccgaaccccgttccctagaaagacggtcgagtcagctatcgtcaggtcacacgtccacgacctagtcctccctgactagtgtaagttanactcggaccgccgacgacgtaaccgaccggtccgtagttaacttacgtggtacgacggagtacgggtaacgggttccggtttaacgttttaaccgggtacctaacggtaccgtttaaacgttaaaaaccttcccgttaaccgttaccgggttacgttacgggtaccggttaccggtacgggggacccgtaagggggtacccgtaaacgggg

SEQ ID NO: 246631 - DNA, 969 bp, Homo sapiens
  misc_feature: GYAE6OF01DE1NK.9.70.G04.1.454.CMB.1.raw
  modified_base (347)..(347): a, c, t, g, unknown or other
  misc_feature (347)..(347): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagtaggtgtcgttcctactcggacctggactcccggcaggtcccgccggacaagggactgggagtatagttggaacgaatctaatcgaccgtaggtcggggacccnccgtaactccgtaaccaaccccggttcccctagaaacggtacgtccgaaggttccaaggccaaagttcggtacgtaacggttaccgaaccgtacccgttaccccgaaacgtaaaccccgtaacgtttaccccgttaccccgtacggtaaccgtaacgggtttaacggtaacggtttttaaacgttaacgttaaccggttaaccggttacggaccccggttaacccgtaaccgggaaccccggttaacccgggggttaaccccggtttaacgggtttaaaccgtttttaaccggttcgggttaacggggtacccggtaaacggggtaaccggggttaaccgggggttttaaacccccggtttttaagggtttttttaaaacccgggggtaaacccccgttaaaccggggtttaaaacccgttttaaaaaccggggttttttaaaaaaaaaaccccccgttttaccccggttttaaaaacccccgggtttttaaacccgggggttttaccccggttttaaacccgggggggtttaaaccccgggttttaccccgggggttttaacccgggggggggaaacccccggggttaaaaccccggggggggttaaaaaacccccggggg

SEQ ID NO: 246632 - DNA, 565 bp, Homo sapiens
  misc_feature: GYAE6OF01BHEUY.9.70.G04.1.454.CMB.1.raw
  modified_base (336)..(336): a, c, t, g, unknown or other
  misc_feature (336)..(336): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtcctctggtgactccatcagaggtggtcgttcctactggacctggactccggcacgtccggccggacaaggggctggagtatagtggacgaatctatcgcaggtcgggaccncatcctaaccaacccgtcctagaagcgtacgagtcagcagtcgtcagtccacaccgtacccagaaccacgttcctcctagacaggtagtagttatacgtcgaccgccgacaagaccacggtcgtagtacttacgtgtacgcgagagtacgtcgtttagttacgactagtacttaacgtaaactcctaacgtcggtcacggtcgtacggtagggcgaaggggactaacgg

SEQ ID NO: 246633 - DNA, 618 bp, Homo sapiens
  misc_feature: GYAE6OF01AXCHJ.9.70.G04.1.454.CMB.1.raw
  modified_base (340)..(340): a, c, t, g, unknown or other
  misc_feature (340)..(340): n is a, c, g, or t
  modified_base (423)..(423): a, c, t, g, unknown or other
  misc_feature (423)..(423): n is a, c, g, or t
  modified_base (566)..(566): a, c, t, g, unknown or other
  misc_feature (566)..(566): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctccatcagtaggttggtccttcctacgtggacctggactccggcacgtccgccggcgaagggctggagtatagttggaacgtaatctatgccaggtcggacccncatcctaaccaaccccgtcctacgaagtcgtcgagtcagcatgacagtccacacgtaccagacctgtcctccctgaactgtanagttatacgtccgaccgcgacacgaccgtacgggtccgtagttacttacgtggtcgacgaacgtaaggtacggttacgtttaagtttaacggacctaagtacgttaaacggtttaaaacctcccgttaaacgttaccgggttntaaccgggtacgttaccgggacggggacccgtaaggggtaacccgtaacggg

SEQ ID NO: 246634 - DNA, 523 bp, Homo sapiens
  misc_feature: GYAE6OF01ENAB7.9.70.G04.1.454.CMB.1.raw
  modified_base (484)..(484): a, c, t, g, unknown or other
  misc_feature (484)..(484): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggaccctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttatttaggaccagctgttaaaacncctactacggtctggacgtctaggggccaggggccaagg

SEQ ID NO: 246635 - DNA, 661 bp, Homo sapiens
  misc_feature: GYAE6OF01DPSEC.9.70.G04.1.454.CMB.1.raw
  modified_base (278)..(278): a, c, t, g, unknown or other
  misc_feature (278)..(278): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctccatcagaggtggtcgttcctactggacctggactcccggntacggtccccgccggacaaggggctggaagttaattagttacggggaactaaattcctaagtcggaccgagggtacgggacccgaccaattcctaaaccaacccccgttccctacgaaaggacgttcggaagttaccagaccagttgtaccaaggtccgaaccgtacccgtaccccgaacgaaccctacgttccctacccgtgacctaagttagtagttatagtcgacccgccgacaacgtaccgaccggtcgtagttacttacgtgtcgcgagtagacggtacgtttaagtttacggacctagtacttaacgttaaaacctaccgttactacggttcgtacggtaccggttacggtacggggaccggaggggaccgtaacgg

SEQ ID NO: 246636 - DNA, 574 bp, Homo sapiens
  misc_feature: GYAE6OF01A1HVQ.9.70.G04.1.454.CMB.1.raw
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttccactggacctggatccggcagtccgccggcgaagggctgggagtatagttggacgatctatgccagtgggaccncatctacaacccgtcctcgaagngtcgagtcagcatgtcagtcgacaccgtcccagaaccagttcctccctagacagtgtagttatatcgaccgcgcacgacacggccgtgtacttactgtgacgagagacggtccgtttagtttacggaccctagtaccgttaacgtttaaaacctccgttaaccgttaccggtacgttcgggaacgttcggtacggggccgaacgggggaccctaaaccgggg

SEQ ID NO: 246637 - DNA, 752 bp, Homo sapiens
  misc_feature: GYAE6OF01A4PJR.9.70.G04.1.454.CMB.1.raw
  modified_base (235)..(235): a, c, t, g, unknown or other
  misc_feature (235)..(235): n is a, c, g, or t
  modified_base (296)..(296): a, c, t, g, unknown or other
  misc_feature (296)..(296): n is a, c, g, or t
  modified_base (356)..(356): a, c, t, g, unknown or other
  misc_feature (356)..(356): n is a, c, g, or t
tcagtgatacgtctcacgaccggtgctcgatttagtgtagtgtgaagggaaagggcctgtgaaggcttcactaagtcctggacctcctgtgcaagaacatgaaacatctgtggttcatcctcctctggtggcagctcccagatgggtcctgtcccaggtgcggctgcaggagtcgggcccaggactagtgaagccttcacacggccctgtaccctcacctgcactgtctctggtnacctccatcgagaggtcgtcgttccagtggacctggactcccgggcacggtcccgccgganaaaggggtctgggactattagttcgggaacgtaatctagtcgaccgtaggtcgggacccnctactcccaaccgaacccccgtcctaagaacgtacggtcgaacgtcaaggcctaagttcgtacgagttacccgaactaccggtcccaaggtaaccctaggttccctacccgtgtaaccaggtacgtaagtttacgtaagtccggacccgtacccgacgtaacggaacccgacccgggttacgtacgtttaactttaacggtcgggttaggaccggtaacggtaaggtaccgggttaaccggtttaaggttttaacccgggaaaccgttaaggtacccgttaaaacgtttaaaaacccgttaccccgttaaccggttaacccggttacgttacggggtaccggtttacccggggtacgggggtaacccgtaacggggggtaacccgtaaacccgggg

SEQ ID NO: 246638 - DNA, 801 bp, Homo sapiens
  misc_feature: GYAE6OF01DDQU0.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatagaaacatctgtggttcatccctcctcctggtggcagctcccagatcgggtcctgtcccaggtgcggctgcaggagtccgggcccaggactagtgaacgtccttcacgacggccctcgtccctcacctgccacgtgtctcgtggtcactccatcgaggtacggtgttccgttcctacgtcggaccgtggacgtcccggctacggtccccggccggacgaacggggtactagggtaagttaagttacgttacgggaacgtaaatcgttaagtcgacccgtagggtacggggaccccacctacttccctaaacccgtaacccccgttccctaacgtaaaacggtacggttaccggaaacgttccgaacgtcctaacgttcgtacccgtaaggttcccgaaaccgtaccccggtaacccgaaaccggtaaaccccttaccggttttacccctaccccgtaggtaacctacgggttaagtacgtttaactacgtaccggaccccgtcgaccgaacgacccgtaccgggtcgttagttaacttacgtgtacgacggtaaggtaacggtacggttaccgttttaacgtttacggaaccttaggtaaccgtttaaaccgttaaaacccgttccgtaaccggttacggtccgttacgggtaccgttacgggaccggggtaacccggacgggggtaaccgtaaacccggg

SEQ ID NO: 246639 - DNA, 739 bp, Homo sapiens
  misc_feature: GYAE6OF01DEUPN.9.70.G04.1.454.CMB.1.raw
  modified_base (204)..(204): a, c, t, g, unknown or other
  misc_feature (204)..(204): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagcctcccagatgggtcctgtcccaggtgcggctgcaggagtccgggcccaggactagtgaagtccttcacncggccctcgtccctcacctgcactgtctcgtggtcgctccatcgaggtaggttcggttccgttcctacgtacggtaccgtgggtactcccggcgtacggtcccggccggacgaaaggggtcctagggaattaagttagttaggaaccgtaattcgttacgtcggaccgagggttccggggacccaccgtaacttacccgtaacccgtaacccccgttccaacgtaaaggaccgttcgaacgtcgacgcgtacttcggaactacgtacccgaccgtacccgtacccgaacgtaacccgtaccgttttacccgcccgtaggtaaaccgtaggttacggttaaactttacgtaccgtaccggaccccggtcgaaccgaaccggtaccgaccgggtaaccgttgttaacgttaccgttgggtacgacggaagtcggtacggttacggtttacgttaacggacctagtacgttaaacgtaaacctcgtacgttcggacttacgggtaccgtcggtacgggaccggaagggacgtaaccgg

SEQ ID NO: 246640 - DNA, 570 bp, Homo sapiens
  misc_feature: GYAE6OF01AJTI4.9.70.G04.1.454.CMB.1.raw
  modified_base (233)..(233): a, c, t, g, unknown or other
  misc_feature (233)..(233): n is a, c, g, or t
  modified_base (472)..(472): a, c, t, g, unknown or other
  misc_feature (472)..(472): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctacgtggacctggactcccgggcacgtcccgccggcgaagggactggagtatagttggacgaatctatgccagtcgggacccgctatcctaccaaccccgtcctacaaggacgtcgacgtcagcatgtcagtccgacaccgtcccaagaacctacgttcctaccctgacagtgtagttatatcgacccgccgcacgaccacggtcgtgtattacgngtgacgagaggtacggtaccgtttagtttacggacctagtacttaacgttaaactcctacgttacgtcgtcgtacgtcgcgggccgagggcgtaacgg

SEQ ID NO: 246641 - DNA, 801 bp, Homo sapiens
  misc_feature: GYAE6OF01B14NK.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccagttgcggctgcaggagtccgggcccaggactagtgaacgtccttcacacggccctgtcccctacacctgcactgtctcgtggtacgacctccatcgaggtaggttcggttccgtttcctacgtcggacctggacgtcccggactacggtccccgaccggacgaagggtccgtgggaattagtaagttggaacgtaaacttcgtaagtccgaccgtagggttaccggggaccccacctaagttaccctaaacccgtaaacccccgttccctaagaaacgtacggttaccgaacgtaccgagtcctacgttcgtacgaaccggttaccgaaccgtacccggttaccccaaacgtaaccccgttacgtttacccctacccgttacgaaccgtaggttaacggttaaacgttttaacgtaaccgttaccgggaaccccgtcccgaacgtaaaccggaccggtaacccgggttacccgttaacgtttaaacgtttaaccggttcgggttacggaaccggtaaggtacggtaccgggttaccgttttaagtttaaccggacccgtaagtaccgttaaaaccgttaaaccttacccgtacgttaccggtacgtaggaccttcgggacgggacccgtacgggaaccgtacgg

SEQ ID NO: 246642 - DNA, 878 bp, Homo sapiens
  misc_feature: GYAE6OF01AR25V.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgagccttcacaggccctgtccctcacctgctactgtctcgtggtcgacctccatcgagaggtggtcgttcctactcggacctgggactcccgggcacggtcccggccggacgaaacggggtctggggtatatagttgggaacgtaattcctaagtcggacccgaagggttcggggaccccgacctaacttaccccttaacccgaaaccccccggtttcccctaacgaaaaggtaccggttaccggtaaggtacccaaggcctaaacgtttcggtaacccgtaacggtttaccccgaaccctaaccccggttacccccgaaacgggtaaacccctttacggtttccccgttacccccgtaagggaaacccgttaaggttacgttaaaggttttaacctaaacggttcccgggaacccccggtcccggaaccgtaacgggaaccccggtaaccggggttcccgtttaagtttaactttacggacgggttacggaaccggttaacggggtaacggggttaccggttttaaccggtttttaaacggtaccggaaccgttaacgttaaacccggttttaaaaacttaaccccggtttaccgttaaacgggttttccgggtacgggttaaccggttcccggggttacgggggtacccggggtaccgggaaaccgggggtaacccgttaacccggg

SEQ ID NO: 246643 - DNA, 586 bp, Homo sapiens
  misc_feature: GYAE6OF01DJMFZ.9.70.G04.1.454.CMB.1.raw
  modified_base (231)..(231): a, c, t, g, unknown or other
  misc_feature (231)..(231): n is a, c, g, or t
  modified_base (270)..(270): a, c, t, g, unknown or other
  misc_feature (270)..(270): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
  modified_base (317)..(317): a, c, t, g, unknown or other
  misc_feature (317)..(317): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggccaggactagtgaagccttcacaggccctgtccctcacctgcactgtctctggtnactccatcagaggtgtcttccactggacctggatccggnagtccgcgcaaggctggatantggacaatctangccaggtcggaccncaatcaccacccgttccagaaagcgtcaagtcagcatcgacagtccgaactccgtaccaacgaacctagttcctaccctagtacgtagtagtagttatacgtcgaccgccgcgacgacgaccggtcgttagttagttaccgtaggtcgacggagaggtacgtaccggtttaagtttacggacctagtacgttaaacgttaaaacctccgttaacgtacgttcgtacggtaccgttacggtacggggtaccgacggggtaccgtaacggg

SEQ ID NO: 246644 - DNA, 527 bp, Homo sapiens
  misc_feature: GYAE6OF01BV3MU.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccgcatctacaacccgtccctcaagagtcgagtcagcatgtcagtcacacgtcccagaaccagttctccctgacagtgagttatatgaccgcgtacagacacggcgtagtattactgtgcgagagacggtcgttagtttacggacctagcttagttaaactcctactacgtctacggtacgtcgagggcaggggcctaacgg

SEQ ID NO: 246645 - DNA, 683 bp, Homo sapiens
  misc_feature: GYAE6OF01DVAFN.9.70.G04.1.454.CMB.1.raw
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagagtgggtcctgtcccaggtgcggctgcaggagtcgggccaggactagtgaacgccttcacacggccctgtccctcacctgcactgtctctggtcacctccatcgagtagggtcgttccgttcctacgtcggacctggacgtccggactacggtcccggccggacgaagggacgtaggagtattagtcggacgaatctatcgacgaggtcgggaccnccgtatacctaaccacccgtacctacgaaagacgtacgacgtacacgactagtcgtactaacggtccaaccgtacccgtacccaacgtaacccgtacgtttaccctacccgtacgaacgttacggttacgtaacgttttaataccgttaaccggacccgcccgacgaacggtaccgaacccgggtcgttaagttaacgttacgtggtcggacgagtaggtacggttaccgtttagtttaacggacctaagtaccttaaacgttaaacctaccggttactacggtcgtacggtacgttcggaccggggccgaagggaccgtaaccgg

SEQ ID NO: 246646 - DNA, 687 bp, Homo sapiens
  misc_feature: GYAE6OF01C77YA.9.70.G04.1.454.CMB.1.raw
  modified_base (233)..(233): a, c, t, g, unknown or other
  misc_feature (233)..(233): n is a, c, g, or t
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagtaggtgtccgttcctacgtggaccttggactccgggacacggtcccgcggacaagggctgggaacttatagttggaacgtaatcgtaatcgccgtaaggtcgggacccnccatcctaaccaaccccgtcctacaaaggtcgtccgaagtcaagcagttgccgtaagtccgaactacccgtacccacgaaccctacgttcctacccgtagactaggtacgtagttatacgtcgaccgccgacgacgaccgaccggccgttagttactttacgtggtcggacgtagtaagggtacggttaccggtttaacgttttacgggaacctaggttaccgttaaacggttaaaaacccgttcccgttaaaccgttaaccgggttccgttaacgggtaccgttaccgggttaccgggggaacccggtaacgggggtaaacccgtaaaccgggg

SEQ ID NO: 246647 - DNA, 682 bp, Homo sapiens
  misc_feature: GYAE6OF01BHY34.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgtggctgcaggagtcgggcccaggactagtgaagccttcacaggccctgtccctcacctgcactgtctcgtggtgactccatcaggaggtcggttcgttcctacgtcggacctggactccgggcacggtcccggccggacgaaggggactaggtagtagtagttggaacgtaatcgtaatcgaccgtaggtcggggacccgaccactcctaacctaaccccgtcctacaaggacgtcgacgtcagctagtgtacagtcgacgtaccgtacccaagtaacccgtagttcctaccctagaacgtagtagtaagttacgtacgtacgacccgccgacgacgacgaccgggtacgtgttaacttacgtgtacggacgaaggtaggacggttaccgtttaagttacggtaccaacggttaacttaaccgtttaaaaacccttccggttaaccgttaccggttacggttaacgggtaccggttaccggtaccgggggacccgtaaaccgggggtaccgttaaacccggg

SEQ ID NO: 246648 - DNA, 788 bp, Homo sapiens
  misc_feature: GYAE6OF01BLPJ3.9.70.G04.1.454.CMB.1.raw
  modified_base (395)..(395): a, c, t, g, unknown or other
  misc_feature (395)..(395): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgtccttcacacggccctcgtccctcacctgcctactgtcctcgtggtcgacctccattcgaggtagggttcggtcccgttccgtaacgtcgggaccctggacgtcccggacacggttccccggaccgggacgaacggggtctagggaagttagttaaggttcggaacgtaatacgtagtacggccgtaggtcgggaaccccnctaacttcccgtaaccctaacccgttccctacaaaggtcgtacgtacgtacgacgtactagtcgtcgtaagtaccgacctaacccggtacccaagttaaaccccgtcggtttcccctaccggtagaaccgttaggtaacggttaactttacgtaaccgtccggacccgacccgtaacgaacgtaccggtaacccgggtaccgttgtttaacgttcccgtagggtcggaaccgtaggtacggtacccggttaccgttttaaaggttccggaacctaaggttacccgttaaaacggtttaaaacccccgtcgttaaaccggttccggttaccggtaaccgggtcggttacccgggtaacggggaccccggtaaagggggtaccccgtaaacgggg

SEQ ID NO: 246649 - DNA, 556 bp, Homo sapiens
  misc_feature: GYAE6OF01BWPXE.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatagttggacgaatctatgccaggtgggaccgcatcctaccaacccgtcctcaaagcgtcgagtcagcatgtcagtcgacacgtcccagaacccagttcctccctgactagtgagttatatcgccgaccgcacgacacggcgtgtacttacgtgtgcgagagaggtccgttagtttacggacctacgtacttaagttaaacctccgtacgttacggtcgtacggtacgttcgtagggcccgacggggaccgtaacggg

SEQ ID NO: 246650 - DNA, 794 bp, Homo sapiens
  misc_feature: GYAE6OF01BJ1LV.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctctggtgcagctccagatggtcctgtcccaggtgcggctgcaggagtcggcccaggactagtagaacgccttcacgtacggccctgtccctcacctgcacgtgtcctcgtggtcgacctccatcgaaggtacggttcggtccgttcctacgtcggtacctggaacttccggactacggtcccggccggtacggaaacgggtacgttgggtaacgttacgttaggtttacggaaccgttaattccgtaacgttcgaccgtaacgggtaccgggtacccctactaacgttaccctaaaccccgtaccccgttacctaacgaaacggtacgtacgtacgttacgaacgtcgtagttcgtacgaacgtaccgtaaccgacccgttaacccgaaggtaaccctaggttcccctacgtcgaaactggttacgtattacgtacgacccggaccgtcgaccgtaaagggcccgttaacgggtcccgtttaagttaaccgtttacggagggttcgaacccgggttaagaccggttaacgggttaccggtttttaacggttaaacggaccggtaaacttacggttaaaaaccgttaaacccttaccgttaccggtaaacgggtttcgtaaacggttacccggtaccgggtaggggaaccccgtaaagggtaccccgtaacgg

SEQ ID NO: 246651 - DNA, 619 bp, Homo sapiens
  misc_feature: GYAE6OF01BJNTF.9.70.G04.1.454.CMB.1.raw
  modified_base (286)..(286): a, c, t, g, unknown or other
  misc_feature (286)..(286): n is a, c, g, or t
  modified_base (327)..(327): a, c, t, g, unknown or other
  misc_feature (327)..(327): n is a, c, g, or t
  modified_base (353)..(353): a, c, t, g, unknown or other
  misc_feature (353)..(353): n is a, c, g, or t
  modified_base (425)..(425): a, c, t, g, unknown or other
  misc_feature (425)..(425): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcagaggtgtcttcctactggacctggatccggcacgtccgccggnaagggctggatatagtggaacaatctatcgcaggtcggccncatcctaccaaccccgtcctagaagngtcgacgtcagcagtgacagtaccgacaccgtccaagtaacccagttcctcccgtgactagtagtagttaancgtacgaccgccgacgacgaccgtaccgggtcgtagtaacttcgtggtacgcggtaaggacggtacgggttaccgtttaagtttaacgggaccctaaggttaccgttaacgtttaaaacgttcccgttaacggttacggttacgtacgggtacccggttcggaccggggacccgagggggtaaccctaacgggg

SEQ ID NO: 246652 - DNA, 603 bp, Homo sapiens
  misc_feature: GYAE6OF01BTV82.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcagaggtggtcgttctactggacctggatccggcagtccgccggcgaagggctggagtatagttggacgaatctatcgccaggtcgggaccgccagtcctaccaaccccgtcctcaaagacgtcgagtcagcatgtcagtcgacaccgtcccagaccagttcctccctagactagtgagttatatacgacccgtccgcacgacgacggtccgttagtacgtttacgtggttcgacgacggtagtacggtaccgtttagtttaacggaccgtaggtaccgttaacgtttaaaacctccgttaaccgttacggtccgttacgggtaccgtacggtggggacccgtaacgggggaccgtaacggg

SEQ ID NO: 246653 - DNA, 707 bp, Homo sapiens
  misc_feature: GYAE6OF01BST8F.9.70.G04.1.454.CMB.1.raw
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacacggccctgtccctcacctgcactgtctctggtcgacctccatcgaggtaggtggttcgttcctacgtcggacctggactccggcacggtcccgccggagaacgggctgggacgttatagttcggaacgtatctagtcgacctaggtcgggacccncattcctaaccaacccgtcctacgaagtacgtcgagtcagctagtcgtcgacgtcgaacctaccgtacccgtaacgtaacctacgttccctacccgtacgtaacgtacgtagtaacgttaagtacgtcgacccgtaccgacgaacgtaccgtaccggtccgttagttaacgttacgtcggtacggacggtacggtaaggtaccggttacgtttaaggtttaacggtaccgtaaacggtaccgtttaaacgtttaaaaacccgttcccgttaaccggttaccggttaacgttaccgggttaccggttacgggtaccggggaccgggtaaacggggtaacccgtaaaccggg

SEQ ID NO: 246654 - DNA, 738 bp, Homo sapiens
  misc_feature: GYAE6OF01AIA97.9.70.G04.1.454.CMB.1.raw
  modified_base (361)..(361): a, c, t, g, unknown or other
  misc_feature (361)..(361): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcgaggagtccgggcccaggactagtgaagccttcacaggccctgtccctcacctgcactgtctcgtggtcacctccatcgaggtaggttcggtccgttcctacgtcggacctggactccggacacggtcccggccggacgaagggcgtgggatagtagtggaacgtatcgtatcggaccgtaggtacgggacccncctaacttacccgtaacccgaaacccccgttccctaacgaacggtacgtaccgagtccgagctagtcgttacgacgtaccgaccgtaaccgtcccgaacgtaaccctcgttaccctcccgtagacgtaggtacgtaagttacgtacgtacggacccgaccgacgacgtaaccgtaccggtccgtttagttacgttacgtcggtacgacggtaggtacgggtaccggttaccggttttaacgttacggaacccgtaacggttaccgttaaaccgttaaaacccgttcccgttaaacggttacccgggtaccgttacggggttacccggttaccggggttaccgggggaacccggtaacggggtaacccgtaacccggg

SEQ ID NO: 246655 - DNA, 812 bp, Homo sapiens
  misc_feature: GYAE6OF01CINEX.9.70.G04.1.454.CMB.1.raw
  modified_base (173)..(173): a, c, t, g, unknown or other
  misc_feature (173)..(173): n is a, c, g, or t
tcagtgatacgtctcacgaccggtgctcgatttagtgtagtgtgaagggaaagggcctgtgaaggcttcactagtcctggacctcctgtgcaagaacatagaaacatctgtggttcatcctcctctggtggcagctcccagagtcggtcctgtcccagttgcggctgcgaggngtccgggcccaggactagtgaacgtccttacacgacggtccctcgtcccctcacctgcctacttcgtcttcgtggtcgtacctccatacgaggtaggttcggttccgtttaccctacggtcggtacctgggaccgtcccggacgtaccggtccccggacccgggaacggaacgggggtacgtagggtaacgttagttacggttacgggaaccgttaacttcgttaagtcggtaccgtaacgggttccggggaaccccgtaccgtaacgttacccgtaaaccccgtaaccccccggttaccctaaacggaaacggtaccggttacggtaaacgtccgaaacgtcctaacggttccgtacgtaacggttaccggaacccgtaaccccgtacccgaacggtaaacccttaccgtttcccgtacccgtacggtacgtaaggtacgttaacgttacgtaacgtccgacccggacctacgaacgtacccggtacggtaccgttagttaacgttcggtacgtcggagtacgtaggtacggttacgtttagtttacgaccgttgtaaccgttaacgttaaaccttaccgttacgtaccggtagttaccgggtacggttcggccgggaaccgtacgggacccgtacgg

SEQ ID NO: 246656 - DNA, 736 bp, Homo sapiens
  misc_feature: GYAE6OF01CM80F.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcatgtcccaggtgcggctgcaggagtcgggcccaggactagtgaagccttcacacggccctgtccctcacctgcactgtctctggtcgactccatcaggtaggtcggtcgttcctacgtggaccttggactccggcacggtccgccggacaaggggacctggagttatagttggacgtaatctatgacctaggtcgggaccaccgtatacctaaccgtaaccccgtccctacgaaacggtacgtcgaacgtcagcctaagtcgttacacggttaccgaaccgtaccgtaccccaacgaacccctacgtttccctaccccgtagaccgtagtacgtaacgttactacgtaccgggacccgtaccggacaacggaccgtaaccgggtccgttaaggttacgttaacccgttgggtaccggtacggaacgggtacggtaacggggttacccggttttaaagtttaaccgggaaccgttaacggttaccgtttaaacggtttaaaaacccgttccgttaaaccgggttccggttaccggtacgggttaccggtacgggttaccggggtaccgggaaccgggggttaaacccgg

SEQ ID NO: 246657 - DNA, 719 bp, Homo sapiens
  misc_feature: GYAE6OF01A5X0O.9.70.G04.1.454.CMB.1.raw
  modified_base (338)..(338): a, c, t, g, unknown or other
  misc_feature (338)..(338): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcttcctactggacctggactccggcacgtcccgccggacgaagggctggagtattagttaggacaatctagtcgccgagtcgggaccnccatcctaaccaacccgtcctacaagcgtcgagtcagcagtcgtcacgtcgacctaccgtacccgaacgaaccctacggttccctcccgtacgaccgtaggtacgtaagtttaacttagtccgacccggccgacgtaaccggaccgtaacccgggtccggttagttaacgtttaccggtagtccgggaacggtaggtaacggtaacgggttacccggttttaaggtttaaccggtaacccgtaacggttaaccgtttaaacggtttaaaaaccccttacccggtttaaccgttaacccgggttaccggttaccggggttaaacccggttccgggttaaccggggggacccggttaacgggggtaaccccggtaaaccgggg

SEQ ID NO: 246658 - DNA, 745 bp, Homo sapiens
  misc_feature: GYAE6OF01DQV2M.9.70.G04.1.454.CMB.1.raw
  modified_base (377)..(377): a, c, t, g, unknown or other
  misc_feature (377)..(377): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccggccaggactagtgaagccttcacacggccctgtccctcacctgctactgtctcgtggtcgacctccatcgaggtaggttcggttccgttacctacgtcggtaccgtggtactccggactacggtcccgccggacgaacgggtactaggaagttatagttaggaacgtaattcgtaactcggaccgtagggtcgggaccccnccgtaacttacctaaacccgtaaaccccgtccctaacgaaaggtacggtcgtaacgtacgagtctagtcgtacgacgtaccgaacctaccggtacccaacgtaacccttacgttcccgtacccgtagtaacgtacggtagtaaggttaactacgtaccggacccgtccgacgaaccggaccgtaccggtacgtttacgttaacttacggtagtcggtacggaaggtaacggtaccggttaccgttttaaaggttaaccggacccgttaagtaaccgtttaaacgttaaaaccttcccgttaaacgtaccgggttacgttaccggtacggtacggtaccggggaaccggtaacggggaaccctaccggg

SEQ ID NO: 246659 - DNA, 539 bp, Homo sapiens
  misc_feature: GYAE6OF01BA36C.9.70.G04.1.454.CMB.1.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttccacttggacctggatccggnagtcccgccggcaaggggctgggatatagttggacgaatctatgccagtggaccgcatccacaaccccgtcctacaagcgtcgagtcagcatgtcagtcgacaccgccagaaccagtcctcctagacagtgagttatactgccgccgcagacacggtcgtgtattctgtgacgagagacggtcgttacgtttaggactacgtcgtacgttaaaactccgtaactacgtactcggtacgtacgtagggccgagggaccgtaacggg

SEQ ID NO: 246660 - DNA, 583 bp, Homo sapiens
  misc_feature: GYAE6OF01BLNLW.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctacgtggacctggactccggcacgtccgccggcgaaggggctgggagtatagttggacgaatctatcgccgaggtcgggacccgccatcctaaccaaccccgtccctacgaagacgtcgagtcagcatgtcagtcgacacgtcccagaaccagttcctccctagacagtgtagttatatcgaccgccgacacgacgaccggtcgtgtacttacgtgtgcgagagacggtacgtttagtttacggacctagtactaacgttaaaactccgttaacgtacggtcgtacgggtacgtcggtaggggccgaacggggtaaccgtaaccggg

SEQ ID NO: 246661 - DNA, 922 bp, Homo sapiens
  misc_feature: GYAE6OF01CKXAO.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatagaaaacatctggttggttcactcctcctcctgggtggcagctacccagagtcgggtcctgtcccgagggtgcggctgacgagggacggtccgggaccgaggactaggtaggaacgtcccttacaacgacggtccccttcggttcccctctaccgtgacctacgttcgtccgttccgttagggtctacctcctaagtcggagggtacggggttcgttaccgtttaccctacggtacgggtaccttacgggtaccgtcccgggactaccggtcccggaccgggacggaaacggggtcgtagggtaagttaagttacggtacgggaaactattaccgttagccggacgtaggggtccggtacccaccgtactaccgtaaccctaaccccgtaccaaggtaacggacgtaccggtaacgtacgacgtactagttacgaccggtaacgtacccgaaccgtacccgtacccctaaacgtaaccgttaccgtttcccacccgtaagaccgtaggttaacgtagtttaagtaccggtacccgaaccgtcccgaacgaaccggtaccggtaacccgggtcgttttaaacggttacgttaccggttcgggtacggtaaccggtacggggttaaacggtccgggttttaaacccggttttaaaggttaacccggaaacccgttaaggttaaaccccgttttaaaaacggtttaaacccgttacccggtttaaaccgggttaccggggttaccggttaaaccgggggtaccgggtttccgggggtaccgggggtaaaccccggggtaaaacggggtaccccgttaaaccgggg

SEQ ID NO: 246662 - DNA, 1065 bp, Homo sapiens
  misc_feature: GYAE6OF01CNI2G.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgccttcacacggccctcgtccctcacctgcactgtctctggtcgacctccatcgaggtagggtcggttccgttcctacgtcggaccttggactccgggcacggtcccggccggacgaaacggggtactagggtaacgttaattaggttacgggaaccgtaaacttcgttaacgtcggacccgtaacggggttaccggggaaccccctacccgtaactttaccccgtaaaccccgtaaacccccccggttccccgttaacgaaaaccgggtaaccggttaccgggtaaacggttacccgaacggtaaaccctaaacggtttcggttaaccccggtaacggttccccggaaacccgttaaccccggggtaaccccccgtaaaaccgggtaaaaccccctttaccgggttttacccccttacccccggttaacgggaacccgttaaggggtttacggttaaaccggtttttaacgtaaacccggtttacccggggaaaccccccgggtacccggaacccggtaaacgggtaacccccgggttacccgggggtttacccggttttaaccgttttaaccgtttaacccggggtttcggggtacggaaccccggggttaaagggtaaccggggttaaccggggttttaaccccggttttttaaaacggggttttaaccgggaaaccccgttacgggttaaaaccccgttttaaaaacccgggtttttaaaaaaacccccttccccgggttttaaaacccgggtttaacccggttaccggggtttaacccggggttaaacccccggggttcggggggtttaacccggggggggaacccccggttaaaaggggggggtaaccccccgttaaaacccgggg

SEQ ID NO: 246663 - DNA, 881 bp, Homo sapiens
  misc_feature: GYAE6OF01ADW7H.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtggcagctccagagtgggtcctcgtccaggtgcggctgcgaggacgtccgggcccaggactagtgaacgtccttcacgacggccctcgtccctccacctcgccactcgtctcgtggtcgtacctccatcgaggtggttcggttccttacctacgtcggtaccgtggacgtcccggcgtaccggtccggaccggacggaacgggtacgtagggtaacgttagttagtacggaactaattctacgtcgacgtacgggtaccggaccgacctactacccgtaacccgtaaccccgttcctaacgtaacggtacggttaccggacgtacgacgtacgtacgtcgtaccgtaccggtaccggtaaccgtaacccggttacccgaagtaaaccctttccggttccccctacccggtaaggtaacgttaacgggttacgttaaacgttacgtaacccggcccggaaccccggtcccggaactaaacccggtacccggtcccgggttacgttttaacgttaaacggtttcccggtagggtaccggaacggttaacgggttaaccgggttaccgggttttaaacccgtttttaacggtaccgggaaacccttagttaaaacccgtttttaaaacccggttaaaacccgtttcccgggttaaacccggttacccgggggttttcgtaaccccgggggttaaccgggttcccggggaacccggggggaaccccggttaaagggggtaaacccctttaccccgggg

SEQ ID NO: 246664 - DNA, 553 bp, Homo sapiens
  misc_feature: GYAE6OF01D03G1.9.70.G04.1.454.CMB.1.raw
  modified_base (386)..(386): a, c, t, g, unknown or other
  misc_feature (386)..(386): n is a, c, g, or t
  modified_base (534)..(534): a, c, t, g, unknown or other
  misc_feature (534)..(534): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtccgttcctactggacctggatccggcagtccgccggcaagggctgggagtatagttggacgaatctatcgccaggtcgggaccgccatcctaccaaccccgtcctacaagagtcgagtcagcatgtcagtcgacnccgtccacgaaccagttcctcctgacagtgagttatactacgaccgccgcacgacgacggcgtgtacttacgtgtgcgagagacggtcgtttatttacggacctagtacgttacgttaaactcctacgtacggtctacggtacgtcgngggccgagggacgtaacgg

SEQ ID NO: 246665 - DNA, 613 bp, Homo sapiens
  misc_feature: GYAE6OF01A6K16.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggcacgtccgccggcaagggctggatactagttcggactaatctatcgacctaggtcgggacccgccatcctaaccgaaccccgttcctacgaaacggtcgtcgagtcagcctatgtcaggtccaactccgtacccaagaaccctagtttcctccctagacgtaggtgtaagtttatacgtcgacccgaccgtacacggaccgacgggtccgttagtacgttacgtgtacgcggtagaggtacggtaccgtttagtttacggacctagtacgttaacgttaaaacctccgtaacgtacggtcgtacggtaccgtcgtcggggccgaggggtcccgtaacgg

SEQ ID NO: 246666 - DNA, 620 bp, Homo sapiens
  misc_feature: GYAE6OF01C0UGX.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggttccgttcctactggacctggactccggcacgtcccggccggcgaagggctggacgttatagtttggaacgaattctatcgaccgaggtcgggacccgacctagtcctaaccaacccgtccctacaaagacgtcgagtcagcctagtcgtcaggtccgaaccaccgtacccgaacgaacctacgtttccctccctagacagttagagtttatatcgacccgccgacacgacaccgggtcgtagttacttacgtgtgccgagacggtacggtaccgtttagtttacgacgtagccgttaaacgttaaaccttcctaacgttacggttacctgggtaccgttccggtaggggacccgaggggtacccaacggg

SEQ ID NO: 246667 - DNA, 716 bp, Homo sapiens
  misc_feature: GYAE6OF01E2SZJ.9.70.G04.1.454.CMB.1.raw
  modified_base (369)..(369): a, c, t, g, unknown or other
  misc_feature (369)..(369): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgccactgtctctggtcgacctccatcgaggtaggttcggttccttcctacgtcggaccctggactcccggcacggtcccggccggacgaaggggctgggaagttattagttcgggaacgtaatctaagtcgccgtaagggtcgggacccncctaactcctaaccctaaccccgtccctaagaaacggtacgtcggaagtcgacgctagtcgtacgacgttaccgacctacccgtacccaacgtaaccctacgtttccctcccgtagaaccgtaggtacgtaagtttactacgtacggacccgccgacgaacggacccgaccggtccgttagttaacttacgtggtacgacggtaaggtacggtacgggttaccgtttaagtttacggaccgtaagtaccgtttaaacgttaaaacccttccgttaaccgttaaccgggttcgttacgggtaccggttcgggaccggggacccgtaaaccgggggtacctaacccggg

SEQ ID NO: 246668 - DNA, 671 bp, Homo sapiens
  misc_feature: GYAE6OF01EBYJZ.9.70.G04.1.454.CMB.1.raw
  modified_base (344)..(344): a, c, t, g, unknown or other
  misc_feature (344)..(344): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtcgacctcatcaggtaggtggtccgttcctacgtggacctggacgtccggcacgtccgaccggcgaagggactggagtattagtggacgaatctatcgcctaggcgggaccnctactcctaaccaacccgtcctacgaaggtcgtacgagtaccagctagtcgtcgacgtccgacctaccggtacccgaacgtaaccctacgttccctacccgtgaccgtagtacgtagttaactacgccgacccgcccgacaacgacccggacggtccgtaagtttacgttacgttggttacggacgggtaaggacgggttaccggttaccggtttaagttacggaccgtaacgtacgttaaaccgttaaaacccttccgtaaaccggtacggttcgtacgggtaccggtcgggtaccggggacgtaacgggggtaccctaaccgggg

SEQ ID NO: 246669 - DNA, 565 bp, Homo sapiens
  misc_feature: GYAE6OF01CC702.9.70.G04.1.454.CMB.1.raw
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (411)..(411): a, c, t, g, unknown or other
  misc_feature (411)..(411): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtccgccggcaagggctggagtatagttggacgaatctatgcaggtggaccncatcaccaacccgtccnaagagtcgagtcagcatgtcagtcgactacgtcccagacctagttcctcctgacagtgtagttanatcgaccgcgacacgacgacggcgtagtacttacgtgtagcgaagagtacggttaccgtttaagtttacggacctagtaccttaacgttaaaacctcctacgttaccgtacgtcggtaccgtacggtggggacccgaaggggtaccgtaaacgg

SEQ ID NO: 246670 - DNA, 780 bp, Homo sapiens
  misc_feature: GYAE6OF01EWYZT.9.70.G04.1.454.CMB.1.raw
  modified_base (607)..(607): a, c, t, g, unknown or other
  misc_feature (607)..(607): n is a, c, g, or t
  modified_base (700)..(700): a, c, t, g, unknown or other
  misc_feature (700)..(700): n is a, c, g, or t
tcagtgatacgtctcacgaccggtgctcgatttagtgtagtgtgaagggaaagggcctggtgaaggcttcactagtcctggacctcctgtgcaagaacatgaaacatctgtggttcactcctcctcctggtggcagcctcccagatcgggtcctgtcccaggtgcggctgcaggacgtcgggcccaggactagtgaagtccttcacgacggccctgtccctcacctgcactgtctcgtggtcacctccatcaggtaggttcggttcttacctacgtcggacctggacttccggactacggtcccggccggacgaacggggtacctagggaacgttaacttacgttacgggaaccgtaattcgttaacgtcggtacccgtaggggttccggggaacccctaccgtaacttacccgtaacccgaaacccccgttcctaacgaaaggtcgtacggacgtaccgagctagtcgtacacggtccgaacctaccggttccccgaaagtaacccttcgttcccaccgtagaacgtagttacggtaacttacgtacggtaccgacccgtacgacgaaccggaccggtaccggttacgtttaagttacgttaccgnggtaccggtacggtaagtaccggttaccggttttaccggtttaaaggttacccgaaccgtaacgtttaaccgtttaaaaaccgtttaaacccncccggtttaaacggtaccggttacggtaaccgggtacggttaccggggaccggggaaccggtaaacgggtaccctaccgg

SEQ ID NO: 246671 - DNA, 920 bp, Homo sapiens
  misc_feature: GYAE6OF01DWICV.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcgaggagtccgggcccaggactaggtgaacgccttcacacggccctcgtcccctcacctcgcactgtcctcgtggtgacctccagtcgaggtaggttcggtccgttaccgttacgtcggacccgtggacgtcccggactacggtccccggccggacgaaacggggacttagggtaacgtaagttagtttacgggaaactaagttccgttaatcggacccgtagggtaccgggacccgacccgtaacttacccgtaaaccccgtaaacccccggttccccgttaaacgaaacgggtacgtttaccggaacgtttaccgaaacgtccgttaaacggttccggttaacctaaccgggttacccggaaacccttaaccccggtacccccgaaaaccggttaaaccccgttaccgtttaccccgttccccgtaaacggtaacccgttaaggttacggttaaacgttttaacgtaaccgttacccgggaacccccggtacccggacgtaaaccgggtaacccgtaacccgggtaccgtttacggtttaaactttacgtacggggttcgaaccggttaagggacgggttaaccgggtttaccgttttaacggtttaaccggaacccgttaagtaaccggttttaaacgtttaaaaccccgttacccgttaaccgggtttaacccggttaccgggttacccggttaccgggttacccggtaccgggggtaaccccggtaaaggggtaacccgttaaaccggg

SEQ ID NO: 246672 - DNA, 727 bp, Homo sapiens
  misc_feature: GYAE6OF01DBDMQ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatccctcctcctggtggcagctcccagatgggtcctgtcccaggtgcggctgcaggagtccgggcccaggactagtgaacgccttcacacggccctgtccctcacctgcactgtctcgtggtgacctccatcgaggtagggttcggttccgtttcctaacgtggacccttggacgttcccggacacggtcccgccggacgaaggggtcctgggaacttatacgttggaacgtaatcctagtcgaccgagggtacgggaccccacaacgtcctaaccccgaaccccgttccctacgaaacggtcggttccgaagttccaaggtcctaagttcgacgtacgttacccgaacccgtaccgtaccccaacggaaccctacgtttccctaccccgtagaccgtaggttacgtacgtttactacgtccggacccgtcgaccgaacggtacccgaccgggtcggttagtttaactttacgtaggtcgacggaggtaggtaccggttacgttttaagtttacgggaacctagtaccgttaaaacgttaaacccttccgttaacggttcggttcgtacggtaccggtacgggtccgggaccggaaggggtaccctaacggg

SEQ ID NO: 246673 - DNA, 762 bp, Homo sapiens
  misc_feature: GYAE6OF01C2OCB.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatccctcctcctggtggcagctcccagatgggtcctgtcccaggtgcggctgcaggagtcgggcccaggactagtgaagccttcacaggccctgtccctcacctgcactgtctctggtcgactccatcaggtaggtcggttcgttcctaacgtcggacctgggactcccgggactaggtccccggaccggacgaaggggtactaggggtaattaagtacgttcgggaaaccgtaaattccgttaagtcggacccgtaagggttacggggaccccacctaacgttaccctaaaacccgaaacccccggttccctaaccgtaaaaaggtccggttccggtaaaggttcccaaggtaccctaagtttcggtacccgtaaagggttacccgaaaccgtacccgtacccgtaaaccgtaacccgtacgtttaccctacccgtacgtaaccgtaagttaggtacgttaactacgttacggacccgccgacgtaacgaccgtacggccgttagtacttacgtgtcgacgtagtacgtacggtaccgtttaagtttaacgaccgtagtacgttaaacgttaaaaccttccgtaaccgttacgggttaccgtacggtaccgttacggtagggaccgaggggtaaccgtaaccggg

SEQ ID NO: 246674 - DNA, 575 bp, Homo sapiens
  misc_feature: GYAE6OF01CETG7.9.70.G04.1.454.CMB.1.raw
  modified_base (233)..(233): a, c, t, g, unknown or other
  misc_feature (233)..(233): n is a, c, g, or t
  modified_base (332)..(332): a, c, t, g, unknown or other
  misc_feature (332)..(332): n is a, c, g, or t
  modified_base (356)..(356): a, c, t, g, unknown or other
  misc_feature (356)..(356): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcatgtcccaggtgcggctgcaggagtcgggcccaggactagtgaagccttcacaggccctgtccctcacctgcactgtctctggtnactccatcagaggttggtcgttcctactggacctggatccggcagtccgccggcaaggggctggagtatagttggacgaatctatgccagtcgggaccncatctacaaccccgtcctacaagngtcgatcagcatgtcagtccgacaccgtacccagaacctagttcctcccctagaccaggtagtagttatatcggacccgccgacaacgaccgaccggccgttgtacgtttacgtgtcggacgaggagtacggtccgtttagtttacggaccgacgtcttaagttaaaacctcctaacgtacgggtcgtcggtaccgtcggcgggccgtacggggaaccg

SEQ ID NO: 246675 - DNA, 633 bp, Homo sapiens
  misc_feature: GYAE6OF01BS7VE.9.70.G04.1.454.CMB.1.raw
  modified_base (329)..(329): a, c, t, g, unknown or other
  misc_feature (329)..(329): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctacgtggacctggactccggcagtccgccggcaagggctggagtatagttggacgaatctatgccagtggaccncatctacaacccgtcctacgaagcgtcgagtcagcatcgtacacgtcgaactaccgtacccaacggtaaaccctacggtttccctaccccgtagaaccgtaggttacgtaacgtttaatacgttaccggacccgtcccggacaacggtaacccgacgggtccgtagttaacttacgtgtaggtacgaaggtagtacggtaccgtttaacgtttacggaccagtacgttaaacgttaaaaccttccgttaacgtacggtacgtcgggtaaccgtcggtacggggccgtaacggggacctaacggg

SEQ ID NO: 246676 - DNA, 634 bp, Homo sapiens
  misc_feature: GYAE6OF01DR8DK.9.70.G04.1.454.CMB.1.raw
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctccatcagtaggtggttcgttcctacgtggacctggactccggcacggtccgccggacaaggggacctgggaacgttatacgttggaacgtaatctatcgcctaggtcgggacccncgatcctaaccaacccgtccctcgaaagcgtacgagtcagcatgtacagtacgactaccgtacccagaaccctagttcctcccgtagacagtagacgttatagtacgacccgccacgacgaccgacggtcgtagtacttacgtgtcgcgaagtacggtacggtacggttttagtttacggaccgtagtaccgttaacgtttaaaaccttccgtaaacgttacggttaccgtacgggtaccggttacggtaccggggtaccggacggggtacctaaacccggg

SEQ ID NO: 246677 - DNA, 613 bp, Homo sapiens
  misc_feature: GYAE6OF01BQT8H.9.70.G04.1.454.CMB.1.raw
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgctactttctctggtgacctccatcagaggtggtcttcctactggacctggactcccgggcacgtcccggccggacgaaaggggacctgggagtattagttggaacgaatctatgccaggtcgggaccnccatcctaccaacccgtcctacgaaagngtcgagtcagcatgtcagtcgacacgtacccagaacctagttcctcctagacgtagtgtaagttactacgtacgacccgccgacgacgacccgtacggtaccgttagttacttacgtggtacgacggtaggacgtacggtacgtttaagtttacggacctagtacttaacggttaaaaccttccgtaacgtaccggtcgtaggacgtcggtcgggaccgacgggaccgtaggtacccg

SEQ ID NO: 246678 - DNA, 748 bp, Homo sapiens
  misc_feature: GYAE6OF01BQJBX.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgccttcacgacggccctgtccctcacctgctactgtcctcgtggtcgactccatcaggtaggtcgtccgttcctacgtcggacctggacgtccggactacggtcccggccggacgaaacgggcgtaggacgttagtagttacggaacgtaatccgtagtcgtaccgtaggtacgggaccctacctaacttccgtaaacccgtaaccccgtccctaacgaaacggcgttacgaacgtaccagtacctaagttcgaccgtacgtaccgaactacccggtacccaacgtaaacccgtcctttacctacccgtagtaacgtacggttagtaagttactacgtacgacccgtacgacgaacgtaccggaaccggtcgttaacgttataccggtagtaccggacggaaacggtacggtacggttaccgtttaaggttaaccggaccttaacggttaaccgttaaacgtttaaaacccgtccgttaacggtaccggttaccggtacggttacccgggttacgggtaccggggaaccgttaaacgggggtacccctaaacggg

SEQ ID NO: 246679 - DNA, 756 bp, Homo sapiens
  misc_feature: GYAE6OF01BYO44.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatcgggtcctcgtcccagttgcggctgcgaggagtccgggcccaggactaggtgaacgtccttcacacggccctcgtccctcacctgctactcgtctcgtggtcactccatcgagtaggtggtccttcctacgtggacctggacgtccggcgacggtccggccggacgaaggggactagggaagttacgttagttacggaactaactcgtatcgacgacgggtcggaccgacctactacctaacccgaacccgtccacgaacgacgtacgagtctacgctagtcgtacgacgtacgaccaccgtccctaacgaacctcgttccctcgtacgacgtagtacgtacgttacacgtacggacccgtaccgagaaccggtaaccggtacccggtacgtttacggttaacctttaccggtcgggtaggaccggaaggtaacgggttacccggtttaaccggttttaaaggtttaaccggaccgttaagtaaacccggtttaaaacgtttaaaaccctcccggtttaaaccgtacccggggtttacggttaccggggtaacccgggtttccggggaaacgggggtaccccgggtaaaggggggtaaccccgttaaaccgggg

SEQ ID NO: 246680 - DNA, 673 bp, Homo sapiens
  misc_feature: GYAE6OF01EMALB.9.70.G04.1.454.CMB.1.raw
  modified_base (267)..(267): a, c, t, g, unknown or other
  misc_feature (267)..(267): n is a, c, g, or t
  modified_base (283)..(283): a, c, t, g, unknown or other
  misc_feature (283)..(283): n is a, c, g, or t
  modified_base (374)..(374): a, c, t, g, unknown or other
  misc_feature (374)..(374): n is a, c, g, or t
tcagtgatacgtctcacgaccggtgctcgatttagtgtagtgtgaagggaaaggcctgtgaagcttcactagtcctggacctcctgtgcaagaacatgaaacatctgtggttcatcctcctcctggtggcagctcccagatgggtcctgtcccagttgcggctgcaggagtccgggccaggactagtgaacgccttcacgacggtccctgtccctacacctgccactgtcctcgtaggtcgactccatcgagaggtggtcttcctancggacctgactccggnacgtccgcggagaagggctggatatagtgacgtaatctagtcgccaggttcgggacccgtacagttaccctaacctaacccccggtcctanaaacggtcgtccgtaacgtcaaagctaagtcgtacgagtaccgaactacccgtacccaacgtaacctcgttacctcccgttacgaacctaggtacgtacgtttaatcgacggtacccgacgccgaacggtaccgaccggtacccgttagttaacttaccgtggtacgaacggagtaacggtacgggttacctttaaggtttaccggacctaacgtacgtttaaacgttaaacccttcgtaaacgttcggcgttacgggtaccgtacggtaccggggacgtaaaccgggacgtaaaccgg

SEQ ID NO: 246681 - DNA, 597 bp, Homo sapiens
  misc_feature: GYAE6OF01EPAHO.9.70.G04.1.454.CMB.1.raw
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcaggaggtcggtcttcctagtcggacctggactcccggacacgtccggccggacaaaggggctgggagtatagtggacgtaatcatcgcaggtggaccncatccacaacccgtcctanaagcgtcgagtcagcatgcagtcgacaccgtccacgaacctgttctccctgactagtgtagttatacgtcgaccgcgcacgacaccgggtctagttacttacgtggtacgacgtagacggtacggtaccgtttaagttaccggacctaaggttaccgttaaacgttaaaacccttccgtaacgttacggtacgtacgggttacgtccgggtaggggacccgaaggggtacctaaccggg

SEQ ID NO: 246682 - DNA, 916 bp, Homo sapiens
  misc_feature: GYAE6OF01BL16K.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctcccagagtgggtcctgtcccgaggtgcggctgcgaggacggtccgggacccgaggactaggtagaacgtccttcacgacggtccctcgtcccctcaccgtgcctacgtcgttccgttcgtggtacgaccttcctagtacgagggtagggttcggttccgtttaccctacggtcggtaccgttaggaccgtcccggaccgaccggttccccggaccgggtaaccggtaaacgggggtcgtaggggtaacgttacgttaaggttcgggaaacgttaatccgttacggtcggtaccggtagggttacccggggaaccctccttaaaccgttccgtaaaacccccgtaaccccggtttacccctaaacggtaaccggttacgtaccggtaacggtaccgtacggtacctaaggttcggtaacccgtaacggtacccggaaccgtacccggtaaccccgaaccggttaaccgtacccggtttaccccgttacccggttacgtaaccggtacggttaacggtttaacgttaacggttaccggttaccccggacccggtacccggtaccggtaacccgtaccggtaaccgggttacccgttaagtttaccggttacggttacggtaaccggacgggtaacggtaccggttaccggtttacggtttaacggttaaccggtaacccgtaacggttaaccgttaacgttaaaacccgttaccgttacgggttaccggtacgtaccgggtcggtaccgggtacggggaccggtaccgggtacgtaacccggg

SEQ ID NO: 246683 - DNA, 767 bp, Homo sapiens
  misc_feature: GYAE6OF01ALGID.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggacgtcgggcccaggactagtgaagccttcacacggccctgtccctcacctgcactgtctctggtcgacctccatcgaggtagggttcggtccgttacctacgtcggacctggacgtcccggactacggtcccgccggacgaacgggtactgggtaagttagtacggttacggaacgtaatcgtaagtcgaccgtaggtccgggaaccccgctactacccgtaaccctaaaccccgttcccgaacgtaaggtaccggttaccggacgtaccgacgacgtaagtcgtaccgtacgggttaccgaaccgtacccgtaccccgaacgtaacccgtaccgttccctacccgtagaaccgtaggtacgtaacgttactacgttaccggacccgacccgtagaaccggaacccgacccgggttccggttaacgtaaaccgtttacgtacgggtacggtacgaacggtacggtaccgtttaccggtttaacgtttacggaccgtaacggttaaccgttaacgttaaacccgtaccgttaccgtaaccgggttccgttagggaccggttcgggaacggggcccgtaaaggggaaccggtaacccgg

SEQ ID NO: 246684 - DNA, 761 bp, Homo sapiens
  misc_feature: GYAE6OF01D588F.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcgaggaggtccgggcccaggactaggtgaagtccttcacgacggcccttcgtccctcacctgcactgtctctggtcactccatcgaggtaggttcggttcgttcctacgtcggaccgtggacgtccggacacgtccggcggacgaagggtctaggatagtagttaggaacgtaatctagtcggaccgtaacgggtccgggacccctacctaacttaccctaaaccccgtaacccccgtcccgtaacgaaaacggttaccgtacggtaacgtacgaacgtactaaacgttcgtaaccgtaacgttacccgaaccgtaacccggttacccgaaaccgtaaacccgttacgtttaccccttacccgtagaaccgtaggttagtaacgtttaagtacgtacccggacccgcccgaacgaaccggaccgtaccggttacgttaagttaaccttacggtcggtacggaacggtagtaacggtacggttacgtttaagttaccggaacctacgttaaccgttaaacgtttaaaacctcgttaacggtacggttacgtacggtacggttcggaccggggaacggtaacgggaacgtaaccgg

SEQ ID NO: 246685 - DNA, 883 bp, Homo sapiens
  misc_feature: GYAE6OF01ATP0Y.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagcctcccagagtcgggtcctgtcccgaggtgcggctgcgagggacggtccgggcccaggactaggtgaacgtccttcacgacggccctcgtcccctcacctgcctacgtcgtcttcgtcggtctacctccacgtcgaggtggttcggttccgttacctaacgtcggtaccgtggacgtccggaccgtacggtcccggccggaacggaacggggtaccgtggggtaagtttaacgttaagttacgggaaaccgtaattccgtaacgtccgaccggtaacgggtaccggggaaccccctacctaaaccgtttacccctaaaccccgttaaccccccgttcccgtaacgaaaccgggttaccggttacgaacggttcgaacgtaccgtacggttacggttaccgaccgggttaacccgaacccgtaccccggtaacccgaaacgttaacccgtttaccggttccccttaccgtaacggaacgttaacggtacggttacttaacgtaccggtacccggaccccgcgaccgaacggtacccggtaccgggtacgtttagtttacggttaccgttgggaacggacggttaaggtacccgggtacggtttacttttaacggttaaccggacccgtaaggtttaaccttaaaaacccgtaaccgggttttaccctaacggggtttcccggtacggttacggggtaccggttaccggggtaaccggggacccggttaacggggaacccgttaaccggg

SEQ ID NO: 246686 - DNA, 684 bp, Homo sapiens
  misc_feature: GYAE6OF01BV2LQ.9.70.G04.1.454.CMB.1.raw
  modified_base (233)..(233): a, c, t, g, unknown or other
  misc_feature (233)..(233): n is a, c, g, or t
  modified_base (345)..(345): a, c, t, g, unknown or other
  misc_feature (345)..(345): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtccttcctactggacctggactccggcacgtccgccggacaaggggcctggagttatagttcggaacgtaatcctagtcgccgaggttcgggaccnccaacttcctaaccaaccccgttccctagaacgacgtcgagtcaagctatcgtcgaagtccgaaccgtaccgtacccgacgtaacccgtacgtttccctacccgtagaaccgtacggttacgtagtttaagtacgttacggacccgtaccgaccgacgaaccgaccgggtccgttagttaactttacggtgtacgacggaggaacggtacgggttaccgtttaagttttaacggaccgtaacgtaccgttaaacgttaaaacccttccgttaacgtaaccggttcgtacgggtaccggttacggtacggggtaccgtacgggggtaacccgtaaccggg

SEQ ID NO: 246687 - DNA, 788 bp, Homo sapiens
  misc_feature: GYAE6OF01DT015.9.70.G04.1.454.CMB.1.raw
  modified_base (232)..(232): a, c, t, g, unknown or other
  misc_feature (232)..(232): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacaggccctgtccctcacctgcactgtctctggtnacctccatcgaggtacggttcggtccttccgtaacgtcggaccttgggacttcccgggactacggtccccggccggagaaacgggggtctgggaattatagttcgggaactaattctaagtcggacctagggtccgggaccctccaagttcctaaccgaaccccggttccctaagaaacggtcgttaccgaacgtcgaacggtacctaagttcggtacaaacggttcccgaaacccgtaccgtacccgaacgtaaacccgtacgtttaccctaccccgttagaaccgtaggtacgttaacgttaagtacgtaccggtacccgaccgacgtaacggtaaccgtaccgggtccgtaacgtttaacgttaccgtaggtacggaccggtaaggtaacgggtacgggttacccgttttaaggtttaaccggaacccgtaaggttaccgtttaaaacgtttaaaaacccttccggttaaaccgttacccgggtacgttaccggggtaacccggttcggggtaaccggggacccggtaacggggtaaaccccggttaaacggg

SEQ ID NO: 246688 - DNA, 824 bp, Homo sapiens
  misc_feature: GYAE6OF01BYPZL.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctagcaggagtcgggcccaggactagtgaacgccttcacaggccctgtccctcacctgctactgtctcgtggtcacctcatcgagtaggtgtcttcctactggacctggactccggcacggtcccgccggtacaaggggtcctagggagttatacgttcgggaactaattcgtagtcggaccgtagggttccggggacccctacctaacgttacccgtaaacccgtaaacccccggtttcccgtaacgaaaacgggtccggttaccgaacgttaccgaacggtccttaaacgttccggtaccgtaacggtacccggtaaacccgtacccggtttaccccgaaacgtaaaccccgttaccgtttaccccgttaccccgtaacggtaaccgtaaggttacggttaaacgtttacgttaacgtaccggtaccccggtacccggaacgtaaccggtaaccgtaccgggtacgttacggttaacttaccgtacggtacggacggtaaggtaacgggtaccggttacgttttaacggtttaaccggaaccgtaacggttaaccgttaaacgtttaaaaacccgttccgttaaacggttaccggttacgtaaccgggttaccggtacgggtaccgggaccggtaacggggtaacccgttaaacccggg

SEQ ID NO: 246689 - DNA, 766 bp, Homo sapiens
  misc_feature: GYAE6OF01BFEBS.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctcccagatgggtcctgtcccaggtgcggctgcaggagtcggcccaggactagtgaagccttcacacggcccttgtccctcacctgcacctgtcctcgtggtcgacctccatcgaggtaggttggttccgttcctacgtcgggtacctggactcccgggcacggtcccggccggacgaaacggggctggaagttattagttacggaacgtaatcgttaagtcgacccgagggttacgggacccgcctaactacctaacccgaaaccccgttcccacgaaacggtacgtaccgaacgttccaggtactaagttcggtaccaaggttccgaaacctacccgtacccgaacgtaaacccgtacgtttaccctacccttaggaaccgtaaggttacgtaacgtttaacgttacgttacggacccgaccgtacgaacggtacccgaccgggtccgttacggtttaacttacgtggtcgacggtaaggtacgtacgggttaccgttttaacgtttaccggaaaccgtacgttaaccgttaaacgttaaaaaccttacccgttaaccgttaacggttaccggttacgggtaccggttacgggtaccggggaccggtaacggggtaaacccggtaaccggg

SEQ ID NO: 246690 - DNA, 628 bp, Homo sapiens
  misc_feature: GYAE6OF01CE0WM.9.70.G04.1.454.CMB.1.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (328)..(328): a, c, t, g, unknown or other
  misc_feature (328)..(328): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctcccagatgggtcctgtcccaggtgcggctgcaggagtccgggcccaggactagtgaagccttcacacggccctgtccctcacctgcactgtctctggtnactcatcagnggtgtctcactggactggactccggnacgtccgccgganaagggctggatatagtggaactatctatcgcctaggtcgggaccncatcctaaccaacccgttccagaaagtcgtcgaagtccgaagctaatcgtacgacggttaccacctacccgtacccaacgaacctacgtttcctacccgtagaacctagtagtagttactacgtacgacccgaccgacgaacggtacgacccgggacgttacgttaacttacgtggtacgccggaagtacggtacgtaccggtttaatttacggaacctagtaccttaacgttaaaactccttaacgtaccgttacgtacgggtaccgtcggtacggggcctaacggggacctaaccggg

SEQ ID NO: 246691 - DNA, 687 bp, Homo sapiens
  misc_feature: GYAE6OF01EE2TI.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctcatcaggaggttcggttccttcctacgtcggacctggactccggcacggtccggccggtacgaagggtactggagttagttagttaggaacgtaatctagtcgaccgtaagggtcgggacccgacctactaccctaaccgtaaccccgtccctaacgaagtacgtcggaacgtacgagactagtcgtacgagtccggaacctacccgtacccaacgtaaccctacgtttccctacccgtacgtaacgtaggtagtaagtttactagtacccggaccgtacccgacgaacggaccgtaccgggtccgttagttaacttacgtcggtaggacgtaggtaacggtaccgggttacgtttaacgtttacggaccgttaagtacgttaaacgttaaacctccgttacgtaccggtcgtacggtcgtacggacgggacgtagggacccgtaaacgg

SEQ ID NO: 246692 - DNA, 652 bp, Homo sapiens
  misc_feature: GYAE6OF01DWQIQ.9.70.G04.1.454.CMB.1.raw
  modified_base (359)..(359): a, c, t, g, unknown or other
  misc_feature (359)..(359): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcaggagtcgggcccaggactaagtgaacgccttcaacaggtccctgtcccctcacctgcctacctgtctcgtggtcactccatcacgaggtggtcttccacgtcggacctggactccggctacggtcccgccggacgaagggtactggagttatagttggaactaattctagtcgactaggtacgggacccncctatacctaacctaaccccggtccagaagtacgtcgaggtcaaggtcagtcgtacacgtaccgaactaccgtacccaacgaaccctacgttcctacccgtagaacgtacgtagttagttactagttaccgaccgtccgaccacgtacaccggtcgtagttacgttaacgtgtacgacgtagacggtacggtaccgtttaagtttacgtaccgtagtaccgttaacgttaaaacctccttaacgttaccggttcgtacggtacgttacggcgggaccggtacggacgtaacgg

SEQ ID NO: 246693 - DNA, 695 bp, Homo sapiens
  misc_feature: GYAE6OF01CUPPP.9.70.G04.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
tcagtgatacgtctcacgaccggtgctcgatttagtgtagtgtgaagggaaagggcctgtgaaggcttcacaggccctgtccctcacctgcactgtctctggtgactccatcagaggtggtcgttcctactggacctggatccggcagtccgccggcaaggggactggagtatattggacgaatctatgccaggtgggaccnccatcctaaccaaccccgtccctanaaaggagtcgagtcagcatgtcagtcgacncgtcccaagaaccagttctccctgacagtgagttatatgaccgccgcagacacggcgtgtatacgtgtgcgagagacggtcgtttagttttacggaccagtcttaacgttaaaaactcctaacgtacggtcgtacgggacgttcggcggggacacgggggaccaagggttccaaccgttcctaccctccgacgtccctacccaaccgaacgggcccctaagttcccgggttcccttccccccgtgggcccgtcccctggcccgttaccgacgggacgccaacccgtccggaacgtccgacacgaccggccggtaccccggtcggggtcctacggtcccgttacgggtacccgtaaacgggttacccttaaccgttacccgtaaacggtacccggtttaaactcccgtaaccgtcgggaacgggtccggggtaacccgg

SEQ ID NO: 246694 - DNA, 835 bp, Homo sapiens
  misc_feature: GYAE6OF01CYW1V.9.70.G04.1.454.CMB.1.raw
tcagtgatacgtctcacgaccggtgctcgatttagtgtagtgtgaagggaaagggcctgtgaaggcttcactagtcctggacctcctgtgctaagaacatgaaacatctgtggttcatcctcctcctggtggcagctcccagatgggtcctgtcccaggtgcggctgcaggagtcgggcccaggactagtgaagccttcacgacggccctgtcccctcaccgtgccactgtctctggtcgacctccatcgagtacggttcggtccgttcctacgtcggtacctggactccggactacggtcccggccgggacgaaacggggtacgtagggtacggttaagttacgtttacgggaacgtaaacgttccgttaacgtccggacccgtaagggtaccggggaaccccgtacctaacgttacccttaaacccgtaacccccgtttaccccgtaaacgtaaacgggtaacggttaccggaacgttaccgaacggtaccgtaagtttcgtacccgtaacggtacccggaacccgtacccggtaaccccaaacggtaaccctacgtttacccctacccgtagtaacctacgttacgtaagtttactaacgtaccgacccgccgacgtaacggacccgtaaccgggtccgttaacgttaacttacggttgtacggacgaagggtacggttacggttaccggtttaaggtttaccggaaccgttacggtaaccgtttaaaccggtttaaaaccctcccgttaaaccggttaccgggttaccggttacgggtaaccggttaccggggtacgggggaacccgtaacgggggaacccgttaaccggg

SEQ ID NO: 246695 - DNA, 580 bp, Homo sapiens
  misc_feature: GYAE6OF01BL3QA.9.70.G04.1.454.CMB.1.raw
  modified_base (330)..(330): a, c, t, g, unknown or other
  misc_feature (330)..(330): n is a, c, g, or t
  modified_base (359)..(359): a, c, t, g, unknown or other
  misc_feature (359)..(359): n is a, c, g, or t
  modified_base (401)..(401): a, c, t, g, unknown or other
  misc_feature (401)..(401): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcttcctactggacctggactccggcagtccgccgcaagggctggacgtatattggacgaatctagtgccagtcgggaccncatcctaacaaccccgtccctacgaacgngtacgagtccaagcatcgtcagtcgacacgtcccagaacccnttcctccctgaccagtgagttatatcgacccgccgcacgaccgacgggccgttagtaattacgtgtcgcgaaggaggtacggtacgtttaagtttacggaccgagtacgtaacgttaaaacctctaaccgtacgttcgtacgggtacgtcggtagggaccgtaggggaccgtaaccggg

SEQ ID NO: 246696 - DNA, 675 bp, Homo sapiens
  misc_feature: GYAE6OF01AXVXP.9.70.G04.1.454.CMB.1.raw
  modified_base (343)..(343): a, c, t, g, unknown or other
  misc_feature (343)..(343): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtgtgacctccatcagaggtggtcgttcctacgtggacctggactccggctacggtcccggccggacaagggcgtggagtatagttggacgaatctatcgccaggtcgggacccncatccgtaaccaaccccgtcctacaaggcgtcgacgtcagctatgtcacgtccgaacctaccgtacccacgtaaccctacgttcctccctagaacgtagtagtacgttaatacgtacggacccgccgacgaacgtaccgtaccggtaccgttcgttaacgttacgtggtacggtacggacggtaaggtaccggttaccgttttaacgttttaacgggacccgtaacgtacgtttaaacgtttaaaaccttcccgttaaaccggttacccggttcgttacgggttaccggttacgggtaccggggacccggtaacggggtaccgtaaaccggg

SEQ ID NO: 246697 - DNA, 590 bp, Homo sapiens
  misc_feature: GYAE6OF01CKXMV.9.70.G04.1.454.CMB.1.raw
  modified_base (104)..(104): a, c, t, g, unknown or other
  misc_feature (104)..(104): n is a, c, g, or t
  modified_base (197)..(197): a, c, t, g, unknown or other
  misc_feature (197)..(197): n is a, c, g, or t
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
tcagtgatacgtctcacgaccggtgctcgatttagtgtagtgtgaagggaaagggcctgtgaaggcttcacaggccctgtccctcacctgcactgtctctggtnactccatcagaggtggtcgttcctactggacctggatccggcagtccgccggcaagggactggatatattggacaatctatgccagtggaccncatctacaacccgtcctnaagagtcgagtcagcatgtcagtcgacncgtcccaagaacctgttctccctgacagtgagttatatcgaccgccgcagacacggccgtgtattacgtgtgcgagagacggtcgtttaagtttacggactagtcttaagttaaaaactcctaacgtacgtcgtggacgtcgtcggggaccgaaggggaccaaggtcaccgtcctccctcaccgtcctcccgaaccgtaaccgggaccctacgttccggtcccttcccccgtcggcccgccctcgcctccgacgcgaccaccctcgagcgcacgcgccgccgtcggctcgccgtaggtacgaagtacctcgttaccgaagtacgtacacagtacggacgcggggtcg

SEQ ID NO: 246698 - DNA, 769 bp, Homo sapiens
  misc_feature: GYAE6OF01BWK6X.9.70.G04.1.454.CMB.1.raw
  modified_base (245)..(245): a, c, t, g, unknown or other
  misc_feature (245)..(245): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagagtgggtcctgtcccgaggtgcggctgcgaggagtccgggcccaggactaggtgaacgtccttacacgacggccctcgtccctcacctgctactgtctcgtggtnacctccatcgaggtggttcgttccgttcctacgtggacctggacgtccggctacggtcccggaccggacgaaggggtacctgggtaagttagttacgttcggaaacgtaattccgttagtacggaccgtagggttaccggggacccctaccgtaacttacccgtaaacccgtaccccggttaccccgttaaagaaacgggtacgttaccggacgttaccgaaggtaccctaagtttcgttaccggaacggttcccgaaccgtaacccgttacccgaacggtaacccttacgttcccgtacccgtagtaaccgtaggtacgtaagtttaacacgttaccggaccgcgtacgaacgacgtaccggtacgtagttaacgttcgtgtcggacgtaacggtacggtacgttaccggttttaagttaccgggacttaacggttaacctttaaacggttaaaaccctcggtttacgtacggttcggtacggtaccggttcgggacgggacccgtaagggaacccgtaacgg

SEQ ID NO: 246699 - DNA, 840 bp, Homo sapiens
  misc_feature: GYAE6OF01C32K4.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaaacatctgtggttcattccctcctcctggtggcagctcccagatgggtcctgtcccaggtgcggctgcgaggacgtccgggcccaggactagtgaagtccttcacgacggtccctcgtccctacacctgacctacttcgtctcgtggtacactccaagtcgaggtacggttcggttccgttaccctaacgtcggaccgtacggtacgttcccggacgacggtccccggaccggacgtaacgggacgtaggattaactgttacggaacgaatcgtaagcgaccgaggtaccgggacccacctaacgtcctaaaccccgtaccccgttccctaacggaaaacgggcgttaaccggagtaccaaggtaccctagttccggtacacggtacccgaccgtaaccgtacccgaacgaaaccgttccgttaccctacccgtaacgtaacgtaggttacgtaaagtttaacgtacggttaccgaacccggacctaaccggaccggtaacccggtaccgggttaaccggttaacgtttaaccgtttaccggtggttaacgggaacggttaacgggacggttaaccgggtttaccgtttaaacgggtttaaccggaaccgttaaaccggttacgttaaaaaccgtttaaaacccttacccgttaaacggtttacccgggttacgttacgggtaccgggttaccgggtaagggggaccccggtaaacgggggtacccttaaaccgggg

SEQ ID NO: 246700 - DNA, 582 bp, Homo sapiens
  misc_feature: GYAE6OF01DIDP0.9.70.G04.1.454.CMB.1.raw
  modified_base (292)..(292): a, c, t, g, unknown or other
  misc_feature (292)..(292): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgactccatcagagggtggtcgttcctacgtcggacctggactccggcagtcccgccggngaagggctgggatatagttggaacgtaatctancgccaggtcgggaccncatcctacaccccgtcctacaagngtcgagtcagcagtcgtcagtccgactaccgtcccaacgaacctacgttcctccctagacgtagtagtagttatactcgaccgccgacacgacgacggtcgtagtattacgtgtcgacgtagagacggtcgtttagtttacggactagtactaaacttaaaacctccttacgtacggtcgtacggtacgtacggacgggcgacgggaccgtaacggg

SEQ ID NO: 246701 - DNA, 708 bp, Homo sapiens
  misc_feature: GYAE6OF01ACJCB.9.70.G04.1.454.CMB.1.raw
  modified_base (305)..(305): a, c, t, g, unknown or other
  misc_feature (305)..(305): n is a, c, g, or t
  modified_base (385)..(385): a, c, t, g, unknown or other
  misc_feature (385)..(385): n is a, c, g, or t
  modified_base (531)..(531): a, c, t, g, unknown or other
  misc_feature (531)..(531): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatccctcctcctggtggcagcctcccagatgggtcctgtcccaggtgcggctgcagggagtccgggcccaggactagtgaacgtccttcacacggccctcgtccctcacctgcctactgtctcgtaggtcgacctccatcaggacggttggtccgtttcccacgttcgggaccctgggtactcccgggntacgtccccggcggacgaaaggggcttgggattatagttacgggaacgtaatcgtatcggaccgaagggtcgggaccccntactccttaaccgaaccccctcctagaaacgtcgttcggactcaagctagttcgtaccgaggtcccaccgacccgtcccaaggaacccttcgttaccctcccgtagacctaggtcgtaagttactacgtaccggacccgcccgtanaccggtaaccgaccgggtccgttagttaacttacggtgtacggacgtaggtacggaccggttacgttttacttacgggaccctaagttaccgttaaacgttaaaaccctccgttaacgttaccggtcgttacgggtaccggttcggaccggggtacgaccgggggtacctaaccggg

SEQ ID NO: 246702 - DNA, 636 bp, Homo sapiens
  misc_feature: GYAE6OF01AX3I6.9.70.G04.1.454.CMB.1.raw
  modified_base (237)..(237): a, c, t, g, unknown or other
  misc_feature (237)..(237): n is a, c, g, or t
  modified_base (295)..(295): a, c, t, g, unknown or other
  misc_feature (295)..(295): n is a, c, g, or t
  modified_base (343)..(343): a, c, t, g, unknown or other
  misc_feature (343)..(343): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtcccctcacctgccactgtctcgtggtnacctccatcgagaggtgtcgttcctacgtcggacctggactccggcacgtccgccggngaagggctggagtatagtggaactatctagtcgcgaggtcgggacccnctactacctaaccgaaccccgtcctacgaagtcgtcgacgtcagctagtcgtacacgtcgaacctaccgtacccacgtaacctacgttccctacccgtacgaactaggtacgtaagtttactacgtaccgacccgcgtacgacgaccgaccgggtcgtacgttaacttcggtagtcgacgagtacggtacggttaccgtttacgttacggacctaacgtacttaaacgttaaaccttccgtaacgttaccggtgtacggtacgtacggtcgggaccgagggtacccgtaacgg

SEQ ID NO: 246703 - DNA, 629 bp, Homo sapiens
  misc_feature: GYAE6OF01CFRR0.9.70.G04.1.454.CMB.1.raw
  modified_base (235)..(235): a, c, t, g, unknown or other
  misc_feature (235)..(235): n is a, c, g, or t
  modified_base (341)..(341): a, c, t, g, unknown or other
  misc_feature (341)..(341): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctcgtggtnactccatcgagaggtggtcgttcctacgtggacctggactccggcacgtccgccggcaagggctgggatagtagtggaacgaatctatcgaccgaggtcgggaccnccatcctaaccgaccccgtcctacgaacgcgtcgagtcaagcagtgtcagtcgacaccgtccagacctacgttcctccctgacgagtagtagttactacgtcgacccgcgacgacgaccgacggtccgttagttacgttacgtggtacggacgaggacggtacggttaccggtttaagtttacggaccgtagttacgttaaacgtttaaaacctccgttaaccgtaccgggttacgtacgggtacccggttcgggtaccggggaccgacgggggtaaccgtaaccggg

SEQ ID NO: 246704 - DNA, 783 bp, Homo sapiens
  misc_feature: GYAE6OF01DGJNK.9.70.G04.1.454.CMB.1.raw
  modified_base (725)..(725): a, c, t, g, unknown or other
  misc_feature (725)..(725): n is a, c, g, or t
tcagtgatacgtctcacgaccggtgctcgatttagtgtagtgtgaagggaaaggcctgtgaaggcttcactagtcctggacctcctgtgcaaagaacatgaaacatctgtggttcatcctcctcctggtgcagctcccagatgggtcctgtcccaggtgcggctgcgaggagtccgggcccaggactagtgaagtcccttcacacggcccctgtcccctcaccgtgcctacttcgtccttcgtggtcgacctccatccgaaggtagggttcggttcccgtttaccctaacgtcgggtacccttggaccgttcccgggctacggtccccggccggacggaacggggtctaggggaattaacgtacgtttaggaaccgtaattcgttatcggaccgtagggtcgggaccccactacgttaccaacccgtaacccccggttcccaacgtaaagggtaccggtacgtaacgttaccgaaggcctaagtttcgaccgtacggttaccgaccgttaccgtacccgaaacgtaaccctacgtttcccaccgtagacgtagtacgtacgtttatacgtccggacccgtccgtacgaacgaccgtccgggtcgttattaaccgtttacgcgggtcggacggaggttaaccggtacgttccggtttttaaagttacggaccgttagttaaccgtttaaaaccggtttaaaccctcccgtttaaacggttccggtntaaccgggttaccgtacgggtacggggtaacccgggaagggtaaccccgttaaccggg

SEQ ID NO: 246705 - DNA, 663 bp, Homo sapiens
  misc_feature: GYAE6OF01CO6HN.9.70.G04.1.454.CMB.1.raw
  modified_base (105)..(105): a, c, t, g, unknown or other
  misc_feature (105)..(105): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (363)..(363): a, c, t, g, unknown or other
  misc_feature (363)..(363): n is a, c, g, or t
  modified_base (425)..(425): a, c, t, g, unknown or other
  misc_feature (425)..(425): n is a, c, g, or t
  modified_base (541)..(541): a, c, t, g, unknown or other
  misc_feature (541)..(541): n is a, c, g, or t
tcagtgatacgtctcacgaccggtgctcgatttagtgtagtgtgaagggaaagggcctgtgaaggcttcactagtcctggacctcctgtgcaagaacatgaaacntctgtggttcatcctcctctggtggcagctcccagactgggtcctgtcccaggtgcggctgcgaggagtcgggcccaggactagtgaacgtccttcaacgcggccctgtccctcacctgcactgtctcgtgtnactccatcgngacggtgtccgttcctacgtggacctggactcccggctacggtcccgccggacgtaacgggctgggaagtatagttacggaacgtaactcttagcgtaccgaaggtcgggacccncgtatcccgtaaccaaccccgttcctacaaggtacgtcgtaacgtcgaacgctagttcgacncggtaccgactaaccgtccaacgtaacctacgttcctacccgtagtaccgagttacggtagttaactacgtacgaccgccgacgaacgaccgaccggtcgtacgttaacgttacgngtcgaccggagaggcggttaccgttaagttacgacgtacgtacgttaacgttaaacctcgttaacgttccggtagttacgggacttaccgggtacgggacccggaagggtaacccgtaacgg

SEQ ID NO: 246706 - DNA, 570 bp, Homo sapiens
  misc_feature: GYAE6OF01CE48H.9.70.G04.1.454.CMB.1.raw
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (435)..(435): a, c, t, g, unknown or other
  misc_feature (435)..(435): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcgagaggttggtccgttacctacgtggacctggactcccgggcacggtccgccggcaaggggctggagtatagtggacgaatctatgccaggtcggaccgcatcaccacccgtcanagtncgagcagcatgacagtccgactacgcccagaacctacgttctaccctcgacagtagtattactagacgaccgccncagacacgcgtagtattactgtgcgagaggtaggtaccgttagttaagaccagtacgttaacgttaaaacctccttaacgtacggttcgtacggtaccggttacggtacgggtccgaacggggtacctaaccggg

SEQ ID NO: 246707 - DNA, 852 bp, Homo sapiens
  misc_feature: GYAE6OF01CSM9S.9.70.G04.1.454.CMB.1.raw
  modified_base (396)..(396): a, c, t, g, unknown or other
  misc_feature (396)..(396): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagcctcccagatgggtcctgtcccaggtgcggctgcaggacgtccgggcccaggtactaggtgaacgtccttcaacgcggtccctcgtcccctcaccctgacctcttcgtctcgtggtacacctccatcgaggtacggttcggttccgttacctacgtcggacttggacgttcccggactacggtccccggaccggaacggaaaggggtctgggaattagtagttcggaaactaattctagtcgaccgtagggccgggacccnctaacctctaaccccgaacccgttccgtaagaaacggtcgtacccggaagttccgacgacccttaagtcggtacccgaacggttacccgaaccctaccccggtaacccgaaacgtaacccgttacgttttccccacccgttagaaccgttaggtaacgttacgtttaagtaccggtaccggacccggacccgtacggaaccggtaacccggtaccgggttaccgggttaatttaacccgttacggttacgggtaccgaacgggtaacgtacgggggtttaaccggtttacccggttttttaaaaggttaacccgggaccttaaacggttaaccgtttaaaaaccggtttaaaaccctccggttaaacccggttttaccgggttaggtcccggggttaaacccggttacgggtacccgggggaacccggtaaacggggttaacccctaaacccgggg

SEQ ID NO: 246708 - DNA, 719 bp, Homo sapiens
  misc_feature: GYAE6OF01C0C2V.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatggtcctgtcccaggtgcggctgcaggagtccggcccaggactagtgaacgccttcacgacggccctcgtccctcacctgccactgtctcgtggtcgacctccatcgaggtaggtcggttccgttcctacgtcggaccgtggacgtccggacgacggtcccggaccggacgaagggtactagggagtagttagtcggaactaagtcctagtacgccgaggtccgggacctaccgtaactacccgtaaacccgaacccccggttcctaaacgaaacgtaccggtacgtaacgtcgaacgactagtcgtcgtaaggtccgtaccgaccgtacccgaacgtaacccgtacgttcctaccgtacgacgtaggtacgtaacgttactacgtacgacccgacgtaccgaacgaccggtaccggtaccgttagttaccgttacgtaggtcgacggacggtaggtacggttacgtttacgtttacggacgttaacgtaccgttaacgttaaaacccttccgtaaccgttacggtacgtacggttaccgtaccggtacggggaccggtaacgggtaccgtaaccgg

SEQ ID NO: 246709 - DNA, 588 bp, Homo sapiens
  misc_feature: GYAE6OF01BISE0.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttccactggacctggatccggcagtccgccggcaagggctggatatagttggacgaatctaatgccagtcgggaccgcatctaccaacccgtccctacaagtacgtcagtcagcatgtcaaggtccgaactaccgtcccaagaacctacgttctaccctgacagtagtagttatagtacgaccgtcgcaacgaccgacggtccgtagtaacttacgtgtcgacgagacgacggtacgtttagtttacggacctagtacgtaacgttaaaactccgttaacgttacggttcgtacgggtacgttacggtaggggcccgaacggggtaccgtaacggg

SEQ ID NO: 246710 - DNA, 597 bp, Homo sapiens
  misc_feature: GYAE6OF01A3XSB.9.70.G04.1.454.CMB.1.raw
  modified_base (326)..(326): a, c, t, g, unknown or other
  misc_feature (326)..(326): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcttcctactggacctggatccggcagtccgccggcaagggctggagtatattggaacgatctatgcagtcgggaccnccatcacaaccccgtcctacgaagagtcgagtcagcatgtcagtccgacaccgtcccaacgaacctacgttctccctgacagtagagttatatcgacccgccgcacgacgacggtcgtagtacttacgtgtgcgaagaggacgggtaccgtttagttttaacggaccctaggtaccgttaaacgttaaaaaccgttacccgttaaccgttaccggttacgtacgggtacggttcggtacggggacccggtaacggggaacccgtaaacggg

SEQ ID NO: 246711 - DNA, 622 bp, Homo sapiens
  misc_feature: GYAE6OF01EQAQ6.9.70.G04.1.454.CMB.1.raw
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggttggtcgttcctacgtggacctggactccggcagtccgcggcaaggggactggagtatattgggacgaatctatgccaggtgggaccnccatcctaaccgaacccgtccctanaagtacgtcgagtcagcagtgtcagtcgactaccgtcccaagaaccagttcctccctagacgagtcgtagtttactagtcgaccgccgacagaccacggtccgtgtacttacgtgtacgcgaagaggtacggtaccgtttaagtttacgggaacctagtacgtttaaacggttaaaaccttacccgttaaacgttaccgggttacgttacgggtaccggtttcgggtacggggtacccgtaaacgggggaccgttaaaccggg

SEQ ID NO: 246712 - DNA, 830 bp, Homo sapiens
  misc_feature: GYAE6OF01AIB5D.9.70.G04.1.454.CMB.1.raw
  modified_base (238)..(238): a, c, t, g, unknown or other
  misc_feature (238)..(238): n is a, c, g, or t
tcagtgatacgtctcacgaccggtgctcgatttagtgtagtgtgaagggaaaggcctgtgaaggcttcactagtcctggacctcctgtgcaagaacatgaaacatctgtggttcatcctcctcctggtggcagctcccagagtgggtcctgtcccaggtgcggctgcgaggagtccggcccaggactagtgaagccttcacgacggccctcgtccctcacctgcactgtctcgtggtnacctccatcgaggtagggttcggttccgtttacccgtacgttcggacccgttggacgttcccgggactacggtccccggaccggacggaaacgggtacgtagggtaacgttatacgttacggaacgtaacttcgtagtcggaccgtagggtccgggacccgcctaactaccgtaacccgaacccccgttccgtaacgaaggtaccgttcgaaacgtcgaacgtacctagttcgtaaccgtacggtacccgaacccgtaacccggttaccccgaaacggtaaacccgtttccgtttacccccgtaccgttaaggaaacccgttagttacggttaaacgtttacgtacgtacccggaacccggtaccggaaccgtaaccgtacccggtaccgggttacgtttaacggttaaccgtttaccgtagggtaccggaaggaacgggttaacggttaaccggttacgttttaaacgtttcggaaacccgttacgttaaccgttaaaaccgtttaaacccgtccgttaaccgttaccgggtaccgttacgggtaaccggttccgggtaacggggaccgttaaccggggtaacgtacccgg

SEQ ID NO: 246713 - DNA, 696 bp, Homo sapiens
  misc_feature: GYAE6OF01BJMRV.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatagaaacatctgtggttcactcctcctcctggtggcagctcccagatgggtcctgtccaggtgcggctgcaggagtcgggcccaggactagtgaacgccttacacgacggccctcgtcccctcacctgcactgtcctcgtggtcgacctccatcaggtaggtcggttccttacctaacgtcggacccgtggacgtcccggacacggtcccggccggacgaagggtactaggagtattagttacggacgaactctaagtcgacgtagggtccgggacccgacctactacccgtaacctaaccccgtacctacgaagtacgtacggactcacgacatcgtacgtacgtaccgaacacccggtacccaacggtaaccctacggtttacccctcccgtaacggtaaccgtaggttaagtaacgtttaacgtagtccggacccgaccacgaacggtacccgacggtccgtagttaaccttcgtgggtacaggacgtacggtacggttacgtttaaggttaccgactaacggttacttaaacgttaaaccctcgttacgtacggtcgaggtaccggacggtagggaccgaagggtcgtaacgg

SEQ ID NO: 246714 - DNA, 911 bp, Homo sapiens
  misc_feature: GYAE6OF01CEK9U.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatcgggtcctgtcccaggtgcggctgcgaggagtccgggcccaggactagtgaacgccttcacgacggcccctgtccctcacctgccactgtctcgtaggtcgaccttccatcgaaggtcgggttcggttccgttaccctaacgtcgggtaacccgttgggaacgttcccgggacgtaaccgggttccccggcccgggtacggaaaacgggggtccttaggggtaacgttaacgttaggttacggggaaacctaaagttccgtaagtcggaccgtaacggggttccgggacccctactaacgtaccgtaaaccccgtaaacccccggtttccctaacggaaaacgggtacgttacccggtaaacggttacccgaaggtaccctaaagtttccgggtaaccctaacgggttaacccgaaacccgtaccccggttaacccccgaaacggttaaaccccttaccgggttttaccccctacccgttaacggtaaaccgttaaacgggttacggttaaacggtttaactaacggttacccggtaacccccgtaccgtaaccgaaacccggtacggtaaccccgggttaccggtttacggttaaccgttaacggttcggtaacggaccgggttaacggacgggttaccggttaaccgttttaaggtttaaccgggaccgttaagtaccgttaaaacgttaaaacccttccgttaacgttaccggtacgtacggtaaccggttcggaccggggtaccgaacgggtacccgtaacggg

SEQ ID NO: 246715 - DNA, 580 bp, Homo sapiens
  misc_feature: GYAE6OF01A0UPT.9.70.G04.1.454.CMB.1.raw
  modified_base (332)..(332): a, c, t, g, unknown or other
  misc_feature (332)..(332): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcacgtccgccggcaagggactggagtatagttggacgaatctatgccagtcgggaccncatctaccaacccgtcctacaagacgtcgagtcagcatgtcagtccgacaccgtcccaagaaccctagttcctccctgactagtagagttatactcgacccgccgacacgaccaccgggtccgtagtacttacgtgtcgacgagtacggtacggtaccgtttagtttacggacctagtacttaagttaaaacctccgtacgttacgtcgtacggtacgtcggtacgggccgacggggaccgtaacggg

SEQ ID NO: 246716 - DNA, 637 bp, Homo sapiens
  misc_feature: GYAE6OF01E4G4I.9.70.G04.1.454.CMB.1.raw
  modified_base (353)..(353): a, c, t, g, unknown or other
  misc_feature (353)..(353): n is a, c, g, or t
  modified_base (539)..(539): a, c, t, g, unknown or other
  misc_feature (539)..(539): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccggccatgactagtgacgtccttcacacggccctgtccctcacctgcctactcgtctcgtggtcacctccatcgaggtagggttcgtccgttcctacgtcggacctggactccggactacgtcccggcggacgaagggctggatatagtggaactatctatcgccgtaggtcgggaccnctatccaacctaccccgtcctacgaagcgtcgactacagtcctaagtcgtacgtagtccgaacctaccgtacccaacgtaacctacgttccctacccgtagtacgtaggttacgtacgttactacgtccgtacccgccgtacgaacggaccgtccggtacgttagttacttacgtggtcgtacggnggacgtaggttacctttagttacggactacgtacttaacgttaaacctccgtaacgtacgtcgtacggtacgtacgggtacgggccgtaggggtaccg

SEQ ID NO: 246717 - DNA, 710 bp, Homo sapiens
  misc_feature: GYAE6OF01EWIGU.9.70.G04.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacaggccctgtccctcacctgcactgtctctggtnactccatcagnggtggtcttcctagtcggacctggactcccggcacgtcccggccggcgaaggggctagggagtatagttggaacgtaatctagtcgaccgtaagggtcgggaacccgcctaacgtaccctaaacccgtaacccccgtccctaacgaaacggtacggtcgaagtccgacgctagtcgtacgacggtaccgaccaccgtaccccaacgtaaccctacgttccctacccgtagaacctacggttagtaacttacgtacgtaccgggacccgaccgaccgaacgtacccggaccggtcgttacgttaacgttaccgtggtacggacggacggacggtaccggttacgtttaaggtttaaccggaacctaggttaaccgttaaacgtttaaaaccctccgtttaaacgttccgggttagtacgggttacgtcgggtacggggaccggtaacggggtaacccgtaaacggg

SEQ ID NO: 246718 - DNA, 747 bp, Homo sapiens
  misc_feature: GYAE6OF01D4TWU.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtccaggtgcggctgcaggagtccgggccaggactagtgaacgccttcacgacggtccctgtccctcacctgcctactgtcctacgtggtcgactccatcaggtacggttcggttccgttacctaacgtcggaaccctggtaacgtcccggactacggtccccggaccggacgaaagggggtacctgggaagttattaaggttcggaaacgtaattcgtaacgtcggaccgtagggtaccggggaaccctacctaacgttacccgtaaacccgtaaacccccgtccgtaaacgaaaggtaccgttaccggagttaccaaggctagtacgtacacggtaccgtaaccgaccgttacccgaaacgtaaccctgttccctaccgtagaccgtaaggttacgtaaggtttaactacgtccggacccgcgaacgtacggaccgtaccgggtccgttaagttacgttaccggtggtacgacggaaggtaacggtacggtttaccgtttaagttacgactaagtacgttaaaacgttaaactccgtaaacgttccggtactacgggtacgttacggtacggggacgtaagggacccgtaaacgg

SEQ ID NO: 246719 - DNA, 801 bp, Homo sapiens
  misc_feature: GYAE6OF01A10SK.9.70.G04.1.454.CMB.1.raw
  modified_base (595)..(595): a, c, t, g, unknown or other
  misc_feature (595)..(595): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagcccttcacgacggcccctgtacccctccgaccttcgcacttgtccctgtaggtcgacctcccagtccgaaggtagggttcggttccgtttaccctacgtcgggtaccctggtaacgttccccgggactacggtaccccggacccggtacggtaaaacgggggtacccgttgggggaagttaagttaacgtttacggggaaaccgttaaatttccgtaagttcggaccccgtaagggttcggggaaccccgtcctaacgttcctaacccgtaaacccccggttcccctacggaaacggtcgttaccggaagtccgaggaccctagttcgtaccgaggttccgaaccgtacccgtcccaacgaacccttacggttccctcccgtacgacgtacgtgtaacgttntagtcgaccgccgacacgacaccgggcgttacgtattaccgtaggtcgacggtacgacggtaccggttacgtttaaggtttacgaaccgtaggtaaccgtttaaaccggtttaaaaccttcccggttaaccgttacgggttacccgttacgggtacccggttccggtacgggggaacccggtaacggggtacccgttaaaccgggg

SEQ ID NO: 246720 - DNA, 930 bp, Homo sapiens
  misc_feature: GYAE6OF01CEXJD.9.70.G04.1.454.CMB.1.raw
tcagtgatacgtctcacgaccggtgctcgatttagtgtagtgtgaagggaaaggcctgtgaaggcttcactagtcctggacctcctgtgcaagaacatagaaacatctgtggttcatcctcctcgtggtggcagctcccagagtcgggtccctcgtcccgaggtcgcggctgcgagggacggtccgggcccaaggactagtagaacgtcccttacaccgacggtccctcgttcccctacaccctgcctactcgtctcgtggtacacctccatcgaggtaggtcgttccgttacctacgtcggtaccgtggacgtccggacgtacggtcccggaccggacgaacgggtacgtagggtaagttagttacgtaacggaacgtaactcgttaagtccggaccgtagggtaccgggaaccctccgtaactaccctaacccgtaaaccccgtcctaacgaaacggtcggtacgaacgtacgaacgtaccgtaagtcgttaaccgaacggtaccctaacccggaccccgtaccccgtaacgtaacccgttaaccgtttccctaccggtaacgtaacggtaacgttaacggtaacgtttaacgtaaccggtacccggaaccccggtaccgaaccggaacccgggtaaccggttaacccgggtaccggttttaacggttaacgtttaccggtacgggtaacgggtaaccggtaacgggttaaccgggttaccgggtttaacccggttttaaacggtttaaccgggtaaacccgttaaaccggtttaaacccgtttaaaaccggttttaaaaaccccgtttacccggtttaaacccgggtttaacccggggtttaccggttaccggggttaaaccgggtttccccggggttaacgggggaaccccggttaaaccgggggtaacccgttaaaccccggggg

SEQ ID NO: 246721 - DNA, 726 bp, Homo sapiens
  misc_feature: GYAE6OF01BDMUI.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggccaggactagtgaagccttcacgacggccctgtccctcacctgcactgtcctcgtggtcacctccatcgaggtaggttggtccgttacctacgtcggacctggacgtccggctacggtccgccggacgaagggctggagtatagttacggacgtaatctatcggacaggtcgggacccgcaattccaacctaaccccgtccctagaaacggtacgtacggagtccgaagctagttcgtacgacgtaccgaaccgtacccgtacccgaacgtaaaccctacggttcccctaccgtacgtacgtaacggtagttaacgttaattaccgtacggtacccggaccgcgaacgtaccgaccgggtaccgttaggttaactttaacgtcggttacggacggtaacggtagggtaaccgggttaccggtttaaggttttaaaccgaccggtaacgttacgttaaacgttttaaaacccgtcccgttaacgttaccgggttacggtacgggtaccgtaccgggtacggggacccggtacggggtaaccgtaaccgg

SEQ ID NO: 246722 - DNA, 803 bp, Homo sapiens
  misc_feature: GYAE6OF01EP3J9.9.70.G04.1.454.CMB.1.raw
  modified_base (360)..(360): a, c, t, g, unknown or other
  misc_feature (360)..(360): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagtccttcacgacggccctcgtccctcacctgcactgtctcgtggtgacctccatcgaggaggttcggttcttcctacgtcggtacctggactccggcacggtcccgccggacgaacgggctaggtagtatagttggaacgtaatctaagtcgaccgaggtcgggaccnccgtaatacctaaccgaaccccgttcctaacgaaagtcgtaccgagttacgagtctacgttcgtaccgacggtaccgaccgtaaccgtaccccgaaacggtaaccctacggttccttccccgtacgaaaccgtaggttacgttaacggtttaacgtaacgttaccgggacccgtaccccggtacggtaaccggaacccgggtaacccgggtcccggtttaaggttttaaccttaccggttcgggtaacggaccgggtaacgggtaacgggttaacgggtttaccccgttttaaagggtttaacccgggaaaccgttaaccggttaaccgtttaaaacgttttaaaaacccgttcccgttaaaccggttaacccggttacgggttacgggtacccggttacgggtaaccggggtacccggtaaggggaaaccccgttaaccggg

SEQ ID NO: 246723 - DNA, 640 bp, Homo sapiens
  misc_feature: GYAE6OF01B6K6B.9.70.G04.1.454.CMB.1.raw
  modified_base (299)..(299): a, c, t, g, unknown or other
  misc_feature (299)..(299): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctccagatgggtcctgtcccaggtgcggctgcgaggagtccgggcccaggactagtgaacgtccttcacgacggccctgtacccctcacctgcctactcgtctcgtaggtcacctccagtcaggtaggttcggttccttcctagtcggaccgtggtactcccgganacggtcccgccggagaagggtctagggattattagtacggaactaattctagcgaccgaaggtccgggacccactactacctaacccaaccccgttcaagaaggacgtcgagtcagtctagttcgacgtacggtaccaccgtacccgtacccgaaacgtaccctacggtttccctaccgtaagacgtaagtacgttaagttactagtcgactccgaccgacacggaccgtcggtcgttagtacgttacgtgtagagaacgtagtacggttcttaggttacgactagtactaaattaacctctacgtacgttcgtacggtcgtaggcggacggcggtaaccg

SEQ ID NO: 246724 - DNA, 773 bp, Homo sapiens
  misc_feature: GYAE6OF01BM8VQ.9.70.G04.1.454.CMB.1.raw
  modified_base (344)..(344): a, c, t, g, unknown or other
  misc_feature (344)..(344): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacaggccctgtcccctcacctgctactgtctctggtgactccatcagaggtgtcgttcctacgtggacctggactccggcacggtcccgccggacgaagggcgtggagtatagttaggacgtaatctatcgaccgaggtcgggaccnctactcctaaccaccccgtcctagaacgacgtcgacgtcgacgctagtcgtacacggtccgaaccgtacccgtacccgaacgtaaccctacgtttccctacccgtagtaaccgtaggttacggtaacgtttaacgttaacgtaccggacccccgtacccggaccgaacggaacccgacccgggtacccggttacgtttaaccgtttaccgttcgggttacggaccgggtaacgggtaacggtaccgggttaaccggttttaacgttttaaccgggaaacccgttacggttaacccgtttaaaccgggttttaaaaaacccttaccccgtttaaaccggttcccgggtttaaccggtaccgggttaaccggggttacccgggttaccgggggggacccggtaaacgggggtaaccccggtaaacccgggg

SEQ ID NO: 246725 - DNA, 1041 bp, Homo sapiens
  misc_feature: GYAE6OF01BQMFO.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatagaaacatctgtggttcatcctcctctggtggcagcctcccagagtcgggtcctcgtcccgaggtcgcggctgcgagggacggtccgggcccgaggactaggtagaacgtccttcacgacggtccctcgtcccctcacctcgctactcgtctcgtggtcgacctccagtacgaggtacgggtcggtttcccgttacccttaacggtcggtaccgtaggtaccgtcccgggacgtaccggtacccggaccgggtaacgaaacgggggtaccgttaggggtaagttagttacggttacggaaacgtaaactttccgtagtaccggacccggtaacgggtacccgggaaccccgtaacccgtaaccgttaacccgtaaacccccggttaaccccccggttacccgtaaacgtaaaacgggttaacggtaccgtaaacggttaccgaacggtacctaacggtttaccggtaccgttaacccgggtaccggtaaccccaaccccgggtttaacccgaaaccggttaacccgttaaccgttcccctacccggttaacgtaaccggtaacggttaacgttaaacgggtttaactaccggttaacccgggaccccgacccggtaaccggaaccggtaacccgtaacccggggttaccccgtttaaggttaaaccgtttacccggttaacgggttacccgggaaacgggttaaccgggtaaacggggttacccgggtttaaaaccccggttttttaaaacggggttacccgggtaaacccgttaaaccgggtttaaaccggttttaaaaaaacccggtttaaaacccccggtttaaccccgtttaaacccgggttttaaccgggtaccggttaacccgggggttacccgtacccgggggtttacccggggggaaacccgggtaaaccggggtaacccgttaaaccccgggg

SEQ ID NO: 246726 - DNA, 724 bp, Homo sapiens
  misc_feature: GYAE6OF01BFFZ3.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgtccttcacgacggtccctcgtcccctcacctgctactgtcctcgtggtcgactccatcgaggtaggttcggttccgttcctacgtcggacctggacttcccggctacggtccccggccggacgaaagggtcgtgggtagtattagttacggaacgtaatctagtcgaccgaggtcgggacccacctacgttaccctaacccgaacccccgttccgtaacgaacggtacgtcgtaacgtcacgtctagtcgtacgtaggtacccaaccgtacccggtacccaacggtaaacccttcgtttcccctacccgtaggaacctaggttcgtaacgtttactacgttaccggaccccgcgaccaagggacccgtccgggtacgttacgttacttacggtgtacggacgaacggtacggtacggtttaccgtttaagtttaccgggaacctagtaccgtttaaaacgtaaaccttcccgtaagttaccggtcgttacggccgttacgggacggggaccgtaacggggccgtaaccgg

SEQ ID NO: 246727 - DNA, 612 bp, Homo sapiens
  misc_feature: GYAE6OF01A1WE6.9.70.G04.1.454.CMB.1.raw
  modified_base (233)..(233): a, c, t, g, unknown or other
  misc_feature (233)..(233): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctacgtggacctggactcccgggcacggtcccgccgggacgaaggggctgggagtatagttggaacgtaatcgtatcgaccgaggtcgggacccgcctatcctaaccgaaccccgtccctagaagacgtcgacgtcagctatcgtcagtcgacaccgtaccacgacctgttcctccgtgacagtgtagttatacgtcgaccgccgcgaacgacgaccggtcgtagtacttacgtgtcgacgaggacggtacggtcgtttaagtttacggaccgtagtacgttaaacgttaaaaccttccgtaacgttaccggttcgtacgggtaccgtcggtacgggaccgtaggggaaccgtacggg

SEQ ID NO: 246728 - DNA, 622 bp, Homo sapiens
  misc_feature: GYAE6OF01CREQE.9.70.G04.1.454.CMB.1.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgaggccctgtccctcacctgcactgtctctggtnactcatcagngtgtcttcactggactgatccgnagtccgcganaaggctggatatagtgaacgtatctancgctaggtcggacccncatcctaccaacccgtcctagaagcgtcgagtcagctagtcgtacagtccgactaccgtacccaacgaacctacgttcctaccgtacgacgtacgtagtaacgttatacgttacgacccgccgacgtaacgacgaccggtcgttagtacttaccgtgtacgaccggtagtaacggtacggttaccgtttaagttaaccggaccgttaagtaccgttaaacgttaaaacctcccgttaacgttaccggttacgtacggtaccggttacggtacggggaccgtaacggggtaccgttaaccggg

SEQ ID NO: 246729 - DNA, 729 bp, Homo sapiens
  misc_feature: GYAE6OF01C3CL8.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaacgccttcacacggccctgtccctcacctgcactgtctctggtcactccatcgaggtggtcggtcttcctacgtcggactggactccggctacggtccggccggacgaagggtacctaggagttaattagttacggaacgtaatcgttaagtcggacccgtaagggtccggggaccctaccgtaacttaccctaaacccgtaaacccccgttcctaacgaaacggtacgttaccggtaacgtaccgaaggtacctaagtccgttaccgaacggttcccgaacgttaacccgtaccccgaacgtaaacccgttacgttccctacccgtaggtaacctaggttacgtaagtttacgtacgtcgaacccggtcctacgacgtacgaccgggtccgttaagttaccttagtacgtcgacgtagtacggtacggttacgttttaagttacgaccgtaagtacgttaaacgttaaacctccgttaacggttacggtcgtacgggtaccgtcgggtacgggacccgtaagggtacccgtaaccgg

SEQ ID NO: 246730 - DNA, 716 bp, Homo sapiens
  misc_feature: GYAE6OF01D63EF.9.70.G04.1.454.CMB.1.raw
  modified_base (578)..(578): a, c, t, g, unknown or other
  misc_feature (578)..(578): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatccctcctcctggtggcagctcccagatgggtcctgtcccaggtgcggctgcaggagtcgggcccgagactagtgaacgtcctacacgacggtccctcgtcccctcacctgactacttgtcctcgtggtacacctacactgaaggtaggttcggttccttacctagtcggtaccgtggtaccgtccggactaccggtcccggaccggaggaaacgggtctaggaagttacttaaggtcggaacgtattctaagtccgaccgtaggggtacgggaccctacctaataccgtaaccccgtaaaccccgttccaaggaaaagtcgtacgacgtcaagctagtcgtacacggtaccaacctcccggtaacccaaacgtacccttacgttccctacccgtagacgtaaggtagtaacgtttactacgcgacccgcgacgaacgaccgcgtcgttagtactttacggngtcgaggtaagacggtacggtttctttaaacggttacgactacgttaacgttaaaacgtttaaaccctccgttaacgttacgggttcacggggttacgttacgggacccggggaacccggtagggaacccgtaaacgg

SEQ ID NO: 246731 - DNA, 764 bp, Homo sapiens
  misc_feature: GYAE6OF01CJROX.9.70.G04.1.454.CMB.1.raw
  modified_base (142)..(142): a, c, t, g, unknown or other
  misc_feature (142)..(142): n is a, c, g, or t
  modified_base (487)..(487): a, c, t, g, unknown or other
  misc_feature (487)..(487): n is a, c, g, or t
tcagtgatacgtctcacgaccggtgctcgatttagtgtagtgtgaagggaaaggcctgtgaaggcttcactagtcctggacctcctgtgcaaagaacatagaaacatctgtgttcatcctcctcgtggtggcagctcccagngtcgggtcctcgtccaggtgcggctgcgaggagtccgggcccagggactagtagaacgtccttacaacgcggtccctgtccctcaccgtgcctacgtcgtctcgtcggtcgacctccaagtcgaggtacggttcgttaccgttaccgtacgtcggtacgttggacgtcccggcgtaccggccggaccggacgtaaacggggtcgtaaggtaggttaacgtttacggtaacggaaacgtataccttaaggcgtaaccggtgggtaccggacccgtacttaacgtacctaacccccggtaaaccccgtttccaacggtaaacggacgtaccggtacgtaccgaacgnttacgtcgtaaccggtcgtaccgaccgtaccgtacccgaaacgtaccgttcgttacccgtactacgtacgtaacgtcgttaacttacgccggtaacccgacccgacgtacgaacggtaccgtaccgtaccggtttataacttccggagggtcgaacggtaagtacgttaccggttacgtttaacgtaccgagttaacgttagttaaaccgttaacctcgttaccgtacgtccggttaacgtccggttaagggacccggagtaacggggcttaaccgg

SEQ ID NO: 246732 - DNA, 817 bp, Homo sapiens
  misc_feature: GYAE6OF01EE1JO.9.70.G04.1.454.CMB.1.raw
  modified_base (105)..(105): a, c, t, g, unknown or other
  misc_feature (105)..(105): n is a, c, g, or t
tcagtgatacgtctcacgaccggtgctcgatttagtgtagtgtgaagggaagggcctgtgaaggcttcactagtcctggacctcctgtgacaagaacatgaaacntctgtgttcatcctcctctggtgcagctccagagtggtcctgtcccaggtgcggctgcaggagtccgggacccaggacttagtcgaacgtcccttacgacgacggtcccttcggtacccctcaccgttgacctacttgttctcgtggtactacctccagtcgaggtacggttcggttccttaccacgtcggaccgtaggacgtccggcgtacggtccccggacggaacaacggggtctagggtaagttattagttacgggaactaacgtccttagtccgacgtacggtacgggacccctacgtacgttacccgtaacccgtaaccccggttcctaaacggaaacgtccgtacggaacgttaccgaggtacctagttccgacgtaacggttacccgaaacctaccggtaccccgaaacgtaaccccttttacgggtaccctacccgtagtacgttaggttacgtaacgtttacgtaacgtcccggtaacccgcgtaacgaaccggtaaccgccgggtttaaccttaggttaacttacggtacggtacgacggtaacggtaccggttaaccggttacgttttaaggtttaccggacccttaaggttacccgtttaaaacggttaaacccttcggttaaaccggtaccggtttacggttacgggtaccggttaccgggacggggtaaaccctaccggggtaacccgttaaccggg

SEQ ID NO: 246733 - DNA, 908 bp, Homo sapiens
  misc_feature: GYAE6OF01C14T6.9.70.G04.1.454.CMB.1.raw
tcagtgatacgtctcacgaccggtgctcgatttagtgtagtgtgaagggaaagggcctgtgaaggcttcactagtcctggacctcctgtgacaaagaacatagaaacatctgtgttcacttccctcctcgtggtggcacgcctacccgagtagttcgggtccttcggtcccgagggtcggccggctgacgagggacggtccgggacccgaggacttaggtacgaacgtcccttacacgtaccggccccttcgtccccttcaccgtcgacctacgttcggtccttcggttacgggtcctaccttaccacgttacggaagggttacgggttcggtttcccgtttaccgttaccggtacgggtaacccgttcggtaccgttcccgggacgttacccgggccccgaccggggaacggaaagggtaggttacgggtaattaagttacggttacgaaacgtaacgttcgtagtaccgacgtacgggtccgggaccctaacctaccgtacctaaaccccgtacccgttacctaaaggtaaacggcgttacgtaacgccgtagtacccgtgtaccgtaactacggtaccccaacggttaccccgaaccgtaacccggtaaccttacgtttccccgacgtacgtaacgtacgttaagttacgttacgtaccgacccggtaccgacccgtaacgaccggaccggtaacccggtttgttaaaccgtttacgttaccgtagggccggtaagggacggttaacgggttaccgttttaccggtttaagttaaccgggaccgtttaaacgtaaccggttaaaccgtttaacccgtttaaccggttaaaccgggttccgttagggacccgggttacgggttacccggtaccggggaacccgtaacggggaacccttaaccgggg

SEQ ID NO: 246734 - DNA, 741 bp, Homo sapiens
  misc_feature: GYAE6OF01A9F4D.9.70.G04.1.454.CMB.1.raw
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (367)..(367): a, c, t, g, unknown or other
  misc_feature (367)..(367): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggacccaggactagtgaacgccttcacacggtccctgtcccctcacctgctatcgtcctntcggtnacctccatcgaggtaggttcggttccttcctacgtcggaccttggactccggctacggtcccggaccggagaaggggtctggaattatacgtaggaacgtactcgtagtcgccgaaggtcggaccncctatccctaaccgaaccccgtcctacgaaaggtccgtacgacgtcaacggcctaagttcgtacctaggtacccgaaccgtaccgttacccgaaacgtaacccttagttaccccgtaccgtacgaaccgtagggtacgttaaagtttacgtaaccgtccggtaaccccgaccggtaccgaacgtaacccggacccggttccggttaacgttacttaccggttaggtacgacgggtaacggtaacgggtaccgggtttacccgttttaagttacggacccttaaggtaccgtttaaaacgtttaaacctaccgttacggtacccggtcgtaaccggtacgttcgggtacgggaccggtacggggtacctaaccgg

SEQ ID NO: 246735 - DNA, 559 bp, Homo sapiens
  misc_feature: GYAE6OF01BIRNG.9.70.G04.1.454.CMB.1.raw
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
  modified_base (410)..(410): a, c, t, g, unknown or other
  misc_feature (410)..(410): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgaggccctgtccctcacctgcactgtctctgtgactccatcagaggtgtcgttccactggacctgggatccggcagtccgccggcaagggactggagtatagttggaacgaatctaatgccagtgggaccnccatcctacaacccgtcctanaagatcgagtcaagcatcgtcagtcgacacgtcccagaaccagttctccctgacagtnagttatatgaccgcgtcagacacggcgtgtaacttacngtgngagagacggtccgtttagtttacgggacagtacgtaacggttaaaaccttccgtaactacggttcgtacggtacgttacgtcggggacctagggggaccctaacggg

SEQ ID NO: 246736 - DNA, 704 bp, Homo sapiens
  misc_feature: GYAE6OF01CGHEL.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctcgtggtcgactccatcgagaggtcggtcgttcctacgtcggacctggactccggcacggtcccgccggacgaagggcgtggaagtactagttacgggaacgtaactctaagtcgccgtaagggtcgggacccgcctaactccgtaaccaacccgtccctaacgaaacgtacggtacgacgtcgacgactatcgtacgacgtaccgtaaccacccgtaacccgaacgtaaccccgtaacgttccctacccgtgaaccgtagtacgtagttaactgtaccgtaccgcccgtagacgtaccgaccgggtacgttagttacgttcgtagtacggacggtaacggtaggtacgggttacccgtttagttaaccggggaaccctaagggttaccgttaaaacgttaaaaccgttacccgttaacgttaccggttcgtacggtaccggtacggtcggggaccgtacggggaaccctaaccggg

SEQ ID NO: 246737 - DNA, 935 bp, Homo sapiens
  misc_feature: GYAE6OF01E41U2.9.70.G04.1.454.CMB.1.raw
  modified_base (232)..(232): a, c, t, g, unknown or other
  misc_feature (232)..(232): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctcccagatgggtcctgtcccaggtgcggctgcaggagtcgggcccaggactagtgaagccttcacacggccctgtccctcacctgcactgtctctggnacctccatcgaggtacgggttcgttccgttcctacgtggacccttgggactcccgggcacggtccccggacccgggacgaaacggggtccgtgggtaacgttaattagtttaggggaaccgtaaattcgttaacgtcggacccgtaagggttccggggaaccccgtaccgtaacttccgtaaaccccgaaaccccccggttccccttacgaaaacgggtcggttaccggaacgttccaaggcctaacgttcggtacctacggttccggaaccctacccggtaccccaacggaaaccctacggtttccctacccgttacgaacgtaggttacggttaacgttaacgttacgtaccggacccggtaccccgtacgaacggaacccggtaccgggtaccggttacggtttaacgtttaccggttacggggttacgggtaaccggtaacgggtaacggggttaacgggtttaacccggttttttaaacgggtttttaaaccggggaaaccccgttaaaccgggttaaaccggttttaaaacccggttttaaaaaaaaccccgtttaccccggtttaacccgggtttaccggggtacccggggttttaacccgggtttaaccggggggttaacccgggtttaccccggggggttacccggggggggtaaacccccgggtaacccggggggggttaaaacccccggggg

SEQ ID NO: 246738 - DNA, 811 bp, Homo sapiens
  misc_feature: GYAE6OF01DGJOB.9.70.G04.1.454.CMB.1.raw
  modified_base (170)..(170): a, c, t, g, unknown or other
  misc_feature (170)..(170): n is a, c, g, or t
  modified_base (661)..(661): a, c, t, g, unknown or other
  misc_feature (661)..(661): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagcctcccagatgggtcctgtcccagttgcgctgcaggngtccgggccaggactagtgacgtcctcacgacggccctcgtcccctcaaccgtgacctacttcgtcctcgtcggtctacctcccagtcgaggtacgggttcggttccgtttaccgtaacggtcgggtaacccgtcgggtaaccgttcccgggtaccgtacgggttccccgggtacccgggaacggtaacgggggtaccgttaggggtaagtttaaggttaacgttttacgggaacgttaaacttccgtttaagccgtacccgtagggtccggggacccctaaccgtacttcccgtaaccctaaccccggttcccaacgtaaacgcgttacgttaactcgaacgcgtacttacgtcgtaaacgtcccgtaacgtacccggtaaccccaagaacccgttacgttaccctacccgtagtaaccgtagtagtactttagtacacccggtaccgccgtaacgacgtaaccgaccggttcggttagtacgtttacgnggtacggaacgacggttaacggttacggttaccgttttaaggttaaccgaccgttaattaccggttaaaactttaaacccgtccggttaacgttaccggttcgtacgggtaccgtacgggtaccgggtaccgacggttaaccgggtaccg

SEQ ID NO: 246739 - DNA, 719 bp, Homo sapiens
  misc_feature: GYAE6OF01E2ZRE.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggccaggactagtgaagccttcgacgggccctcgtccctcacctgctactgtctcgtggtcgacctccatcgaggtaggtcggttccgtttcctacgtcggaccttggacgttcccgggactacggtcccggaccggacgaaacggggtacttgggagttaagttacgttacgggaaaccgtaattccgttaagtcggacctagggttccggggaaccaccctaactaccttaacccgaacccccgttccctacgaaaggacgttaccgaagtccagtacagttcggtaccgaagtacccgaaccacccggttacccgaaacgaacccgttaccgttcctacccgtaggaacctaggtacgtaacgtttaatacgtcgacccgccgacgtacgaccgaccggtcgtacgtacttacgtgtcgacggtaagacggtacggttacgtttaacgttacgactacgtacttaaacgttaaacctccgtacgttacggtacgtgggtacccgtcgggtacgggaccgtacggggaacctagggtacccg

SEQ ID NO: 246740 - DNA, 941 bp, Homo sapiens
  misc_feature: GYAE6OF01ED5QX.9.70.G04.1.454.CMB.1.raw
tcagtgatacgtctcacgaccggtgctcgatttagtgtagtgtgaagggaaagggcctgtgaaggcttcaccagtcctggacctcctgtgcaaagaacatagaaacatctgtgttcatcctcctcctggtggcagcctcccagagtcgggtcctcgtcccgagggtgcggctgcgaggacgtcggggggggccaggactagtagaacgtccttacacgacggtccctcgtccctctacctgctactcgttctcgtggtcgtacctacctatacgtaggtacgggttcggttccgttaccgtacgtcggtaccgtggacgtccggacgtaccggtcccggaccgggacggaacggggtacgtagggtaacgtttaagttacggtttacgggaacgttaacgttacgttacggtacggtaccggtaacgggttaccggggacccctaaccgtaaccttaaccccgttaaaccccgtaacccccggttaccctaaacggtaaacggtacggtaccggtacgtaaccgacgtactaacgttcgtacgtaacggtacccgaaccgtacccggtacccgaaacgtaacccgttccgttcccgtacccgtaagtaacgtaggttacgtaaagtttactaccggacccggtaccccgacgaaccgtacggtaacccggtaccgggttacgttaacgtttacttacggtcggggtaccggaacgggtaacgggttaacgggttacccgggttttaaacgtttttaacgggttaccggtaaacccgttaaaggttttaaaccccgtttttaaaaacccgttaaaaccccggttcccggtttaaacccgggtttaacccgggtcgggtttaaacccggggtcccggggtttacccggggaaccgggggggtaaacccctaaaccggggggtaaaccccgtttaaccccgggg

SEQ ID NO: 246741 - DNA, 703 bp, Homo sapiens
  misc_feature: GYAE6OF01BCN8E.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctcgtcccaggtgcggctgcaggagtcgggcccaggactaggtgaagccttcacgacggcccctgtcccctcacctgcctactgtccttcgtggtcacctccatcgaggaggttcgttccgttcctagtcggacctggactccggcacgtccgccggcaacgggctaggagttatacgttcggaacgtaatctagtcgacccgtaggtccggaccacctactaccctaaccgaaaccccgttccctaagaaaggtccgtacggacgtacaggactagttcgacgaacggttacccgaaccgtaccgtacccaacgtaacccgtacgtttcccctacccgtaggaactacggtagttaactttacgtacgttacgaccgttcggaccctacgaacgacccgtacgggtccgttagttacttaacggtcgtacgggcggaaggtacggtacggttaccgtttaagttacgaaccgttagtactttaaacgttaaaccctccgttacgttaccggtcgtacggaccgttcgggtaccgggacgggacgggtaacccg

SEQ ID NO: 246742 - DNA, 850 bp, Homo sapiens
  misc_feature: GYAE6OF01B5CFJ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctccagatgggtcctgtcccaggtgcggctgcaggacggtccgggccaggactagtagaacgtccttcacgacggtccctcgtcccctcacctgctactcgtctcgtgtcgacctccatcgaggtggtcgttccttcctagtcggacctggacgtccggctacgtcccggccggtacgaacgggtcgtagggtaacgttagttacggttacgggaactaattaccgtagtcggtacccggtagggtaccgggaccctacctaacttaccctaaccccgtaaccccgttcctaacgaacggtacgtacgagtcacgtactagtcgtacgtacgtaccgaacccgtacccgtacccgaacgtaacccgttaccgttccctacccgtaagaaccgtaggttacggttaacttacgtaaccggtacccggaccccggtaccgaaccgtaaccggaacccgggtacccgggttacggtttaacgtttaaccgttacggtacgggtaccggaacgggtaacgggtaaccgggttaccgggttttaccttttaaacgggtttaaccggacccgttaaacgggttaaaccgttttaaaaacccggttaaaaccctttacccggttaaaccgggttacccgggttacggttaccggggttacccgggttacccggggttaacccggggggacccggtaaaccgggggttaacccgtaaacccgggg

SEQ ID NO: 246743 - DNA, 932 bp, Homo sapiens
  misc_feature: GYAE6OF01D9QV9.9.70.G04.1.454.CMB.1.raw
tcagtgatacgtctcacgaccggtgctcgatttagtgtagtgtgaagggaaaggcctgtgaaggcttcactagtcctggacctcctgtgacaaagaacatagaaacatctgtgttacacttccctcctcgtggtgcagcctcccagtagtcggtcctgtcccgaggtgcggctgcgaggacggtccggaccaggactagtacgaacgtccttacaacgccggcccttcgtcccctacacctcgacctacgttcgttccttcgtggtacaccttaccgagtacgtaaggtcgggttcgttacccgtttacccgtaacggtcggtaccgtggtaaccgtcccggacgtaccggtcccgggaccggaggaaacggggtcgtagggtaacttaagttaggtacggaacttaactcgtagccggtacgtacgggtccggaccctactaacttacccgaacccgtaaccccgtccgtaagaaacggtcgtacgacgtacgacgtacgtacgttcgtaccgtacggtacccgtaacctaacccgtaaccgtaaccgtaaccgttccgttaccctaccgtagtaaccgttaaggttaacgttaactttaacgtaccggtaacccggtaccccggaccgaaccggtaaccggtaacccgggtacccgggttacggtttaacgttaaccgttaccgggttagggtacccggtaacgggtaacggttaaccgggtttaacccggttttaacggttttaaaccgggtttaacccggaaaccggtttaaaccggttaaaaacccggtttttaaaaaccgtttaaaacccccggttccggtttaaacccggttaaccgggtttacccgggttaacggttacccggggttaccgggggttaacccgggaacccggggtttaaacgggaaccccggtttaaacccggg

SEQ ID NO: 246744 - DNA, 607 bp, Homo sapiens
  misc_feature: GYAE6OF01BUYU4.9.70.G04.1.454.CMB.1.raw
  modified_base (341)..(341): a, c, t, g, unknown or other
  misc_feature (341)..(341): n is a, c, g, or t
  modified_base (488)..(488): a, c, t, g, unknown or other
  misc_feature (488)..(488): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcagaggtggtccgttcctacgtggacctggactcccggcacgtccggccggcgaagggactggagtatagtcggacgaatcgtatcgccgaggtcgggaccnccgataccctaaccgtaaccccgtccctacaaggtacgtcgagtcagctatgtcacgtccgactaccgtcccagaaccctagttcctcctacgacgagtagtagttatacgtcgacccgcgaccagacgacggcgttgtacttacgngtcgacgaggtacggacggttccgtttagttacggacctagtcgttaaacgttaaaccctcgtacgttacggtcgttacgggtaccgtcggtacgggaccgtaggggtaccctaacggg

SEQ ID NO: 246745 - DNA, 888 bp, Homo sapiens
  misc_feature: GYAE6OF01C5NO0.9.70.G04.1.454.CMB.1.raw
  modified_base (453)..(453): a, c, t, g, unknown or other
  misc_feature (453)..(453): n is a, c, g, or t
tcagtgatacgtctcacgaccggtgctcgatttagtgtagtgtgaagggaaagggcctgtgaaggcttcactagtcctggacctcctgtgcaaagaacatagaaacatctgtggttcactccctcctccgtggtgcacgcctcccagagtcgggtcctgtcccgaggtcgcggctgcgaggacgtccgggacccagggacctaggtgaacgtcccttcaacgacggcccctcgtcccctcacctgcctacttcgtcctcgtggacacctccaatcgaaggtcgggttcgttccgttacctacgttcggaacccgttggaccgtccggactaccggtccccggaccggaagaacgggtccgtaggaattaacgttagttacgggaactaactttcgagtcggaccgtagggtaccggaccctacgtacctaccaacccgtacccgtaccgtaanaaacggcgtaaccgtagacaactcgtacgtgtacctaacgtaccgaaccgtcccgtaacccgaaccggtaaaccttaccggttacccttaccccggtaggtaacccgtaaggttaaggttaaccgtttaacgtacgttacccgggaacccgacccgtacgaaccggaaaccccgttcggggttaccttaagggtttaaccttcgggttaacgacgggtaaccggtaagggtaaccgggttaccgggttttaaccggtttttaaccggtttaaaaaccggccgttaaacggttaacccgtttaaaaacccggtttaaaaaccccctttccggttaaaccggtttaacccgggtttccggttaaccggggttaccggtaacccgggggttaccggggaaacccccggggtaaaggggtaacccggttaaaccccggg

SEQ ID NO: 246746 - DNA, 1050 bp, Homo sapiens
  misc_feature: GYAE6OF01C0Q6Z.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcaggagtccgggcccaggactagtgaagccttcacacggccctgtccctcacctgcctactgtcctcgtggtcgtaccttccatcgaggtagggttcggttaccgttcctaacgtcgggacccttgggtaaccttcccgggacctacggtccccggaccggtaccgaaaggggtccttgggaagttaagtacggtttagggaaccgtaaattccgttaagtccggtaccccgtaaggggttccggggaacccccgtacctaacgtttaccccttaaaacccccgaacccccccggtttaccccttaaaccggaaaaggtaccgggttacccggtaacggttaccaaacggttacccgtaaggtttcggttaaccgaaccgggtttacccggaacccgtaaccccggtaacccccgtaaaccggtaaacccccgttaaccggttttacccccgtacccccgttaccggtaaaccggttaacgggtttaaccggttaaacggttttaacgttaaaccggtttacccgggaacccccgggtaccccggaacccggtaaacggtaaccccggtaacccgggggtttaccccggttttaacggtttaaccggttttaaccggttaccgggtacgggtaacccggggttaacggggtaaccgggtaccggggttttaacccggttttttaaacgggttttacccgggaaaccccgtttaagggtttaaacccgttttaaaaccgggttttaaaaaccccgtttaccccggtttaaaaccgggtttaccccggggttttacgttaccgggggttaaaccccgggtttacggggttacccggggggaaaccccggggtaaacgggggggtaaaccccttaaacccgggggg

SEQ ID NO: 246747 - DNA, 783 bp, Homo sapiens
  misc_feature: GYAE6OF01DSAJC.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacaggccctgtccctcacctcgactactcgtctcgtggtacgtacctaccacgtacgaggtacgggttcggttccgttacctacggtacggtaccgtaggtaccggtccggacgtaccggtcccggaccggaacggaacggtcgtaggtacgtaagttacggtacggtaaactacgttacgtacgccgacgtacgggtaccggaccgacctaccttaccgtaacccgtaccccgttcccaacgaacggtacgtacgacgtacgacgtactagtacgtacgtacgtaccgaccgtacccgtaaccgaaccgtaaccgttccttacccctccggaacgtaacggttggtaagtttaaacgtttctacgggtacccgaccccggtcgtaaccgaacggaaccggtcccgggttacgtttaacttaaacggttcgtcgggacgaagggaagtacgggttacccgtttaagttttaacggtaccgaaccgtagtttaaccgtttaaaaccttaaccgttacccgtacggttaccgggtagtacccgggtacggttccgggaaccgggaccgggtaaaggaccgttacccgg

SEQ ID NO: 246748 - DNA, 698 bp, Homo sapiens
  misc_feature: GYAE6OF01A6W5H.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctcgtggtcgacctccatcgaggtagggttcggttccgttccctacgtcgggacctggtactcccggcacggtccccggccggacgaagggactaggacgttaattagttacggaactaatctagtcgacccgtagggtccgggaccctaccaacgttccctaaacccgtaaacccccggttcccctaacgaaacggtacggttccgaaacggttacaacggcctaagttcggtaccgacggtaccgaacccgtacccgtacccaacgtaaccccgttacgtttcccctacccgtagtaaccgtaggttacgtaagtttactacggtccgacccgccgacacgacgtaccggtcgttagttacttacgtgtcgacgtaggagtacggtactttaaggttacgaccgtagtacttaagttaaacctcgtaacgtcgtgtacggtacgtcggacgggaccgagggacgtaacgg

SEQ ID NO: 246749 - DNA, 785 bp, Homo sapiens
  misc_feature: GYAE6OF01CV77S.9.70.G04.1.454.CMB.1.raw
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
tcagtgatacgtctcacgaccggtgctcgatttagtgtagtgtgaagggaaagggcctgtgaaggcttcactagtcctggacctcctgtgcaagaacatagaaacatctgtggttcatcctcctctggtgcagctcccagatcgggtcctgtccaggtgcggctgcgaggacgtccgggaccaggactagtcgaacgtccttcaacgcggccctcgtcccncaccgtncnctgtctgtggtcactcagtcgaggtacggttcgtccgttacctacgtcggaccgttaggacctccgggactacggcccggacggagaacgggtcgtaggtaacgttagtacgtacggaactacgtctaacgtcgacgtagggtcggacccactactaccgtacccgtaaacccgtcctaaacggaaggtacgtaccggtactacgacgtactagtccgggtaacgacggttaacccgacctacccggtaccgaaccgtaacgtccgttacctacgtagaaccgtaggtaccgttagtaaccttagacccggaaccgtccggacgaacgggtacccgaacccggggttacgtttacgttaaccgttcggtacgggtacgtaaacgggaacgggttacggttaccggtttaaaccgttttaggttaaacggacccgttaagttaaacccgtttaaaaccggttaaacccttccgttaaacgggttcccggttacggtaaccggggttaccgtttaccgggaccggggtacccgggtaaacgggtccgttaaacccgg

SEQ ID NO: 246750 - DNA, 666 bp, Homo sapiens
  misc_feature: GYAE6OF01EQTPD.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctccatcaggaggtggtcgttcctactggacctggatccggcaggtccgccggcaagggctgggagtatagttggacgaatctatgccaggtcgggaccgccatcctaaccaacccgtccctacaaagtcgtcgagtcagcatcgtcagtccgacaccgtcccaacgaaccctacgttcctaccctgacaggtagagttatagtcgacccgtccgacgaacgtaccgacgggtcccgttagttaacgttacgtggtaggtccgtaaggagggtaccgggttacccggttttaagtttaaccgggtaacctaaggttaccgtttaaaacggtttaaaaacccgtcccgttaaaccgttaccgggtttaccgttacgggtaaccggttccgggtacgggggaccccggtacgggggtaaccgtaaacccgggg

SEQ ID NO: 246751 - DNA, 744 bp, Homo sapiens
  misc_feature: GYAE6OF01B7XBW.9.70.G04.1.454.CMB.1.raw
  modified_base (439)..(439): a, c, t, g, unknown or other
  misc_feature (439)..(439): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagagtcgggtcctcgtcccagggtgcggctgcaggagtccgggcccaggactagtgaacgtccttcacgacggccctcgtccctcacctgcactgtctcgtggtcgactccatcgaggtggtcggttccgttcctacgtcggaccgtgggacctcccggcgtaccggtccccgggacggacggaaacggggtcgtagggtaacgtaagttagttacgggaactaacttctagtccgaaccgaggggtccgggacccgactactacccgtaacctaccccgtcctaacgaaaggtcgtacgnggtaccaacgctaagtcgtaccgtaacgtaccgaccgtaacccgtacccaacgtaacccgttacgttaccctacccgttagaccgtaacggtaacgttaagttacgtacgtaccgtacccgacgtaccgaacgtaaccggtaccgtacggttaacgttacgtttcggtacggtacggacggtaacgtacgggtaccgttaccggtttaagttaccggaccgttaacgtacgtttaaactaaacccgttacgtaaccgtaccggttgtacggtcggtacggacgggacctacggggacctaaccgg

SEQ ID NO: 246752 - DNA, 943 bp, Homo sapiens
  misc_feature: GYAE6OF01CM7IA.9.70.G04.1.454.CMB.1.raw
  modified_base (205)..(205): a, c, t, g, unknown or other
  misc_feature (205)..(205): n is a, c, g, or t
  modified_base (537)..(537): a, c, t, g, unknown or other
  misc_feature (537)..(537): n is a, c, g, or t
  modified_base (623)..(623): a, c, t, g, unknown or other
  misc_feature (623)..(623): n is a, c, g, or t
  modified_base (647)..(647): a, c, t, g, unknown or other
  misc_feature (647)..(647): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccccagattcggggtcctcgtcccaggtgcggctgcgaggagtccgggcccaggactagtgaagccttnacgaggccctcgtccctcactgcactgtctcgtggtcactccatcgaaggtggtggttccttacccgtacttcggactcgggtacgtcccggacacggtcccggaccggacggtaacgggggtacctaggggttaagtaacgttacggttacgggaaaccgtaacgttaccttacgttacggacccgttaaggggtaccggggaaccctacccgtaacttacccgttaaaccccgaacccccggttcccccttaaaggaaaaccggtacggtaccggttaacgtacgaaacggccgttaaacgtcggttaacgaccggtaccggtaaacccncccgggttacccgaaacggtaaaccccttacgggtttcccctacccgtacggggtaaacctaaggtttaacggttaactttttaanaaccggaccgggttaaaccccccnccggaacccggtaaacggaaccccggtaaccgggggtttaccgtttaaacgggtttaaccctttaaccggtttagggaccggttaaacccgaagggttaaccgggttacgggtttaccctttttaaaacgggtttacggaaaccccgtggtttaaaacccggttaaaacttttaaaaacccgttcccccgttaaagggttttcccgggaacccgttttagggggaaccccggtttttacgggaaccccggggggggttaaacctaacccggggggtaaacccgtttaaacccgggg

SEQ ID NO: 246753 - DNA, 795 bp, Homo sapiens
  misc_feature: GYAE6OF01ANYTZ.9.70.G04.1.454.CMB.1.raw
  modified_base (233)..(233): a, c, t, g, unknown or other
  misc_feature (233)..(233): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnacctccatcgaggaggttcggtccgtttcctacgtgggacctgggtacttcccgggctaacggtcccggaccgggacgaaaacggggtcctaggggtaattagtacgttacggaacgaatttcgtaagtcgaccgtaagggtcgggaaccccgcctaacgtcctaacccaaaccccggttccctaacgaaacggtcgtaccggaacgttcccgaggtaccctaagttcggttaccaacggttacccgaaacccgtacccggttaccccgaaacggtaaacccgttcgtttaaccccgtccccgttaacgaccgttaacggttacgtaaacgtttactaacggtaccgaaccccggccggaccgaacggtaccgaccgggtaccttaggtttaactccgttagggtacgaccggtaaggtacgggtacgggttaccgttttaagtttaccgggaacctaacggtacgtttaaacgttaaaaccgttccgttaaacggttaacggtccgttacggtacccgggtacggttacgggggaccgtaacggggtacccgtaaaccggg

SEQ ID NO: 246754 - DNA, 567 bp, Homo sapiens
  misc_feature: GYAE6OF01EY9OR.9.70.G04.1.454.CMB.1.raw
  modified_base (355)..(355): a, c, t, g, unknown or other
  misc_feature (355)..(355): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccatgactagtgaagccttcacaggccctgtccctcacctgccactgtctctggtgactccatcagaggtggtcgttcctactggacctggatccggcagtccgcggcaagggctgggatatattggacgaatctatgccagtgggaccgccatcctaacaaccccgtcctacaagngtacgatcagcatgcagtcacacgccagaccattctccctagacagtgagttatatcgaccgccgacacgacacggccgttagtattacgtgtgacggagaggtacggtaccgtttagtttacggaccgagtacttaagtttaaaaaccttccgttaaccgtacggttcgtacgggtaccgtacggtcggggacccgtaagggggaaacccg

SEQ ID NO: 246755 - DNA, 747 bp, Homo sapiens
  misc_feature: GYAE6OF01DESLY.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcgaggagtccgggccaggctagtgaacgccttcacacggccctcgtccctcacctgcctactcgtctcgtggtcacctccatcgaggtaggttcgttccgttccgtacgtcggaccgttggacgttcccggctacggtcccggaccggacgtaaacggggtcgtagggtaacgttaagttaggtttacgggaaaccgtaaattccgttaagtccggacccgtagggtaccggggaccccacctaactacccttaaacccgaacccccggttccctaacgaaaacggtccggttaccgaagttaccgaacgtactagttcggtaccgtagttacccgaaccgtacccgtacccgaacgtaacccttacgttccctaccctacgacgtaacggttagttacgttactaacgtccggacccgcgaccgtacggaaccgtaccggtcgtagttacttacgtgtacggacgaggtacggtacggttacgtttaacgtttacggacctagtaacgtttaaacgtaaaccttacgtaccgtacggttgtacggtcgtacggtacgggacggtacgggaacgtaccgg

SEQ ID NO: 246756 - DNA, 736 bp, Homo sapiens
  misc_feature: GYAE6OF01ECE9Z.9.70.G04.1.454.CMB.1.raw
  modified_base (388)..(388): a, c, t, g, unknown or other
  misc_feature (388)..(388): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcgaggaggtccgggcccaggactagtgaacgtccttacacgacggcccctcgtcccctcaccgtgcctactgtcctcgtggtcacctccatcgaggtacgggttcggttccgttacctacgtcggtaccgtgggactccggacacggtcccgccggacgaagggtcgtggtaagtattaggttaggaacgtaactctagtccgacgtagggtccgggacccnctactaccctaacccgtaaccccgtcctaagaacggtacggtacgacgtcgacgctagttcggtactaacggtacccgacctacccgtacccgaaacgtaaccctcgtttccctacccgtagaacgtaggtacgtaagttactacgaccggacccgtccgaacgaacgaccggtaccgggtcgtttataacgttacgtgggtacggacggtaaggtacgggttacggtttaccgttttaaaggttaccggaacctaacggttaccttaaaacgttaaacccttcgtaaccggttacggtcgtacgggtaccggtacgggtacggggacccgtaagggacccgtaacgg

SEQ ID NO: 246757 - DNA, 763 bp, Homo sapiens
  misc_feature: GYAE6OF01BRV9H.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcgaggaggtccggccaggactagtgaacgtccttcacgacggtccctcgtccctcacctgctactgtctcgtggtcgcctaccatcgaggtagggttcggttccgttaccgttacgtcggtacccgtgggaccgtcccggacgtaccggtcccggaccgggacggaacggggtacgttagggtaagttaagttacggttacgggaaccgtaattccgtaacgtccggtacccgtagggtaccgggaaccctaccgtaacgttacccgtaacccgtaacccccgttcccgtaaccgtaaacggtacggtacggtacgtccgaagtactacgtacgtaccgtacggtacccgaaccgtacccgtacccgaaacgtaacccttaccgtttccctacccgtaggtaaccgttaagtttacgtaactacgtccgaccccgcgtacgacgaccgtacgggtctagttctacgtggacgtggtaagacggtacggtttaccttaggttacccggaacttaggtaactttaaacgttaaaccctcgttaacggttacggtcgtacggtacgtccgggtacgggacgacgggtacctggtaccccg

SEQ ID NO: 246758 - DNA, 602 bp, Homo sapiens
  misc_feature: GYAE6OF01EXXJC.9.70.G04.1.454.CMB.1.raw
  modified_base (234)..(234): a, c, t, g, unknown or other
  misc_feature (234)..(234): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtnactccatcagaggttcggtcgttcctacgtcggacctggactccggcacgtcccgccggacgaaggggtctgggaagttatagttcgggaacgtaatcgtatgccaggtcgggaccncatcctaccaaccccgtcctanaagcgtcgagtcagctatcgtacacgtacgaactaccgtacccgaacgtaacctacgttccctaccctgaactagtgtaagttatatcgactcggccgacacgacgacggtccgttagtacttacgtgtacggcgaggaggtacggtcgtttagtttacgactagtcgtaattaaaccgtccttaacgtacgtcgtacggtacgtacgtcggggtcgacggggtaaccg

SEQ ID NO: 246759 - DNA, 710 bp, Homo sapiens
  misc_feature: GYAE6OF01EN3Z5.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcgaggaggtcgggcccaggactagtgaagccttcacacggccctgtcccctcacctgcactgtctctggtgactccatcgagtacggtgtcgttcctacgtcggtacctggtacgtccggcacggtccggccggcgaagggctggaacgtattaggttaggaacaatcgtatcgaccgtaggtcggaccgtccagtcctaaccgtaccccggtcctagaacgtacgtcgagtccgagctagtcgtcacgttccgaactaccgtcccgaacgaacccttacggttcccttacccgtcggaacgtacgggttacgtaaagtttaccgtaacgtccggaaccccggtccgtaacgaccggtaacccggccggtacccggttagtttaaccgttccgtaggtccggaacggtacgaaggtccgggtttacgtttaacgtttaaccgggaccgtaggtaaccgtttaacggtttaaaaccctccgttaacgtaccggttcgttacgggacgttcgggtacggggacgtaaccggggtaccgtaaccggg

SEQ ID NO: 246760 - DNA, 707 bp, Homo sapiens
  misc_feature: GYAE6OF01BX7NW.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccggccaggactagtgaagccttcacgaggccctgtccctcacctgcactgtctcgtggtcgactccatcaggtggttggtccgttcctacgtcggacctggaccgtccggactacggtccggccgggacgaaacggggcttaggggaagttagttagtttacgggaacgtaacttcgtaatcggacccgtaagggtccgggaacccgacctaacttaccgtaaaccccgaaccccgttccctaacggaaggtaacggtcgaacgtacaggtccaagttcgtacgacggttaccgaaccgtacccgtaacctaaccgtaaacccgtacgtttaccctacccgtagtaaccgtaggtacgtaagtttactacgtacggacccgtccgacgacggacgtaccggtcgtacgttactcgtcgtacgtacggagtacggtacgttacggtttagttaccggactagtacgttaacgttaaactccgttacgtacggtactacggtacgtcggtacgggaccgtacgggaccgtaacgg

SEQ ID NO: 246761 - DNA, 683 bp, Homo sapiens
  misc_feature: GYAE6OF01A3C3J.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctagtggacctggactccggcacgtccgccggacgaagggctggatatagttaggacgaatctagtgccgaggtcgggacccgacctagtacctaaccaacccgtccctaacgaaacgtagtcgacgtcaagctatcgtacacgtaccgactaccgtacccgaacgaaacctacgttccctacccgtagaaccgtaaggttagtaacgtttagtaacgtccggaacccgtcccgacgaccgtaccgtaccgggtacccgttagttaacctttacggtcggttacggaccggtaagaaccgggtacggttacccgtttaaggtttaacccggaccgtaacgttacgttaaacgtttaaaaccctccgttaaacggtaccgttcgtacggtacgttcgggtagggacccggaaggggtacccgtaaacggg

SEQ ID NO: 246762 - DNA, 651 bp, Homo sapiens
  misc_feature: GYAE6OF01BUJFZ.9.70.G04.1.454.CMB.1.raw
  modified_base (233)..(233): a, c, t, g, unknown or other
  misc_feature (233)..(233): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctacactgtctctggtnactccatcagaggtgtcttcctactggacctggactccggcagtccgcggtcaagggtctggatatagttggaccaatctaatcgcctagtgggacccgccattctaaccaaccccggtcctacgaagacgtccgagtcaggccaagtcgtacagtccgaacctacggtacccaacgtaaccctacgttcctacccgtagactaggtagtaagttaatacgtacggacccgcccgtacgacgacgaccgggtaccgtagttaacttacgtgttacggacgtaaggtacggtacggtacccgtttaagttttacggacctagtaccttaaacgttaaaacctcccgttaaaccgttcggtaccgttacgggtaccgtacggtacggggaccgaacggggaacccgtaacgggtaccccg

SEQ ID NO: 246763 - DNA, 571 bp, Homo sapiens
  misc_feature: GYAE6OF01D8HZ1.9.70.G04.1.454.CMB.1.raw
  modified_base (246)..(246): a, c, t, g, unknown or other
  misc_feature (246)..(246): n is a, c, g, or t
  modified_base (359)..(359): a, c, t, g, unknown or other
  misc_feature (359)..(359): n is a, c, g, or t
  modified_base (474)..(474): a, c, t, g, unknown or other
  misc_feature (474)..(474): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggtttcatcctcctcctggtggcagctcccagatgggtcctgtcccaggtgcggctgcaggagtcgggcccaggactagtgaagccttcacaggccctgtccctcacctgccactgtctctggtgactccatcagnggtgtcttctactggacctggatccggcacggtccgccggcaaagggtctggagtattagttggaacgtaatctatcgccaggtcgggaccgcatcctaccaacccgtcctanaagtcgtcgagtcagcatcgtcagtcacacgtccaagtaccacgttctcctagacagtgtacgttatacgtcgaccgcgacagaccgacggtcgtagtacttactggtagcgagngacggtacgttatttaacggactacgtacgttaacgtaaaacctccgtaacgttacgtcgtacggtcgtacggtcgggaccgagggtccgtaaccgg

SEQ ID NO: 246764 - DNA, 681 bp, Homo sapiens
  misc_feature: GYAE6OF01CWBLY.9.70.G04.1.454.CMB.1.raw
  modified_base (305)..(305): a, c, t, g, unknown or other
  misc_feature (305)..(305): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctctggtggcagctcccagattgggtcctgtcccgaggtgcggctgcaggacgtcggccaggactagtagaacgtccttcgacgaggccctcgtccctacacctgcaccgtgttcctgtggtacgacctcattcgagtagggttcgtcgttaccagttcggacctggactcggcagtccgcgngaaggctggatactgtaggacaagtctagcgacgtaggcggaacctcaataccgtaacctacccgtctaacgaaaggcgtacgaagtcgaacgcgtagttcgacgtaaggtacgaccaaccgtaccaacgtaacctacgttctacccgtagacgtacgtaggtaattacgtacgtacgacgccgtacgaacgaacgtacgtaccgttataacgttacgtaacgtcgaacggacgtaacggtacgggttaacggtttaaacgtttacggaaccgttaacgaacgtttaaaccgttaaaaccgttcctaacgttaaccggtcgtttaacggtccggttacggtaccgggaacggtaaccggggtaacgttaacccggg

SEQ ID NO: 246765 - DNA, 746 bp, Homo sapiens
  misc_feature: GYAE6OF01BXUZM.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaacgccttcacacggccctcgtccctcacctgcactgtctctgtgactccatcagtaggtgtcgttccacgtcggacctggactccggacacggtccgacccggagtaacgggactggaattacgtagttgggaaccgtaagttcctaagtcgaccgtagggtacggggtaccctcctaagttacccgtaaacctaaccccgttccccgtacgaaaaggtccggttaccgaaggttaccgacgcgtaacgttcgaccgtaaggtccgaacccgaaccggttacccaacgtaaccccgtaacgttccctaccccgttagaacctaggttacgtaacgtttactacgttacggaccccgtaccgacgaccgaaccgtaccggtcgtacgttacgttacgtcggttacggaccggaagtacgggtacggtttaccgtttaaggttttaaccggacctaacggtaccgtttaacggttaaaacctcccgtttaaccgtaaccgggttcgttacgggtacgttcggtaacgggggtcctaaaccgggggaccgtaaaccggg

SEQ ID NO: 246766 - DNA, 692 bp, Homo sapiens
  misc_feature: GYAE6OF01CMXET.9.70.G04.1.454.CMB.1.raw
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (281)..(281): a, c, t, g, unknown or other
  misc_feature (281)..(281): n is a, c, g, or t
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
tcagtgatacgtctcacgaccggtgctcgatttagtgtagtgtgaagggaagggcctggtgaaggcttcactaggtcctggacctcctgtgcaagaacatgaaacatctgtggttcactcctcctctcggtggcagctcccagatgggtcctgtcccaggtcgccggctgcaggacgccggccaggacctagtgacgccttcanacggcctagccctcacctgacnctgtctcgtagngactcatcaggngtacgtcgtcctacgtggacctggaatccgngacgtccgcggacaagggcttagggactatagttcggaactaatctaanggaccaggtcggacccnctaactcgtaacgaacccctccaagaaggctcgggacttcaggtctatcgtaacagtccgaactccgtaccgaacgtaaccgtacgttcgtaccctaggtaaccgtaacggtacggtaaggttaactaacggttacggaaaccccggtcgtaaccggaacccgttaacgaacccgggttaccggttacgtaaacgttccggtagggttaccggacgggtaacgtaacgggtacggttacccggtttaaagttttaccgggaccgttaaggtacgtaaccgttaaacgaccttacggtacgtacggtcggacgttacgtaccgggcgtaccgggaccgtaaccggg

SEQ ID NO: 246767 - DNA, 931 bp, Homo sapiens
  misc_feature: GYAE6OF01EFUXM.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatggtcctgtcccaggtgcggctgcgaggagtcgggcccaggactagtgaacgccttcacgacggccctgtccctcacctgcactgtctcgtggtctacctccatcgaggtaggtcggttaccgttccctacgtacgggtacctcggtacctccgggctacggtcccggccggtagaacgggtcgtaggacgttagtagttacggaacgtaatcgtaagtcgtacgtacgggtacggacccgtacctaccttacccgtaaaccctaaccccgttcccgtaacgaaaggtcgtaccggtagtacgacggtcctaaggtcgttaactaccggtaccgtaacctaaccccgggttaaccccgaaacggttaaaccctaccgttttacccctacccccggttaaaggtaccttaacgggttaaaggttttaccgttaaccgggttaaccgttcccgggaacccccggtacggaacccgttaacgggaaccccgggtacccggggtttcccgtttaaacgggtttaaccgtttacccggttagggtaaccgggtaacccgggaaggggttaaccgggttacccgggtttaaacccgggtttttttaacgggttttaaaccccgggaaaccgtttaaacgggttaaccccccgtttttaaaaaaacgggttttaaacccccgttacccggtttaaaccggggtttaaccggggttacccttaccgggggttaaccgggttaaccggggtaccccggggacccggggttaaaccggggtaaccgttaacccccgggg

SEQ ID NO: 246768 - DNA, 668 bp, Homo sapiens
  misc_feature: GYAE6OF01DA0C3.9.70.G04.1.454.CMB.1.raw
  modified_base (246)..(246): a, c, t, g, unknown or other
  misc_feature (246)..(246): n is a, c, g, or t
  modified_base (374)..(374): a, c, t, g, unknown or other
  misc_feature (374)..(374): n is a, c, g, or t
  modified_base (390)..(390): a, c, t, g, unknown or other
  misc_feature (390)..(390): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtgcagctcccagatgggtcctgtcccaggtgcggctgcaggagtccgggcccaggactagtgaacgtccttcaacgacggccctcgtcccctcacctgcctatcgtcctcgtggtanaacctcatcgaggtaggtcgttccgttcctaacgtcggaccctggactcccggactacgtccggaccggataagggctaggatatagtggaactaatctatcgacaggtcggcccactactctaaccncccgttccagaaacgngtacgaagtcaagtctaagttcgacgtagtcccgaactacccgtacccaacgaaccgtacgttcccgtcctacggtacgtaagttagtaacgttaacgtacgtaccgaccccgccgacgtaaccgaaccggaccggtccgtaagttacgttacgtggtacgacgtaggtacggacggttaccgtttagttaacggacctacggtacttaaacggtaaacccttcgtaaccgtacggttcgacggtccgtacggtcgggaccgagggtacctaaccggg

SEQ ID NO: 246769 - DNA, 723 bp, Homo sapiens
  misc_feature: GYAE6OF01A92BN.9.70.G04.1.454.CMB.1.raw
  modified_base (372)..(372): a, c, t, g, unknown or other
  misc_feature (372)..(372): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatccctcctcctggtggcagctcccagatgggtcctgtcccaggtgcggctgcgaggaggtccgggcccaggactagtgaacgccttcacacggccctcgtccctcacctgccactgtcctcgtggtcgacctccatcgaggtaggtcggttccgttacctacgtcggaccgtggacgtccggcgtacggtccggccggacgaagggcgtaggtagtatagtacggacgtaatcgtactgacctagggtcggacccncctactactaccaaccttccgtacctacgaagtacggtcgtacgtcgaacgcgtagtcgtaccacgtaccgaacgtacccgtacccgaacgtaacccttacggtttcccctaccccgtagtaacctagggttacggttaagtttaactaccggtaccggtaccccggtcccggaacaacgggtaacccgtaccgggttcccgttaagttaacccgttacgtcgggttacgaacggtaaggacggtaacggttaccgtttaggttaaacccgaacgtacgtaccgttaacgttaaacctccgtacgttacggtctacgggtacgtaccgggtcgggacccggtagggtaacc

SEQ ID NO: 246770 - DNA, 890 bp, Homo sapiens
  misc_feature: GYAE6OF01CN6RZ.9.70.G04.1.454.CMB.1.raw
  modified_base (825)..(825): a, c, t, g, unknown or other
  misc_feature (825)..(825): n is a, c, g, or t
tcagtgatacgtctcacgaccggtgctcgatttagtgtagtgtgaagggaaagggcctgtgaaggcttcactagtcctggacctcctgtgcaaagaacatagaaacatctgtggttcatccctcctcctgggtggcacgcctcccgagagtcgggtcctcgtcccagggtcgcggctgcgaggtcggtccgggccgaggactaggtagaagtccttacaacgccggtccctccgtcccctcaccctgacctacgttcgttccgttcgttacggtacgtacctacctacgtacgagggttacggggttccggtttcccgtttacccgtaacggtccgggtacccgttacggggtaacccgtcccggtacggtacccggtcccccgggaccggaacgggtaacggggtacgtaggggacgtttaagtaggttacgggaaactaacttcgtagtccggacggtacgggtcccgggaacctaccgtactacctaaccccgcccgtaccgtaagaacgtacggtctacgctatccgagtcggtaccgtagcccgaacccgtcccgtaacccgtaacgtaacccgtcttccccgtaccgaagttaccgtagttaaacgtacggttacttaacccgccggtacccgccgtaaccgtaacgtcccgggtaccgttacccgtttgtaaaccgtttcggtacggggtacggacgggtaacgtacggggtttaacccttttaacggtttaaccgggttaaacaccccggttaaattttaaacccggtttaaaaaccgttaaaccgttttcccggaacccggttacggggtttaccncgggggttaaacccgtccggggggtaaaccggttacccgggaaacggggtacccggttaaacccg

SEQ ID NO: 246771 - DNA, 935 bp, Homo sapiens
  misc_feature: GYAE6OF01B6ANW.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggacgtcgggcccaggactagtgaacgccttcacacggccctcgtccctcacctgctactcgtctctggtactacctccatccgaggtacgggttcggtccgtttacctacgtcgggtacccctggggaactttcccgggccgtacggttcccccggacccggggacgtaaaacgggggtaccttgggggtaacgtttaacgtttaaggtttacggggaaccggtaaaattccgtttaaagttcggccccgtaaaggggttccggggaacccccgtaccctaaacgtttaccccgtaaaccccgtaaaccccccggtttccccctaaacggtaaaacggtaccggtttaccggaaacgttccaacggtacctagttaccggttacgtaaccgggtaccccgaacctaccccgggttaccccgaaacggtaaacccgttacgtttccctaccccgtacgtaaaccgtttaaggtttaacgtttactacgttaccgggtaccccgaccgtacgtacggtaacccggtaccggttaccggtttacgttaacgttaacgttcggggtacggtaccggtaagggtaacggttaacgggttaacccgtttttaacgggtttaaaccggtaacccttaaacgggttaaacctttaaaaccggtttaaaaaccctttaccccggttaacgttacccggggttacttaccggggtaccggtttccgggtaccgggggacccgtaaggggggtaaacccccgtacggggttaaccccg

SEQ ID NO: 246772 - DNA, 710 bp, Homo sapiens
  misc_feature: GYAE6OF01C2EWG.9.70.G04.1.454.CMB.1.raw
  modified_base (385)..(385): a, c, t, g, unknown or other
  misc_feature (385)..(385): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcgaggaggtccgggcccaggactagtgaacgtcccttcacgacggcccctcgtcccctcacctgccactcgtctcgtggtcgtacctccatcgaggtcggttcggttccgtttccctaacgtcggaccgtggacgtcccggctacggtccccggccggacgaagggtacctggtaattatagttaggaactaatctagtcgaccgtaggtcgggacccncactacctaaccgtaccccgtcctacgaaaggcgtacgacgtcgagtacctagttcgtacgacgttaccgaaccgtcccgtacccaacggtaacccttaccgttccctacccgtgtaacgtagttagtaacgtttactacgtacgacccgccgacgaacgaccgtacgggtcgttaagttacgttacgtcggtcgacggaacggtaggtaccggttaccgttttaaggttaccgaaccgtagtaaccttaaacgttaaaacctccgttaacgtaccggtacgtacggtaccgtcggtaccgggaccgaacgggtaccgtaaccgg

SEQ ID NO: 246773 - DNA, 878 bp, Homo sapiens
  misc_feature: GYAE6OF01C1GO4.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcaggagtcgggccaggactagtgaagccttcacacggccctgtccctcacctgcactgtctctggtcacctccatcgaggtaggtggttccgttcctacgtcggacctggactccggcacggtcccgcggcgaacgggctggatatagttaggaacgtaatctagtcgaccgtaggtcgggacccaccgtaactacctaacccgtaaccccgtcccctaacgaaacggtacggtaccgtaacggttccgaacggtcctaagttcggtaccgtaacggtacccgaaccgtaacccgggtaacccctaacggtaaaccccgttaacgtttcccccgtaccccgttacggtaaccgtaacgggttacggttaacgttttaacgtaaccgttacccgggaaccccggtccccggaaccgtaaccggacccgggtaacccgggtacccggtttaaggtttaaccgtttaccgtcggggttacggaaccgggtaagggtaaccggttaccgggtttaaccggtttttaaaccggttttaaccgggaaacccgttaacggttaacccgttttaaaaaccggtttaaaaaaccccgttccccggtttaaaaccgggttacccggggtttaacccggttcgggggttaaccccggtttaccgggggtacccgggggaaacccgggttaaccggggggtaaacccccggttaaacccgggg

SEQ ID NO: 246774 - DNA, 621 bp, Homo sapiens
  misc_feature: GYAE6OF01BRX95.9.70.G04.1.454.CMB.1.raw
  modified_base (110)..(110): a, c, t, g, unknown or other
  misc_feature (110)..(110): n is a, c, g, or t
  modified_base (133)..(133): a, c, t, g, unknown or other
  misc_feature (133)..(133): n is a, c, g, or t
  modified_base (227)..(227): a, c, t, g, unknown or other
  misc_feature (227)..(227): n is a, c, g, or t
  modified_base (261)..(261): a, c, t, g, unknown or other
  misc_feature (261)..(261): n is a, c, g, or t
tcagtgatacgtctcacgaccggtgctcgatttagtgtagtgtgaagggaaaggggccgtgtgaagggcttcactagtcctggaccgtcctgtgcaagaacatgaaaccntctgtgttccatcctcctctggngcagctcccagatcgggtcctgtcccagttgcggctgcacggacgtccggggacccaggacttaggtcgaagccttacgacaggccctgccctnacctgctactgtctctggtacaactcatctaggnggttcggtcttccagtggacctggactccggcaggtccgcggacaagggctaggacgtatagtggaacgatctagtcgctaggtggacccgctagtcctaaccgaccccgtcctacaaaggcgtacgacggtcaggctagtcgtacaagtccgactaccgtccgacgaacgtctcctctagacagtagtacgttatacgtacgccgacgacgagacgacgtcgtagtacttacgtggtcggacgaggtacggacggtacccgttagtttaccggacgtaacgtacgttaacgttaaaccgtcgtacgtacggttacgtaccggtacgtccggtacgggtccgaacgggtccgtaacccgg

SEQ ID NO: 246775 - DNA, 703 bp, Homo sapiens
  misc_feature: GYAE6OF01CCJFQ.9.70.G04.1.454.CMB.1.raw
  modified_base (235)..(235): a, c, t, g, unknown or other
  misc_feature (235)..(235): n is a, c, g, or t
  modified_base (486)..(486): a, c, t, g, unknown or other
  misc_feature (486)..(486): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccaggactagtgaagccttcacacggccctgtcccctcacctgccactgtctctggtnacctccatcaggtaggtcggtccgttcctacgtcggacctggactccggcacggtcccgccggacgaacgggctgggattagttagttacggacgtaattcgtagtcgaccgtagggtcgggacccaccgtacttaccgtaacccgaaaccccgtccctaacgtaaaggacgtacggacgtcgagtacgtagtacggtaccgaaggtcccgaaccgtacccgtaccccgaacgtaacccgtactttccccncccgttagacgtagttagtaacgtttataccgaccggacccgtccgactaacggaccgtccgggtcgttacgttaacttacggtcgtcggacgaggtacggtacgggttacctttaaggttacgggaacctagtacgttaaacggttaaaccctcggttaccgttaacgggtcctcgggtaccggttggtaccggggacgaaccgggtactaacggg

SEQ ID NO: 246776 - DNA, 644 bp, Homo sapiens
  misc_feature: GYAE6OF01ET2E0.9.70.G04.1.454.CMB.1.raw
  modified_base (507)..(507): a, c, t, g, unknown or other
  misc_feature (507)..(507): n is a, c, g, or t
tcagtgatacgtctcacgaccggtgctcgattttagtgtagtgtgaagggaaagggcctgtgaaggctttcactagtcctggtacctcctgtgcaagaacatgaaacatctgtggttcatccgtcctcctgggtcggcagcgtccccagagtgggtcctgtcccaggtgcggctgcgaggacgtcgggcccaaggactagtgaagccttcacgacggccctgtccctcacctgcactgtctcgtggcacctcatcagtggtggtcttccgtagtgacctggactccggcagtccgccggagaagggtctggagtatagtggaacgtaatctagtcgccaggtcgggacctcgatacctaccgaacccgtcctagagacgtcgagtacagctatggtacagtccgacgaccgtaccaagtaacccgtcgttcctcccgtagaaccgtagttagtaacgtttatcgtaccggaccgccgacacggacgtccggacttagtaacttacgngtacgtacgaaggacggtacggttccgttttaacgttacggactaacgtaccgttaaacgttaaaaccctcccgttaaggttaacccgtgtacggggtaaccttccgggacgggaccgaacgggtaccctaaacggg

SEQ ID NO: 246777 - DNA, 1007 bp, Homo sapiens
  misc_feature: GYAE6OF01EDF5B.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctcgtccctcacctgcactgtctcgtggtcgactccatcgagtaggtgttcgttcctacgtcggaccgtggactccggctacggtcccggaccggacgaacggggtaccgtagggtaagttaagttaaggttacgggaaccgtaaagttaccgttaagttccggaccccgtaaggggttaccgggggaaccccgtacccgtaacgttaccccgttaaaccccgtaaacccccggtttcccctaaacccggtaaaacgggtaacccggttaccgggtaacggttacccggaaacggacccgttaacgttacgggtacccgtaacggttaccccggaacccgtaacccgttacccccgaaaacggttaaaacccccgttacgggttttaccccctacccccggttaacggtaacccggtaagggttacggttaaacggttttaacgtttaacccgggttaccccgggtaaacccgggtccccggaacccgtaaaccgggtaaccccgggtaacccggggtttacccggtttaacggttttaaccgtttaaccggttacgggtttacgggaaccgggtaaaccgggtaacggggttaaccgggtttaacccggttttttaaacgggtttttaaaccgggaacccgtaacggtttaaaccggttttaaaaccgtttaaaaaacccgttccccgtttaaaacgggttaccccgggttacggtttaacccggggttaaccgggtttaccggggtaaccgggggtaaccccggggttaaacggggggtaaccccggttaaaccccgggg

SEQ ID NO: 246778 - DNA, 748 bp, Homo sapiens
  misc_feature: GYAE6OF01AWS3G.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtcgactccatcgagtaggttggtcgttcctacgtggacctggactccggcacgtcccggccggacgaagggcgtgggagttaagttagttacggaacgtaattctagtcggtacccgagggttaccgggacccgcctaacgttaccctaaacccgaaaccccggttccctacgaaacggacggttccgaacggttacacggtacctagttcggtacctaaggtacccgaccgtaaccgttaccccgaacggtaaacccctacggttttacccctccccgttaagtaaaccgtagggttaacgttaacgtttaacgtacgttaccgggacccgacccggaacaacgggacccgtaacccgggtccgttaagttaacctttacgtcggtacgtacggagtaacggtcggttaccgtttaaggtttaccggacctacgtacgttaaacgttaaaacctcccggttaacgttacggttcgacgggtacgtcggtagggcccgtaaggggaccgtaaccgg

SEQ ID NO: 246779 - DNA, 792 bp, Homo sapiens
  misc_feature: GYAE6OF01DZCW8.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtgattcatcctcctctggtggcagctccagatgggtcctgtcccaggtgcggctgcaggagtccgggcccaggactagtagaacgtccttacacgacggcccctcgtcccctcacctgccacttcgtctcgtggtcacctccatcaggtaggttggttccttcctacgtcggaccgtggacctccggacaccggtccgccggacgtaaacgggtcgttggtaagttactaaggtttacggaacgttaacttcgttaagacggtacccgtaagggttccggggaacccctaccgttaactaccctaaaccccgtaacccccggttccctaacggtaaacggtacggtacggtaaacgtccgaacgactacgttcggtaaccgtaacggtaccgaaccgtaacccgttaccccgaaacgtaacccgttaccgtttccctacccggtagaaccgttaggttacgttaagttactaccgtacccggaccccgaccggtacgaaccgacccgggtacgggttccgtttaagtttaactttacgggtcgtacggaccgaaggtacggtacggtttaccgtttaagttaccggaccgtacggttaccttaaaacggtttaaaccctccgttaaaccgttaggtcccgttacggtaccgttacgggacgggtaccggtcgggtaaacccg

SEQ ID NO: 246780 - DNA, 1121 bp, Homo sapiens
  misc_feature: GYAE6OF01BCE5E.9.70.G04.1.454.CMB.1.raw
tcagtgatacgtctcacgaccggtgctcgatttagtgtagtgtgaagggaaagggcctgtgaaggcttccctagtcctggacctcctgtgcaagaacatgaaacatctgtggttcatcctcctcctggtggcagctcccagatgggtcctgtccaggtgcggctgcaggagtccgggccaggactagtgaagtccttcacgcggtccctgtcccctcacctgcctactcgttctcgtagggtcaccttccatccgaggtacgggttcggttccgtttacctacgtcggacctgggacgtcccgggacacggtcccggccggacgaaacgggtcgtaggggaagtttaacgttaggtttacgggaaccgtaaatttccgtaagtccgggtaccgtaaggggttcccggggaaccccgtacctaacgtttaccccgtaaaccccgtaacccccggtttacccttacggaaaacggtacgggttacccgtaaggtacccgaacggtaccgttaaacgttaccggggtaccctaaacggttaaccccggaaaacccccgtaacccgggttaaccccccgtaaaaccgggttaaaccccccgtttaccgggttttacccccgttaccccccgttaaacgggtaaacccggtaacggggttttaacgggtaaaaccggttttttaaccgtaaaccgggttacccgggaaaccccccggtaccccggtaaacgtaaacccggggtaaccccgggtaacccggggtttacccggttttaagggtttaaaccctttttaccggggttaacggggttaccgggtaacccggggtaaacggggttaaacccggggtttaacccgggttttaaacccgggttttttaaaccgggttaaacccggggtaaaaccccgtttaacgggtttaaaacccccggttttttaaaaaaccggggtttaaaaaaaccccccttttccccggggttttaaaaacccgggttttaccccgggggttttaacggttacccggggggtttaaaccccgggttcccggggggttaaacccggggggtaacccccgggtaaacccggggggttaaacccggtttaaaccccggggttaaccccccgg

SEQ ID NO: 246781 - DNA, 724 bp, Homo sapiens
  misc_feature: GYAE6OF01EVPQ0.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcgaggaggtccgggacccaggactagtgaacgtccttcaccacggtccctcgtcccctcacctgcctacttcgtcctcgtggtcgacctccatcgaaggtcggtcggttccttcccgtagtcggacctggacgtccggcacggtccggccggagaagggtctaggagttattaggttacggaactaactctaagtcgaccgtacgggtcgggaccctactactacctaacccgtaaccccgttccctaacgaaaggtacgtaccgacgtaccgacgtactaagtcggtacgacggtaccaaccgtacccgttacccgaaccgttaacccgtaccgtttaccctacccgtagtaaccgtaggttacgttaagttaactacggtacccgacccgccgtaccgaacgtaaccggtccgggtacgttacggttacttacggtggtaccgacggtacgtacggtacgtttaccgttaagtttaccggacctagttacgttaacgttaaacctcgtacgttacggtcgtacggtacgttcggacgggacgtacgggacgtaacgg

SEQ ID NO: 246782 - DNA, 650 bp, Homo sapiens
  misc_feature: GYAE6OF01EJYF7.9.70.G04.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (271)..(271): a, c, t, g, unknown or other
  misc_feature (271)..(271): n is a, c, g, or t
  modified_base (331)..(331): a, c, t, g, unknown or other
  misc_feature (331)..(331): n is a, c, g, or t
tcagtgatacgtctcacgaccggtgctcgatttagtgtagtgtgaagggaaagggccgtgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacnggccctgtccctcacctgcactgtctctggtnactccatcagagtgtcttccactgacctggatccggnacgtccgccggcaagggctggagtatagttggacgaatctagtcgccgagtcgggacccncgattaccaccgaacccgtcctacgaagacgtcgacgtcacgcagtcgtcacgtccgacgaccgtcccaagaacccgtacgttcctacccgttagaccgtaggttgtaacgtttagtacgtacgtacccgccgtaaccgacgaaccggtaccgggtccgttagttaaccgttacgtcgggttacgacggtacggtaaggtacgggtaccgttttaaggtttaacggacccgtagtaccgtttaacgttaaaacccttccgtaacgttacggtcgtacgggtacgttccgggtacgggccggtaacgggacccgtaacgg

SEQ ID NO: 246783 - DNA, 703 bp, Homo sapiens
  misc_feature: GYAE6OF01AKVO4.9.70.G04.1.454.CMB.1.raw
  modified_base (347)..(347): a, c, t, g, unknown or other
  misc_feature (347)..(347): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcactccatcagaggttggtcgttcctacgtggacctggactccggcagtcccgcggcgaagggactggagtatagttggaacgaattctaagtcgacccgtaggtcggggacccnccgtaacttcctaaccgaaacccccgttcctacaaacgggtcgtaccggtaagtccaggactaacgttggtaccaacggttccgaacccgtaccgttaccccaacgtaacccgtacgtttcccctcccgtagaacccgtagggttacgtaacgtttactacgtccggaaccccgccggaccaacggaccgaccgggtcccgtttagtacgtttaccgtggttacgacggaaggtaaggaccgggttacccgttttaaggtttacggaacctaggtacgttaaacgttaaaacccttccgtaacgttaccgggtcgtacggtaccgtcggtaggggacccgaggggaccctaacggg

SEQ ID NO: 246784 - DNA, 728 bp, Homo sapiens
  misc_feature: GYAE6OF01CFV9Y.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatcctcctctggtggcagctcccagagtgggtcctgtcccaggtgcggctgcgaggaggtcgggcccaggactagtgaagccttcacacggcctgtccctcacctgcatgtctcgtggtgactcctacgtcgaaggtaggttcggttccgtttaccgtacgtcggtaccgtaggtacgtccggccacggtcccggaccgggacgaaagggtacgtaggtaagtaagttacgtaggtaacgtaatcgttagtcgaccgtaggtcgggtacccgactactacctaacccgaaccccgtcctacgaaaggtacgtacgacgtacgactcagtgtcgacgtaccgaacgacccgtacccgaagtaaccgtacgttcctcccgtagacgtagtaacgtagttaactaacgtccgacccgtacacgacgacgtaccgggtacgttgtaacgttccgtggtacgtaggaagtaacggacggtttaccgtttaagttaaccggtaacctaaggtaacgtttaaaaccgtaaaaccgtttccgaaacggtttaaccggttcggttacgggtaccgttacgggtacgggaacccggggtaacgggaaaccccgtaaccgggg

SEQ ID NO: 246785 - DNA, 840 bp, Homo sapiens
  misc_feature: GYAE6OF01DWKHU.9.70.G04.1.454.CMB.1.raw
tcagtgatacgtctcacgaccggtgctcgatttagtgtagtgtgaagggaaagggcctgtgaaggcttcactagtcctggacctcctgtgacaaagaacatagaaacatcgtgtggttcactcctcctcgtggtgcacgcctaccgagtagtcggtcctcgtcccgaggtcgcgtcgtagacgaggtacggtccggaccgaaggtactaggtacgaacgtccttacgaacgtccggtccctcgtaccctcaccgtcgactacgtgtccgtgtcgacgtactaccagtcgtaaggtgtccgttacgtaccgtacggacgtacgtagtacgtccggcgtacgccggacggaaggaagggtcgtaggtagtaacgttcggtacgaacttactagtacggtcggactacggggtaccgacccgtactactacccgtaaccccgtaaccgtaccgtaagaacggttacgaccggtacctacgtaacgttacgacttcggtaacgtaccgtaacgccccgtaaacccgtccgtaaacggtacccttccgttaacccgtacggtagtaacggttacgttagtaaacgttaacgtacggtacccggacccgtcgtaacgaaaccggtccggacccgtttaaggtacgtttaccggtaaccgtcgggtaaaggaaacccggttgtaaccgggttaactttaccgggttaagtaccggtaacctaacggtttaaaaccgtaaaccgttacccggttaacccgtaggttaacccgggtcggtttaaaccgggtaaccggtccgggggttaaccccgggtaaaggtaacccggggtaaacccgttaaaccgg

SEQ ID NO: 246786 - DNA, 817 bp, Homo sapiens
  misc_feature: GYAE6OF01AEW8B.9.70.G04.1.454.CMB.1.raw
  modified_base (235)..(235): a, c, t, g, unknown or other
  misc_feature (235)..(235): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatcgggtcctgtcccaggtgcggctgcaggagtcgggcccaggactagtgaagccttcacaggccctgtaccctcacctgcactgtctctggtnacctccatcgacgtaggttcggttcgttccctacgtcggacccttgggactccgggctacggtcccggccggtacgaagggtaccgtaggtaagttaagtagtttacggaaaccgtattaccgtagttacggacccgtagggttaccgggaaccctcctaacgtaccctaaacccgtaacccccggttcccctaagaaacggtacggttaccggaacgtaccgagtaccgagttccggtacacggttaccgaccctaacccggtacccaaggtaaccctcggtttaccctaccccggttagaacccgtaagggttagtaacgtttaaccgtacgtcccgggaaccccgtcccggaactacgggtaacccgtaccgggttacccgttagttaaaccgtttcgtagggttacgaccggtaaagggtcggttaacccggttaccggtttttaaaagtttccgggaaaccttaggttaaccgtttaaaaccgtttaaaacccgtcccgttaaacgggttaccggtcggttacgggtaccgttcccggggtaggggttaacccgaaaggggtaccccgttaaccggg

SEQ ID NO: 246787 - DNA, 751 bp, Homo sapiens
  misc_feature: GYAE6OF01EBP89.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccaggactagtgaagccttcacaggccctgtccctcacctgctactgtctctggtcactcatcagtggtcgtctacctagtcggacctggactcccgggcaacggtcccggaccgtacgaaacggggtctaggggtaacgttagttacgtttacgggaacgtaattcgtaacgttccggcctaagggtccggggaaccctcctaacgtaccctaaaccgaacccccggttcctaacgaaaggtacggttacccggaagttccgaacgctacgtacggtaccgtaacggtaccggaaccctacccggtaacccgtaacggtaacccgtaacggttacccttaccccgttaggtaaccgtaaggttacgtaagtttaacgtacgtaccggaacccgaccgtaccgaacgtaaccgtaccgggtccgttagttaacgttacgtacgggttacgacggtaagaacggtacggttaccgtttaaagtttaccggaacctaacgtaacgttaaacgttaaaccgtcgttaaccgtaccgtagtacggtcgtacggtacgggacggacgggaccgtaacgg

SEQ ID NO: 246788 - DNA, 808 bp, Homo sapiens
  misc_feature: GYAE6OF01EK4OY.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtccgggcccaaggactagtgaagtccttcaacgacggccctcgtccctcacctgcactgtctcgtggtcactccatacgaggtaggttcggtccttacctacgtcggtaacctggacgtccggcgtacggtcccggacccggacgaaaggggtaccgtagggtaagttagttaggttacgggaacgtaataccgttaagtcggaccgtaacgggttaccgggacccaccgtaacgttaccctaaaccccgtaaacccccgttccccttaagaaacgtaacgtccggtaacgtacacgactacgttcggtacgaacgttaccgaactacccgtacccgtaaaccggtaaccctaccgtttcccttaacccgtacggtaaccgtaacggttacgtaagttttaacgtacgttaacccggaccccggtccgaccgaacggtaccccgtcggtacccggtttagttaacgtttcgtacgggtacgacggtaacggacggtaaccgggtttacgtttaaggtttaaccgaaccgtagttaaaccgtttaaacgttaaaaacccttcccggtaaaccgttacgggtccgtaacgggtaccggttacggtaccggggaaccggtaaagggacccgtaaaccggg

SEQ ID NO: 246789 - DNA, 784 bp, Homo sapiens
  misc_feature: GYAE6OF01CAM0T.9.70.G04.1.454.CMB.1.raw
  modified_base (463)..(463): a, c, t, g, unknown or other
  misc_feature (463)..(463): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctctggtgcagctcccagatgggtcctgtcccaggtgcggctgcaggagtccgggccaggactagtgaacgccttcacgacggtccctcgtccctcacctgctactgtctcgtggtcactcactcgaggtacggtcgttccgtttacctacggtcggtaccgtaggtacgttcccgggactaccggtccggccggaacgaaggggtaccttagggaagtttaacgttagttcggaaacttaacgtacgttagcggacccgtagggaccgggtaccccactaacttacccgtaaaccccgaaccccggttccaacgaaacggtacgtacgaacggtccaacgngttaactcggtacgaccgtaccgacctacccggtaccaacggtaacctacgttcctacccgtagaaccttaggtacgtaagttactaccgtacggacccgtaccgacgtaaccgaccggacccgggttcgtttaacgttacgttacgtggtaacgaccggtaaggtaccggtaccggttaccgtttttaagtaccgggaacctaacggttaacccgtttaaacgttaaaacccttccggttaaacggttaccggttaccggttaacggtaccgggttaccgggtacggggaacccggtaaggggtaacccgttaaccgggg

SEQ ID NO: 246790 - DNA, 921 bp, Homo sapiens
  misc_feature: GYAE6OF01DU05G.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagagtcgggtcctcgtcccaggtgcggctgcaggagtcgggcccaggactagtgaacgccttcacacggccctgtccctcacctgcactgtctcgtggtcgacctccatcgaggtaggttggttccgttcctaacgtcggacccgttgggacttcccgggactacggtccccggccggacgtaaagggggtaccttaggggtaacgttaagttaggttacgggaacgtaattcttaagtcgaccgtagggtccgggaccctccgtaactaccctaacccgtaaccccggttccctaacgaaacggtacgtaccggtaacgtccgaagcctagttcgtacgtaacgggtacccgaacccgtaccgtaccccgaaacgtaacccgttaacgtttccccgttaccccgtaggtaaccgtaagggttacgtaaacggttttactaaccggtaccggaaccccggtcccggaacccgtaaacgggtaaccccggtaacccgggttacccggtttaacggtttaaaccgttaccggttacgggttcggaaccgggtaacgggtaacggggttaacccgggtttacccggttttaaacggttttaacccgggaaacccgttaaggtaacccgttttaaaaaccggttttaaaaaccccgtttacccggtttaacccggttaaaccccggggttaccgtttaacccgggggttaacccgggtttacccggggtaacccgggggggtaaaccccgggtaaaggggggtaaaccccccgtttaaaacggggg

SEQ ID NO: 246791 - DNA, 790 bp, Homo sapiens
  misc_feature: GYAE6OF01ESRJU.9.70.G04.1.454.CMB.1.raw
  modified_base (303)..(303): a, c, t, g, unknown or other
  misc_feature (303)..(303): n is a, c, g, or t
  modified_base (727)..(727): a, c, t, g, unknown or other
  misc_feature (727)..(727): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccggcccaggactagtgaacgtccttacacgacggtccctcgtcccctcgacctcgacacttgtcctcgtgggtcacctccatcgaggtggttcggttccgttcctacgtcggaccgtggacttcccggnaccggtcccgccggacgaaagggtctagggagttattagttcgggaaacgtatctagtacgtaccgagggtacggacccgctactacctaacccgaaccccgttcctagaacggagttacgacgtacagtacacgttgaccgacggtcaaccgtacccgtaccaaccgtaaccgtctttaccccgtacccgagaaacctaggtaaggttaagttaacctacgttacccgggaccccgtaccggtacgaaccggtaacccggtaccgggttacccggtttaattaaccgttttacgccggggttacggacggtacgggaaggttcccgggttttaacccgtttaaagggtttacccgaaccggtttaacttaaccggtttaaaaaccggtttaaacccttccgttaaacccggggttaccggttntacccgggggttacttccgggggtaacccggggacccgggtaaagggtaacccccggtacggg

SEQ ID NO: 246792 - DNA, 581 bp, Homo sapiens
  misc_feature: GYAE6OF01BAVPZ.9.70.G04.1.454.CMB.1.raw
  modified_base (477)..(477): a, c, t, g, unknown or other
  misc_feature (477)..(477): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcaggaggtggtcgttcctactggacctggatccggcagtccgccggcaagggctggagtatattggacgtaatctatgccaggtcgggacccgccatacctaccaaccccggtccctacaaagcgtcgacgtcagctagtgtcgacgtcgaccaccgtaccaacgaacctacgttcctcccttgaccagtacgtagttactagtcgacccgccgcagaccgacgccgtgtattcgngttgcgagaggcggtcgtttagtttacggacctagtacgttaacttaaaacctccttaacgtacgtcgtacggtacgtcggtaggggcgaagggtcctaacggg

SEQ ID NO: 246793 - DNA, 781 bp, Homo sapiens
  misc_feature: GYAE6OF01B93YE.9.70.G04.1.454.CMB.1.raw
  modified_base (393)..(393): a, c, t, g, unknown or other
  misc_feature (393)..(393): n is a, c, g, or t
  modified_base (619)..(619): a, c, t, g, unknown or other
  misc_feature (619)..(619): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctctggtgcagctcccagagtgggtcctgtcccaggtgcggctgcaggagtccgggcccaggtactagtagaacgtccttcacgacggcccttcgtccctcacctgacctacgttcgtcttcgtgggtcacctaccagtacgaggtggtcgttcccgttcctacgtcggtaccgtggacgtccggactaccggtcccggccggaacggaaggggtctagggtaatagttagtacggaactaatcgtaatcggacgtacgggtacggacccncgtaactaccgtaaccctaaccccgtctacgaaacggtccgtacgtacgtacgacgactagttacgacgtaacgtaccgaaccgtacccggtacccgaaacgtaccgtaccggttaccctaccggtacgtaacgtaggtaacgttaacggttactaccggtaccggaaaccccggccgaacgaaacccggtccggaaacccgggttccgttaagtaacttccgggnggttacgacggaaggttacggtaccggtttacggttttaacggtaccggacccgttaagttaaccggtaaaccgttaaacccgttccggttaaacggttcggtaccgtacgggttacggtaccgggtacggggaccggtaaacgggtacccgttaacccggg

SEQ ID NO: 246794 - DNA, 742 bp, Homo sapiens
  misc_feature: GYAE6OF01AOUAH.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatggtcctgtcccaggtgcggctgcaggacgtcgggcccaggactagtgaacgccttcacgacggtccctgtccctcaccctgcactgtctctggtcgactccatcgagagtggtctctactcggacctggactccggcacgtccgccggactaagggctagggacttagtacgtacggacgaattcgtaagtcgaccgagggttcgggacccgcacgtccctaaccgaacccccgttccaccgtaaagtacggttaccgagttacaggtcctagttacggtacgtacgtaccggaactaccccgttaccccaacggtaaccctacgtttacccgtaccccgttagtaacccgtaggttacggttaacgtttactaaccgttaccggaccccgacgaccgacgaccgaaccgggtaccgttcgtttaaccgtttacgtcggttaacgggccgtaagggtaccggtacgggttaccgtttaacgtttacggtacccgtagtaaccgttaacggtttaaaaccctaccgttaaccggtaccgttacgaccggttacgggttacccggacgggggtacccgtaacgggtaacccggtaaccggg

SEQ ID NO: 246795 - DNA, 678 bp, Homo sapiens
  misc_feature: GYAE6OF01DKPJI.9.70.G04.1.454.CMB.1.raw
  modified_base (438)..(438): a, c, t, g, unknown or other
  misc_feature (438)..(438): n is a, c, g, or t
  modified_base (521)..(521): a, c, t, g, unknown or other
  misc_feature (521)..(521): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtgcagctcccagatgggtcctgtcccaggtgcggctgcaggagtcgggcccaggactagtgaagccttcacacggccctgtcccctcgacctcgccgactgttctccttgggtcacctccatcgaaggtggtcggttccgttccctagtcggacctggaccttccggctacgtccccggacggcgaacggggtactagggtacttacgtagttacgggacgtaatctagtcgacgtacggtcggggacctccaattccctaacccgaaccccgtcccttacgaaaggacgtcgaacgtcacgtctagtntccggagtaccgaacctacgaccaacgtaacctacgttcctacccgtagacctagtacgtattacgtagtaccggccgaccgngtacgacgcggtccgtagttaacgttactacgggtgacgggtagacggtcggttaccgtttagttacgaacgtacgtacgttaaacgtaaaccgttccgtacgtacggtacgtagggtacccggttcggacgggggacctaggggacccgtaacggg

SEQ ID NO: 246796 - DNA, 812 bp, Homo sapiens
  misc_feature: GYAE6OF01AO6X2.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctgggtggcagctcccagatgggtcctgtcccaggtgcggctgcaggagtccgggcccaggactagtgaagccttcacgacggccctcgtccctcacctgctactgtcctcgtggtcacctccatcgaggagggttcggttccgttcctacgtcggtacccgtgggacgtcccggcgtacggtccggccggacgaagggtccgtaggtagtatagtacggaacgtaattcgtagtcggaccgtaagggtcgggtacccgacctacgttaccctaacccgaacccccgtccctaacgaaacggtccggtacgtaacggtccacggtcctaagtcgtacgacggtaccgaccgtaaccccgtcccgaaacggtaacccgttaccgtttacccgtaccccgtaagtaaccgaacggttaggttaacgtttaacgtaccgtaccggaacccccgacgtaccgaacggtaacccggtaccgggttacccgttagttaaccttaccgggtggtaccgggtaaccgtagggaacgggttaccggtttaccggttttaaggttaaccgaccgtaacgtttaaccgttaaaacgtttaaaccccgtccgttaaacccgggttacgggttaacttaccgggttaccgggttaccgggtacgggggaacccggtaaaccggggtaaccgtaaccccggg

SEQ ID NO: 246797 - DNA, 657 bp, Homo sapiens
  misc_feature: GYAE6OF01CMD68.9.70.G04.1.454.CMB.1.raw
  modified_base (376)..(376): a, c, t, g, unknown or other
  misc_feature (376)..(376): n is a, c, g, or t
  modified_base (559)..(559): a, c, t, g, unknown or other
  misc_feature (559)..(559): n is a, c, g, or t
tcagtgatacgtctcacgaccggtgctcgatttagtgtagtgtgaagggaaagggcctgtgaaggcttcactagtcctggacctcctttgcaagaacatgaaacatctgtggttcatcctcctcctggtggcagcctccagagtgggtcctgtcccaggtgcggctgcgaggagtccgggcccaggactaggtgaacgtccttacacacggcccctgtcccctcacctgccacttgtccttcgtgggttcactccatcgaggtaggttcgttccgttcctagtcggactggactccggcaccggtcccgcggacgaaagggctgggaagttatagttaggaactaactcgtaagtcgaccggagtaccgggacccnctagtaccctaaccgtaaccccgtcctaagaaacggtcgttcgaacgtcaacgtctaagtcgtacgagtcccgactaccgtacccgaagtaacctacgttccctacctacgacgtacgttagtaagttactacgtccggaacccgccgacgacgaacgcgtaccgttagttaactacggtcgnggtacgaggtacgagttaccgtttagtacgacctagtactaaacgtaaactcgacgttcggtcgtcggacgtcggcggaaccggaggaccgtagtccc

SEQ ID NO: 246798 - DNA, 875 bp, Homo sapiens
  misc_feature: GYAE6OF01DP4UO.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgccactgtctcgtggtcgaacctccgatcgagtacggtggttccgttcctaacgttcgggaacccttggtaaccgttcccgggacaacggttcccccggaccgggaccgaaagggggacctttaggggaagttaacgttacgtttagggggaaactaaacgttccgttaaggttcgacccgtaagggttacgggggaacccctaccctaacggtttccctaaaccgtaacccccggtttacccccttaacggaaaaacgggtcggttaccgtaacggttaccgaacggtacctaaggttccggtaacctaaaccgggtttccgaaacccgtacccggttaacccccgaacggtaaaccccgttaacgtttaccccgttaccccgttacggtaaccgtaaggttacggtaacggttttaacgttaacgtttacccggaaccccgtacccggtaaccgtaacgaacccggtaaccgggtccggttaacgtttaacgtttaacgtggttacgacggaacgtacgggtacggtacccggttttaaaggttttacggacccgtagtaccgtttaaacggttaaaaacccttcgttaaaccgttaccggttcgtaccggtacggtacggtacggggtaacccggacggggaacccgtaaacgg

SEQ ID NO: 246799 - DNA, 726 bp, Homo sapiens
  misc_feature: GYAE6OF01B19Y2.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatccctcctcctggtggcagctcccagatgggtcctgtcccagttgcggctgcaggagtccgggcccaggactagtgaagccttcacaggccctcgtccctcacctgctactgtcctcgtggtcgtacctccatcaggtaggtcggttcgttcctacgtcggaccgtggactccggactacggtcccggccggacgaagggacgttgggaagttacttagttggaacgaattcgtagtcgaccgtagggtccgggaaccacctaactacctaaccaaccccgttacccacgaaaggtcggtcgaacgttccagtctagtcgtcgacggtccgaacgtacccgtacccaacgtaaccctcgttccctacccgtagtacgtaggttagtaacgtttagtacgtaccgacccgccggaccaacgtacgaccggtcgttagttacgttacgtacgtaggacggagtacggtacggttaccgtttaagtttaaccggaccttaacggttaccttaaacggttttaaaacccgttccgttaaaccgttaccggtttacgttacggtaaccggttcgggtacccggggacggtaacccggggaaccgttaaccccggg

SEQ ID NO: 246800 - DNA, 685 bp, Homo sapiens
  misc_feature: GYAE6OF01EBH7D.9.70.G04.1.454.CMB.1.raw
  modified_base (233)..(233): a, c, t, g, unknown or other
  misc_feature (233)..(233): n is a, c, g, or t
  modified_base (280)..(280): a, c, t, g, unknown or other
  misc_feature (280)..(280): n is a, c, g, or t
  modified_base (343)..(343): a, c, t, g, unknown or other
  misc_feature (343)..(343): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggttcgtccgttcctacgttggacctggactccggnacggtccgcggacaagggactgggattatagttggaacgtaatcgtatcgcgaggtcggaccncaatcctaaccacccgtcctagaaagtcgtacgacgtacacgcaattcgcaagtccgaactaccgtacccaacgtaacctacgttccctacccgtagaacctaggtacgtaagtttaacgtacgtacgaccccgtccgaccgtaacggaaccgtaccgggtcgttaacgttaactttaaccggttgggtaaccggtcggtaaacggtacggtaacgggttacccgttttaaagtttaaccgggacctaacggttacgttaaacgttaaaacccttccgttaaccgtacggttacgtacgggtacgtacggaccggggtaccgaacggggtaccgtaaaccgg

SEQ ID NO: 246801 - DNA, 859 bp, Homo sapiens
  misc_feature: GYAE6OF01ET5S8.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccaggactagtgaagccttcacgacggccctgtcccctcacctgcactgtcctctggtcgacctccatcaggtaggtcggttccttcctacgtcggtaccgtggtacgtcccggacacggtccccggaccggagtaacggggcttagggaagttaacgttaggttacgggaaacgtaactttccgttaagtcggaacccgtaggggttaccggggaacccctacctaaccgttaccccgtaaaccccgaaaccccccggtttcccctaaacgaaacggttacggtaccgtaacggtccaaaccgtcgtaacggtttaccggtacaacgggttacccgaaacccggttaccccggttaaccccgaaaccggtaaaccccttacggtttaccccccttcccgtaacggtaaccgttaacgggttacgttaaaggttttaacgtaccggtaaccggtaacccccggacccggtaaccgtaaccgggtaaccgtaacccggggtccgttaacggtttaacttacccgggtggttacgaacgggtaggtaaccgggttacgttaccggttttaagtttaaccggacctagttaccgtttaaaacgtttaaaccctaccggttaacgttaccggttcgaacggttcccggttcgggtaacgggtcccggtaaacggggactaaccggg

SEQ ID NO: 246802 - DNA, 745 bp, Homo sapiens
  misc_feature: GYAE6OF01E39GI.9.70.G04.1.454.CMB.1.raw
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccggcccaggactagtgaagccttcacacggccctgtccctcacctgcactgtctctggtcacctccatcgaggtagggttcggttccgttcctacgtcggacctggactccggcacgtccggccggcgaaggctggatatagttaggactaatctatcgaccgtaggtcgggacccnccactacctaacccgtaaccccgtccctacgaaacgtacgtcgacgtcagcaatcgtacaggtaccgaccaccgtacccgaacgtaacccgtcgttacccctaccccgtagaacccgtaggttagtaacgttaacgtagtaccggacccgcccgaacgaacggtacccgaccgggttccgtaagttaaccgttcgtaggtcggaacggtaagtaacgggtacggtttaccgttttaaggtttaaccggaaccctaagttaaccgtttaaaaccgtttaaaaacccgttaccccggtttaaaccgttaaccgggttaccgttaacggggttaacccgggttcccggggtaaaccggggggccccggtaaacgggggtaaacccgttaacccgggg

SEQ ID NO: 246803 - DNA, 766 bp, Homo sapiens
  misc_feature: GYAE6OF01A2OEW.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtcactccatcagtaggtcgtcgttacctagtggacctggactccggcagtccgccggacaagggtctgggaactatagttggaacgtaatcgtatgaccctaaggtcgggacccactaagtcctaaccgaaccccggtccctaagaaaggtacgtacgtaacggcaagctaacgtgtaccaagtaccggaacctaccgtacccaacgtaacccgtacgtttccgtacccgtagaaccgtaagtacgtaacgtttaactacgttaccggacccgtacccggaccgtaaacggacccggaacggtacccggttacggttaacgtttaaccgtcggttacggtaccgggaacggtaacgggtaaccggttacccggttttaaacggtttttaaacgggacccgttaaaacggttaccgttaaaccggttttaaaaacccgtcccggttaaaaccgttaccgggttacgtacccggggtaaccggttcggtaaccggggggtaacccgtaaaccgggggtaaccgtaaaaccccgggg

SEQ ID NO: 246804 - DNA, 638 bp, Homo sapiens
  misc_feature: GYAE6OF01A4J26.9.70.G04.1.454.CMB.1.raw
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagagtgggtcctgtcccaggtgcggctgcaggagtcgggcccaggactagtgaagccttcacacggccctgtccctcacctgcactgtctcgtggtcgactccatcaggtaggtcggtcttcctactggacctggactccggcacgtccgccggacaaggactggagtatagtggacgaatctaancgcaggtcgggacccncagtacctaaccaacccgttcccagaaaggcgttacgacggttacagacgtatcggtacaagtaccgactaccgtacccgaagtaacccgtacgttcctaccctacgaacgtacggttagtaacgttacacgtacggacccgcgtacagtaccgacggtccgttagttattacgtgtacgagtaggaggtacgtaccgtttagtttaccgacgtaggtacttaacgttaaaacctccgtaacgtaccggtacgtacgggaccgttacggaggggacccggtagggaaccgtaacggg

SEQ ID NO: 246805 - DNA, 782 bp, Homo sapiens
  misc_feature: GYAE6OF01CPOAO.9.70.G04.1.454.CMB.1.raw
  modified_base (250)..(250): a, c, t, g, unknown or other
  misc_feature (250)..(250): n is a, c, g, or t
  modified_base (628)..(628): a, c, t, g, unknown or other
  misc_feature (628)..(628): n is a, c, g, or t
  modified_base (646)..(646): a, c, t, g, unknown or other
  misc_feature (646)..(646): n is a, c, g, or t
  modified_base (749)..(749): a, c, t, g, unknown or other
  misc_feature (749)..(749): n is a, c, g, or t
  modified_base (764)..(764): a, c, t, g, unknown or other
  misc_feature (764)..(764): n is a, c, g, or t
  modified_base (775)..(775): a, c, t, g, unknown or other
  misc_feature (775)..(775): n is a, c, g, or t
tcagtgatacgtctcacgaccggtgctcgatttagtgtagtgtgaagggaaagggcctgtgaaggcttcactagtcctggacctcctgtgcaaagaacatagaaaacatctgtggttcatcctcctcctggtggcacgctcccagatgggtcctgtcccaggtgcggctgcgaggagtccgggcccaaggactagtgaacgccttcaacacggtccctcgtcccctcacctgacacttgtcctcgtggtnacctccactcgaggtacgggttacggttccgtttaccctacgtacggacccgtggtaccgttccgggaccgtaccgggtccccggcccggggacggaaagggggtaccgtagggggtaacttaagttaacggttacgggaaaccgtaaattaccgttagtaccggaccgtaaacggggtccggggaccccgtaaccgtaacttacccgtaaaacccccgtaccccccgtttcccgtaaacggtaaacggtaaccggttacggtaacgttacgaacggtaccgtaaagttcgtaacgtaacgttaccggaaccctacgggtaccccaaaccggtaaaccgtccgttccctaccgtagtaacgttagtacgtaagtttanacgtaccggaccgccaanacccggacgtaccgggtcttacgtaacttacgcggtagacgaacggtagtacggttaccgtttaatacgggactacgtattaaaccgtaactgtctaacggtnacggtccgtacgggngacggaacggngtacccg

SEQ ID NO: 246806 - DNA, 763 bp, Homo sapiens
  misc_feature: GYAE6OF01BPU6K.9.70.G04.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagtgatacgtctcacgaccggtgctcgattttagtgtagtgtgaagggaaagggcctgtgaaggcttcactagtcctggacctcctgtgcaagaacatgaaaacatctgtggttcatcctcctcctggtggcagctcccagatgggtcctgtcccaggtgcggctgcaggacgtcggcccaggactagtgaagccttcacncggccctcgtccctnacctgcactgtctcgtggtcactccatcaggtggtcgtcgttccacgttcggacctggactccggctaacgtccggccggagaacggggacgtggtacgtagttacgttgggaacgtaatctagtcgccgaggtcggaccccactacgttcccaaacccgtacccgtcccctaagaaacggtacggttccgagtaccaaggacctagttcgtacgtaccgtaccgtaaccgaccgtaccccggtaacgaaaccccttagggtttccccctaccgtaacggtaacctacggttaagggaacgttttactaacggtcccggtaaaccccggtccgaaccgttaacggaacccggtacccgggtacgtttaacgtaccgtttaacggtcggtcgggaacggtaacgtaggggtaccgttttccggtttaaaggttacccgtaacgtaacgtttacgttaaaaccggtttaaacctcccggtttaacgtacgggtaccgttcgaacgggtttcggaccggggttccggaaacgggtcccgtaaaccggg

SEQ ID NO: 246807 - DNA, 729 bp, Homo sapiens
  misc_feature: GYAE6OF01ERN1Y.9.70.G04.1.454.CMB.1.raw
  modified_base (582)..(582): a, c, t, g, unknown or other
  misc_feature (582)..(582): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcactcctcctcctggtggcagctcccagagtgggtcctgtcccaggtggcggctgcaaggagtcgggccaggactagtgaacgccttcacacggcctgtccctcacctgacactggtcttcgtggtacacctacagtacgaggtacggtcgttacgttcctacgtacggaccgtaggtacgtaccggctacggtccccgacgggacgaaaggggtcctagggtaacgtagttaacggtacggaacgtaaacgttctaagtacggccgtaagggtaccggaaccgtcctaacgtaccctaaaccgtaaccccgtacctacgtaaagggacgtccgtaggtacacgtactaacgtcgtacgacggtaacgaacctaccgtacccgaaacgtaccgttaacgttcctaccgtacgagtaacgtgtaacgttattaacgtcggaccaccggacacggaacgtacggtaccgtnttaacgttgtacggtcggagaggtaacgtacgggttacgttaagttaccggacctaagttaaccgtaaagtttaaaaccctcgttaaccggtcgtaaccgttcgggcgttaccgggtcgggaacggtaaaccgggtactaacccggg

SEQ ID NO: 246808 - DNA, 718 bp, Homo sapiens
  misc_feature: GYAE6OF01EBQB1.9.70.G04.1.454.CMB.1.raw
  modified_base (358)..(358): a, c, t, g, unknown or other
  misc_feature (358)..(358): n is a, c, g, or t
  modified_base (525)..(525): a, c, t, g, unknown or other
  misc_feature (525)..(525): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacgacggccctgtccctcacctcgctactgtctcgtggtcgactcatcgaggtaggttgtcgttcctacgtcggacctggactccggcacgtccgcggacgaagggctaggacgttatacgttggaactaatctaagtcgaccgtaggtacgggacccncctaatacccgtaaccaaccccgtcctagaacgtcgtcgaacgtcgagcaagttcggtacaaacggtccgaaccgtacccgttaacccaacggtaaacccttaggtttcccctacccggtaagaaccgtaacggtttagaacgttttaagactaccgggtaaccccnccggtaacacggaacccgttacgggtccgttatttaacggttactcggttcgacggtaacgacgggtaccgttacgtttttaagttaccggaacctaagttacgttaaaacggttttaaaaccctccgttaacggtacccggttgtacgggtaccggttcggacgggggacccgaaggggtacctaaaccggg

SEQ ID NO: 246809 - DNA, 795 bp, Homo sapiens
  misc_feature: GYAE6OF01BLCYZ.9.70.G04.1.454.CMB.1.raw
  modified_base (745)..(745): a, c, t, g, unknown or other
  misc_feature (745)..(745): n is a, c, g, or t
tcagtgatacgtctcacgaccggtgctcgatttagtgtagtgtgaagggaaagggcctgtgaaggcttcactagtcctggaccctcctgtgcaaagaacatagaaacatctgtggttcactcctcctctggtgcagctcccgagatcgggtcctgtcccgagggtgccggctgccagggacggtccgggccctaaggactaggtgaacgtccttcacgaccggtccctcgtccctccactcgactcgttgtcctcgttggtcacctacagtcgaggtcggttcgtccggttacctaacgtggaccgtgggcctccggctaccggtccggccggaacggaaagggtctagggtacgttaataggttacggaacgttacttacgtaagtcggaaccgtagggtccggacctactacccgtaacccgtaacccgttaacccgtaccctaacgaaacgggttacgtacggaaactccgtaagaaccgttgtaccgttacgaccggtaacccgtaacgtaccccgttaacccggaacgtttacccgtccgttaccctacgtacggtaacgtacggttaacgtaacgtttaactaccgtacccggacccgaccgaccgaaccggaccgtaccgggtacgtttacgtacgttacggtcggtaaggaccggtaagaacgggttaccttcggttaaacggttaccgaaactaacgttaacgttaaacgttaacccttaccggtacgttccgggngttaaccggtcggttaccggggacggaacggtaccggaacggttaaccgg

SEQ ID NO: 246810 - DNA, 865 bp, Homo sapiens
  misc_feature: GYAE6OF01CLY6B.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatagaaacatctgtggttcatcctcctcctgggtggcagcctcccagagtcgggtcctcgtcccgaggtgcggctgcgaggagtccgggccaggactagtagaacgtccttcacgacggccctcgtccctcacctgcactgtctcgtggtcacctccgagtacgaggtacgggttcggttccgttacccgtacgtcgggtaccgttacggtaccgtcccggcctacgggtccccggacccgggtacgaaaccggggtacgtagggtacgttaagttacggttacggaaaccgtaacttacgttagtccggaccgtacgggtaccggacccgtacctaaccgttacccgtaaaccccgtacccccggtacctaacggtaaacggtccggttaccgagtaccgacgactacgttacgtactacggtacccgaaccgtacccggtaacccgtaaacgaaccttaccgtttacccacccgtaagtaacgtacggttaacggttacgttaactcggtaacccgtacccgaccgtacgaacggtaacccgaccgggttaccgttaagtttaaccgtcgttacgggaccggtaccggtaaaggtacgggttaccccggtttaaccggttttaacggtttaccgaaaaccgtgttaaacccgtttaaaccgttaaaaccccggttacccgttaaccgggttaccgttacccgggaacggttcccggttacggggtaccggggaaaccccgtaagggggtaaccccgtaacccggg

SEQ ID NO: 246811 - DNA, 762 bp, Homo sapiens
  misc_feature: GYAE6OF01BWF1T.9.70.G04.1.454.CMB.1.raw
  modified_base (431)..(431): a, c, t, g, unknown or other
  misc_feature (431)..(431): n is a, c, g, or t
  modified_base (692)..(692): a, c, t, g, unknown or other
  misc_feature (692)..(692): n is a, c, g, or t
tcagtgatacgtctcacgaccggtgctcgatttagtgtagtgtgaagggaaaggcctgtgaaggcttcactagtcctggacctcctgtgcaagaacatgaaacatctgtggttcatcctctcctggtgcagctcccagatcgggtcctgtcccaggtgcggctgcaggagtccggcccaggactgtagaacgtccttacacgacggtccctcgtccctcactgctactgtctgtgtcgacctccagttcaggtcggtcgttccgttacctacgtacggtacccgtggacgtcccggatacggtcccggccggagaaacgggtcgtagggaagttataggttaggaacgtattcgtatccggacgtacgggtaccgggacctctaacgtcctaaacccgacccgtacctaggaaagtcgtacgagtcacgtntacgtcgtagtaacggtaccaccgtaccggtacccaacggttaaaccccgtgttttacccccaccggttaggaaactcgggttaaactacggtttaaacgtcgacccggggaaccccgtcgtaacgtaaccggacccgggtaccgggtcttttaaacgggacttttacggagggtttccggaaggtaaacggtacgggttacccgtttagttttaccggtaaacggccttaaccggtttaaacgttaaaacctttaacccncccggtttacgtaaccggttgaaccggttccggtacgggtaccggggaccgttacggggtaacctaccgg

SEQ ID NO: 246812 - DNA, 1017 bp, Homo sapiens
  misc_feature: GYAE6OF01C5VGQ.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatccctccctcgtgggtcagactccctaccaagtcggtccgtccgtccgacgtggtcggcgtcgcgacggacgggtcgggtcccggacgaacggtacgtaggtacgaccttcctacgacggcccgtccgttcccgtcccctaccgtcgtcgaccttcgttccgttcgttcggtggaccttacctactcgaacggtacggttcgggttcgtttacccttacggtcggtaccggtcggtacgtacccggtccgaacgtcccggtacccgggacggtaaacgggcggttacggtaggttaactacggtttaggtacgaactttcacgtcggtccgaagggttcgggacccggacctacctaccgttaacccgtaaccccgttcccgtcgaaaacgtacggtaccgtacggtacctaaggccgtaacggacggttttcccgaacgggttaccccgtaaacccggaaccccgtttccccggtaaaccgaaaccccggtttaccgttacccctttaccccggttacgaacccggttagttaacgggttaaaccgtttagttaaaccgtaccggggtaacccggtaccccgtaccgggtaaaccccgggtaccgggtaaacccgggtttacccggggtttaacgtttaaaccgttttaacgggtccgtttaccgggggaacccggtaaaggggttaaaccggttacccggggtttacggtttttaaaacccggttacgggttaaccgaaaccgggtttaccttttaaaaaaccggttaaaaccccgttttaacccggttcccggttttaaacgggacccggtttaacggggttaacccgggtaccggggttcccggggggtaaaccggtaaccccgggggaaaaccgggtccccggttaaaccccggg

SEQ ID NO: 246813 - DNA, 762 bp, Homo sapiens
  misc_feature: GYAE6OF01B0CNP.9.70.G04.1.454.CMB.1.raw
  modified_base (389)..(389): a, c, t, g, unknown or other
  misc_feature (389)..(389): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagcctcccagatgggtcctgtcccaggtgcggctgcaggagtcgggcccaggtactagtgagtccttcacgacggccctgtccctcacctgcactgtctcgtggtcgactccatccgaggtacggttcggtccgttcctacgtcggtacctggaacgtccggactacggtcccggaccgggtacgaaggggtaccgtagggtagttacgttaggttgggaaccgtaatcgttaagcgaccgtagggtccgggacccnccataccctaacctaaccccgtctacgaagtaccgacggtatcgaagtcagttcgacgtagtaccgaaccgtacccgtacccgtaaggtaaccccttacggtttaccccgtacccgtagtaacccggtaagttacggtaaatttacgtaaccgttccgggaaccccgtccgtaaccgaacggtacccgtaccggggtaccttagttaacgttccgtacgggtacgtacgtaacgtagggtaccgtttaccggtttagttaaccggaaccgtaagttacccgttaaacgttaaacccttccctaacggttccgggtaacgtcgggttaccggaccggggttagggaaccccggtacggggtaactaacccgggg

SEQ ID NO: 246814 - DNA, 792 bp, Homo sapiens
  misc_feature: GYAE6OF01EBZLK.9.70.G04.1.454.CMB.1.raw
tcagtgatacgtctcacgaccggtgctcgattttagtgtagtgtgaagggaaagggcctgtgaaggcttcactagtcctggacctcctgtgcaagaacatgaaacatctgtggttcactcctcctcctggtggcagcctcccagagtcgggtcctcgtcccgaggtgtcggctgcgaggacggtccgggacccaaggacgtagtaggaacgtccttcgacgacggtccctgtcccctcacctcgctactgtctcgtacggtcgacctccatacgagggtacgggtttcggttccgtttacccgtacggttaccgggtaacccgtagggtaaccgtcccgggactaaccgggtaccccggaccgggacgtaaacgggggtacgtaggggaaagttaacgttaaggttacggggaacgtaaagttccgttaaagtcggaaccgtaggggttacccgggaacccgccgtaactaacccggttaaacccctaaaccccggttccgtaacaaagggtacgtcgaacgttccaagacgttacgtggtaccgacgttacccgaaccgttacccgtacccgaacgtaacccgttaccgtttccccgttacccgtacgtacgtaagggttacgtaacgttaacgtacgtaccggtaccgccgtacgaacgtccggaccgtcgtattacgttcgtgacggcgacgacggttacgtacggttagttacggactacgttacgtaaacgttaaccaccggtcgtacggtcgtacggtccggtaggtcgggacggacggcgtacgg

SEQ ID NO: 246815 - DNA, 822 bp, Homo sapiens
  misc_feature: GYAE6OF01CBBF5.9.70.G04.1.454.CMB.1.raw
  modified_base (401)..(401): a, c, t, g, unknown or other
  misc_feature (401)..(401): n is a, c, g, or t
  modified_base (802)..(802): a, c, t, g, unknown or other
  misc_feature (802)..(802): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcactccctcctccgtggtggcagcctcccagagtcgggtcctgtcccaggtgccggctgcgaggacgtccgggcccaggactagtgaacgtccttacacgcggccctcgtccctcacctgccactgtctacgtggtacgacctcatcgaggtacgggttcgttccttaccgtacgtcggtaccgtggctaccggcgacggtcccggaccggacgaacggggctagggtagttacgtaggtacggaacgttaacttacgtagtccggacgtacgggccgggtaacccnctaacgttaccctaacccgtaaccccgttaccgaacgtaaaggcggttacggacgacgaacgtcgtacttcgacgtaacgtaccgtaccgtacccgtacccgaacgttaacccttccgtttccctaccgttaacgacgttaacgggttaacgttaacgtttaccgtacggtcccgaaccccgtcccgtaacgaaaccgggttacccgtaccgggttaccgtttcgttttaacgttccgtacgggttcggaacgggtaacggttacggggttaccgttttaaccgttttaaggtaaccggaaaccttaacggttaaaccgtttaaaacccgtttaaaccgtacccgtttacgggtcccgtacgggttaacggtcccgttagggggacccgggtaaacccggnggggtaaaccccggtaacgg

SEQ ID NO: 246816 - DNA, 962 bp, Homo sapiens
  misc_feature: GYAE6OF01E27MB.9.70.G04.1.454.CMB.1.raw
  modified_base (388)..(388): a, c, t, g, unknown or other
  misc_feature (388)..(388): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacacggccctgtccctcacctgcactgtctcgtggtcacctccatcaggtagggtcggtccgttcctacgtcgggtacctgggactcccggctacggtccccggcccgggacgaaacggggtctaggggtaacgttaattaggttacgggaacgtaacttcgtagtcgcccgtagggtcgggaaccccnctaacttccttaaaccccgaaacccccggtttcccctaacgtaaacgggtaccgttaccgggtaacgtacccaacggtacccgtaagttccgggttacccaaccgggtttacccgaaaaccccgtaccccggttaaccccccgaaaccggtaaaacccccgtttaccggttttacccccttacccccggttaacggtaaacccgtaacgggtttacggttaaaacggttttaacgttaaccggttaaccccgggtaacccccgggaccccggtaacccgtaaaccgggaaaccccggtacccggggttaccccggtttaagtttaaaccgtttaccggttacgggttaaccggtaaccgggtaaaccgggtaacgggtaacccgggtttacccgtttttaaacggttttaaacccgggaaacccggttaaggtttaaacccgtttaaaaccgttttaaaaaacccgttccccgtttaaaccggttacccgggttaaccggtttaaccgggtacccgggttacccgggtaccggggggaccccgtaaacggggggtaaccccgttaaacccgggg

SEQ ID NO: 246817 - DNA, 745 bp, Homo sapiens
  misc_feature: GYAE6OF01AUJDD.9.70.G04.1.454.CMB.1.raw
  modified_base (302)..(302): a, c, t, g, unknown or other
  misc_feature (302)..(302): n is a, c, g, or t
  modified_base (381)..(381): a, c, t, g, unknown or other
  misc_feature (381)..(381): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaacgtccttcacgacggccctgtcccctcacctgcctacttgtcctcgtggtcgacctccatcgaggtagggttcggtccttacctacgtcggacccgtggacgtcccggnacggtcccggaccggacggaaagggccgttaggaagttattagttggaactatctagtcgccgtagggtccgggacccnctaacttacccgtaaccgaccccgttcctaacgaagtcgtacgagtacaagtctagtcgtacgacgtacgacctaccgtaccaacgtaacccttacgttcctaccctacgaacgtacgttagtaacgtttataccgtacccggacccgtaccgacgtaaccggaccgtaccgggtccgttaagttaccgttacgtaggtacggtacggaacggttacgggtacggttaaccgttttaggttaaccggaccgttaacgttaaccggttaaaccgtttaaaccgtcccgttaaaggttcccggtacggttacgggtacccggttcgggaccgggggtacccggaaccggggtaacccgtacccggg

SEQ ID NO: 246818 - DNA, 761 bp, Homo sapiens
  misc_feature: GYAE6OF01AW8N3.9.70.G04.1.454.CMB.1.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccccnacctgctactgtctcgtggtnactccatcagaggtgtcgttctactgtctgatccggcagtccgccggctaagggacgtgaggtattagttcggacggaatcgttagtacgccgacgggtagggacccggtaccctaatcctaacccaaaccccggtcccctacgaaacggacgttacgacggtacacggactaacgtggttaccacggtaccgaacccgtaccgtaccccgtaacggaaccccgtaacgtttacccgtcccccgttaaggtacccgtaagttaccgggaagttttaaacgttacgtaaccggtacccgtaccccggacgtaaccggaaccggtacccgggtaccggtttacgttacggtttaccgtcggttagtacgggaacggtaacgggtacggttaccggtttaacgtttacggtaaaccgtacgtaaccggtttaaacttaaaaaccgttcctaaccggttaccggttaaccggttagggtaacccgttacgggccggggaacccgggtacggggaaacccggtaacccggg

SEQ ID NO: 246819 - DNA, 698 bp, Homo sapiens
  misc_feature: GYAE6OF01BNMFJ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgccacgtgtcctcgtcggtcgacctccatcgaaggtagggttcggtaccgtttcccgtacgtcggacccttgggacgtcccggctaccggtcccggccggacgaaagggccgtggaacgttatacgttaggaacgtaactcgtaatccggaccgtagggcgggaacccgcctacgtacctaacccaaccccggttcctaacgaacgtacgtaccggcgttacacgacctaagtcgactacgtcgaaccgtacccgtcccaacgaacctcttccgacccgtagactagtgtaagttactacgtcgacccgtcgaccgaggtacaccggttcgtacgttacgtttccaggtcgcgtaaggacggtacgttacgtttagttaccggaaactacgtaccgttaaacgtttaaaccttcgtaaccgttacggtacgttacgggtaaccgttcgggtacgggaacccgggaaggaccggtaaccgg

SEQ ID NO: 246820 - DNA, 770 bp, Homo sapiens
  misc_feature: GYAE6OF01DD8FA.9.70.G04.1.454.CMB.1.raw
  modified_base (276)..(276): a, c, t, g, unknown or other
  misc_feature (276)..(276): n is a, c, g, or t
  modified_base (324)..(324): a, c, t, g, unknown or other
  misc_feature (324)..(324): n is a, c, g, or t
tcagtgatacgtctcacgaccggtgctcgatttagtgtagtgtgaagggaagggcctgtgaaggcttcactagtcctggacctcctgtgcaaagaacatagaaacatctgtggttcatcctcctcctgggtcggcacgcctcccaagtagttcgggtcccttcggtacccgagggtcgccggtctgcgagggacggtccgggacccaggtactagtcgaacgtccttacaacgcggtccctcgtaccctcaccgtgcctacgtcgtctcgtggtcncctcatgacggtggttcgttccttaccacgtcgacgtgacgtccggcncgccgacgagaaggctggatatacgtcggactatcagcgacggtagtcggacctcaacgtacctaaccgtacccgtcgtaacgagtcgtcgtaaacgtcaacggtctaacgtccgtacgtaacgaccgacgtaccctaccgtaacgtactccggttcctaccgtaggtaacgttaggtacgttaattaccgacgtacccggtccccgtacgacgtaaccggtacggtcccggttacgtttagtacggttcggtacgaggacggttacggttaaccgggttacggttaaccgttttaaccggtaccggaaccgttaaacggtttacccttaaaaaccgggtttaacccgtacggtttacccggttaacgggttacgggtttaacccggtacggggttacccggggtaacccggggaaccgggttaacccggaaccggtttacccggg

SEQ ID NO: 246821 - DNA, 656 bp, Homo sapiens
  misc_feature: GYAE6OF01DRFOJ.9.70.G04.1.454.CMB.1.raw
  modified_base (236)..(236): a, c, t, g, unknown or other
  misc_feature (236)..(236): n is a, c, g, or t
tcagtgatacgtctcacgaccggtgctcgatttagtgtagtgtgaagggaaagggcctgtgaaggcttcactagtcctggacctcctgtgcaaagaacatgaaaacatctgtggttcatcctcctcctggtggcagctcccagatgggtcctgtcccaggtgcggctgcaggagtcgggcccaggactagtgaagccttcacacggccctgtccctcacctgcactgtctctggtnacctccatcgaggaggttggtccgttcctacgtcggacctggactccggcacgtcccgcggacgaagggcgtggaagtagtagtaggaacgtaatctatcgacgtaggtcgggacccacgtactcctaaccgaccccgtcctacgaagcgtcgaagtcgacgtctagtcgtactacgtacgaacctaccgtacccaacgaaccctacgttcctacccgtacgtactaggtagtagtttaactacgtaccgtacccggccgacgacgtacgaccgggtacgttgttaacttcgtgtacgacggtaagacggtacggttaccgtttaagtttacggacctaagtacgttaaacgttaaaccttccgtaacgttacggtcgttacggtacgtacggtacggggaccgagggtaaccgtaacgg

SEQ ID NO: 246822 - DNA, 854 bp, Homo sapiens
  misc_feature: GYAE6OF01DFYZL.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatccctcctcctggtggcagcctcccagattcgggtcctgtcccaggtgcggctgcagggacgtccgggacccaggtactaggtagaacgtccttacacgacggtccctgtcccctcacctgacctacttgttcctcgtggtacgacccttaccagtaccgaaggtgggttcggtttccgttaccctacgtccgggaaccgttggaccgttcccgggactaaccgggtccccggaccggaaggaacggggttacgtggggtaaagttaagtttacggttacggggaacttaaagtccgttaaggtccggaccgtaaggggtaccgggaacccctctaagtcccctaaacccgtaaccccgtttcccaaagaaacggtcgtaaccgaggttacccaaggtaccctaagtcggtaccgtaacggtacccgaaccgtcccggttaacccaacggttaaccccgttacgttccctaccccgttagaacggtacgtagttaacgttaactaccggtaccgaacccgtcgaaccggtaacgtaacccggacgttaccggtactttacgttacccggtaggtacggaccgttaaggtacggtacggtttacccgtttaaggttaccgaaacctacggttaacgtttaaaacccgttaaaaccgttcccgttaaaccggttaccggttcggtaaccgggtaccggttaccgggtacgggacccgtaacggggtaacctaacccggg

SEQ ID NO: 246823 - DNA, 842 bp, Homo sapiens
  misc_feature: GYAE6OF01E3718.9.70.G04.1.454.CMB.1.raw
  modified_base (144)..(144): a, c, t, g, unknown or other
  misc_feature (144)..(144): n is a, c, g, or t
tcagtgatacgtctcacgaccggtgctcgatttagtgtagtgtgaagggaaagggcctggtgaaggcttcactagtcctggacctcctgtgcaagaacatgaaacatctgtggttcatcctcctcctggtggctagctcccagntgggtcctgtcccaggtgcggctgcgaggcgtccgggcccaggactagtgaacgtccttcacgacggtccctggtacccctctacctgctactgtcctcgtgggtcacctccatcgaggtacgggttcggttccgttccgtacgttcgggtacccttggggaccgttccgggacctacggtcccggcccgggacgaacgggtaccggtggtaacgtatacggttaggaacgtaagttaccgtagttcgaccggtaggtacggggaccctacctacgttaccctaaccgaccccgtccttaacgaaggttcgaccgtacgtacgtacgcgtaagtcggtaccgtaacggtccgtaacccgtacccggtaaccacgtaaaccctcggtttccctacccgttaagaccgttaagtcgttaacgttactaggtcccgacccgtacgaacgtaccggaacgtcccgggttaacgttcgtaacgtttaccggtagggtccggaacggtaagggttaacggacccgggttttaaccgttttaaacgggttaagggaaccccgtaagggttttaccgttaaaaacccgggtttaaaccttccccggtttaaacgggtcccggtttaaccggttaacgggggtcccggttttccggggaaacggggggtacccccggtaaaccgggggtaaccgttaaccccggggg

SEQ ID NO: 246824 - DNA, 785 bp, Homo sapiens
  misc_feature: GYAE6OF01EOGMC.9.70.G04.1.454.CMB.1.raw
  modified_base (639)..(639): a, c, t, g, unknown or other
  misc_feature (639)..(639): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggaggtccgggcccagggactagtgaacgtccttacacgacggcccttcgtcccctcaccttgcctacttgtccttcgtggtacgacctccattaccgaggtagggttcggttccgtttacctaccgtcgggtacccgtgggaccgttcccggcgtaaccggttccccgggacccggacggaaacggggtaccgttagggtaaggttacgtttaggttacgggaaaccgttaacttacgttaacgttccggaccggtaacgggttcccggggaaccccgtccccgttaacttaccccgttaaaccccgaaacccccccggttcccgttaacgaaacggtaccggttcggtaaccgtacgaccgtactaacgttcgtagtaccggtaccgaacctacccgtacccgaacgtaaccgtaccgtttccctaccgtagtacgtagtagtaagttaactcggtaccgacgcccganacggacccggcgtccgttagttactacgtggtcgaggaacgtaggtacgtttacgtttagtaccgtactacggttaacttaacgttaaacctcgttaacggcgttaccgcggtacggtacgtaccgggcgaagggtaccgtaccgg

SEQ ID NO: 246825 - DNA, 687 bp, Homo sapiens
  misc_feature: GYAE6OF01CGDFB.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggccaggactagtgaagtccttcacgcggtccctgtcccctcacctgctacttgtcctcgtggtcacctccatcgaggtacggtcgttccgttcctacgtcgggtaccgtggaccgttcccggactaccggtccccggccggacgaacgggggtactgggaacgttagttagttcgggaacgttaattcctagtcgaccgtagggtccgggaccctctactcctaaccgtaccccgtcctaacgaagtcgtacgatcgacgtactagtcgacgtacgtacgacctaccggtacccaacgaacccgtacgtcctacccgtcgacgaacgtggtaacgttacgtacgtcgacccgaccgtccgaacgacggtaccgtacggtccgttacgttactgtacgacggacgtaaggtccgtaacgtttacgttacgtaccaagtacgttaacgttaaacttacccgttcgtaccggtcttcggacggttccgaacgggtcggacggtaccgtaccgg

SEQ ID NO: 246826 - DNA, 630 bp, Homo sapiens
  misc_feature: GYAE6OF01CDYD7.9.70.G04.1.454.CMB.1.raw
  modified_base (233)..(233): a, c, t, g, unknown or other
  misc_feature (233)..(233): n is a, c, g, or t
  modified_base (280)..(280): a, c, t, g, unknown or other
  misc_feature (280)..(280): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactcatcgagtaggtcggtcgttcctacgtcggacctggactccggnacgtcccgcggcgaagggcctggatatagtggacgtatctancgccaggtcggacncatcaccacccgtcctacaagcgtacgagacgagcagttcgacagtccgacgtaccgtacccgaacgaacccgtacgttccctacccgtacgaaccgtagtacggtaacgtttagtacgtaccgtacccgcccgaccgaacggaccgtaaccggtccgtaagttacttacggtgtcggacgagtaggtaccggttaccgtttagttacggacctaggtacgttaacgttaaaacctccgttaacgtacggtacgtacgggtacgtcggacgggccgaagggtaccgtaaccggg

SEQ ID NO: 246827 - DNA, 817 bp, Homo sapiens
  misc_feature: GYAE6OF01B1S50.9.70.G04.1.454.CMB.1.raw
  modified_base (195)..(195): a, c, t, g, unknown or other
  misc_feature (195)..(195): n is a, c, g, or t
  modified_base (311)..(311): a, c, t, g, unknown or other
  misc_feature (311)..(311): n is a, c, g, or t
tcagtgatacgtctcacgaccggtgctcgatttagtgtagtgtgaagggaaagggcctgtgaaggcttcactagtcctggacctcctgtgcaagaacatagaaacatctgtggttcatcctcctcctggtggcagctcccagagtcggtcctgtcccaggtcgcggctgcgaggacggtccgggccaggactagngaacgtccttacacgacggtccctgtcccctcaccgtgccacttgtctcgtggtcacctccagtacgaggtagggttcgttccttcctagtccggaccgtaggacctcccgggacncggtcccggacggacgacgggtctagggatttacgtagttcggaaacgtactacgtacgtcgaccgtagggaccggccgacctacgtacccaccgtaaaccccgttccaacgaaaggtccgtaacggtcgtaccgagtaccgtcgtacgtccgtaacggtaccccaaccgtaaccccgtacccgtaaacgtaacccgttacccgtttacccctaccccggtaagaaacggttaacgttacggttaaacgtttacgtaaccggttccgggaccccggttaaccgaccggaaaccggtacggtaacccggttcgtttaacgtttaaaccgtttcgggacggtaccgggtaaggtacggttaaccggggttccggttttaaacggttttacggtttaaccggaaaccgttaaggttaaccgttaaaccggtttaaacccctccggtttaaacggtaccggtcgtacgggttacggtcgggaccgggtacggtaaccgggaacgtaccgg

SEQ ID NO: 246828 - DNA, 765 bp, Homo sapiens
  misc_feature: GYAE6OF01E18NH.9.70.G04.1.454.CMB.1.raw
tcagtgatacgtctcacgaccggtgctcgatttagtgtagtgtgaagggaaagggcctgtgaaggcttcactagtcctgacctcctgtgcaagaacatgaaacatctgtggttcatcctcctcctggtggcagctcccagatgggtcctgtcccaggtgcggctgcaggagtccgggacccaggactagtgaagccttcacacggccctcgtccctcacctgcactgtctctggtcactccatcagacggtgttcgttcctacgtcggacctggactcccgggacacggttccccggacccggacgaaacgggggtacctagggggtaagttaattaggtttacgggaaaccgtaaattccttaagtcggaccctaaggggtcgggaaccccgtaccacgttaccctaaccgtaaacccccgttcccctaagaaacggttacgtaccgagtaccaaggtccaagtcggtacacggtaccacccgtaacccgtaccccgaacgtaacccgttacgtttccctacccctacgaaccgtaaggttacggtaacgtttaactacgtccggacccggcccgtacaaaccggtaccgacccggtccggttagttacttaaccgttgggtacgaccgggtaagaacggtacggttaccgttttaagtttaccgggactacgtaacgtttaaccgttaaaacccttccgtacgttccggtacgtacgggttaccgtccgggacggggtaacccggacgggtaacccgtaacgg

SEQ ID NO: 246829 - DNA, 603 bp, Homo sapiens
  misc_feature: GYAE6OF01BBXSL.9.70.G04.1.454.CMB.1.raw
  modified_base (343)..(343): a, c, t, g, unknown or other
  misc_feature (343)..(343): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctccatcgagtaggttcggtcgttcctactggacctggactccggcacgtccgccggcgaagggacctggagtatagttggacgtaatctatgcctaggtcgggaccnctatcctaccaaccccgtccacaagacgtcgacgtcagcatcgtcagtccacaccgtcccagaaccctagttcctccctagacagtacgtagttatagtcgaccgccgcacgaccgacggtccgtagtacttacgtcggtagcgagaggtacggtccgtttagtttacggacctagtaccgttaacgttaaaacctccgttaacgtacggttcgtacgggtaccgttcggtacggggacccgtaggggaaccctaacggg

SEQ ID NO: 246830 - DNA, 809 bp, Homo sapiens
  misc_feature: GYAE6OF01B68Z7.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggccaggactagtgaacgccttcacacggccctgtcccctcacctcgccacttgtcctcgtggtcgacctccatcgaggtaggtcggttccgttccctacgtcggaccttggacgtccggctacggtccccggaccggtacgaaacggggtacgttagggacgttaagttacgttacgggaacgtaattcgttagtacggccgtaacgggtcggggaaccccacctaacttacccgtaaacccgaacccccgttcccctaacgtaaacggtacgttaccggtacgttccaacgcgtaagttcgtacgtacggttccgaaccgtacccggttaacccccaaggaaaccccgttacgtttcccctacccgtacggtaaccgtaggttacggttaaacgtttacttaacgtacggaccccggtaccgaccgtaaacgggacccgtaacccgggttccggttacgtttaacgtttcgtcgggtacgaccgggtaaggtaaccggtacgggttaccgttttaaagtttaccggggacctaacggttaacgtttaaaccgttaaaaccttccggttaacgttacggttacggtacgggtacgttaccggaccggggcgtaaaccgggtcgtaaaccggg

SEQ ID NO: 246831 - DNA, 855 bp, Homo sapiens
  misc_feature: GYAE6OF01DT5G9.9.70.G04.1.454.CMB.1.raw
  modified_base (106)..(106): a, c, t, g, unknown or other
  misc_feature (106)..(106): n is a, c, g, or t
tcagtgatacgtctcacgaccggtgctcgatttagtgtagtgtgaagggaaagggcctgtgaaggcttcactagtcctggacctcctgtgcaaagaacatgaaacntctgtggttcatcctcctcctggtggcagctcccgagagtcgggtcctcgtcccaggtgcgctgcaggacgtccggacccaggactaggtgaacgtccttacacgacggtcccttcgtcccctacacctcgcctactgtcctcgttgggtactacctcctagtacgaggtacgggttcgttccgttcctaacgtcggtaccgtcgtaacgtcccggacgtaccggtccccggccggaacggaacggggtacgtaagggtaagttaacgttaggttacggaacgttaacgtccttagtccggaccgtaaggtccgggaccctactaacttaccaaccccgtaacccgtcctaaggaacgtacggttaccgtaagtaccaggtactacgtcggtacgaacggttaccgaaacccgttacccggtaacccaaaccggttaaccttccgtttaaccccctacccggttacgaaacgttaacggttagttaacgtttaacgtcccgtaccggaaacccccgtcggaaaccgtaccggtaaccggtaccggtacccgtttagttaaacgtttccggtagttaacgggaaccgttaacgggtaaccggtttccggtttaaaccggtttttaaggttaaccgaaccgtaacgttttaaacgtttaaaacccgttaaaccgttcccggttaaacgttacggggttcctaaccggggtcgttccgggaacggggtcccgaaaggggtacccctaacggg

SEQ ID NO: 246832 - DNA, 699 bp, Homo sapiens
  misc_feature: GYAE6OF01BN2WP.9.70.G04.1.454.CMB.1.raw
  modified_base (360)..(360): a, c, t, g, unknown or other
  misc_feature (360)..(360): n is a, c, g, or t
  modified_base (557)..(557): a, c, t, g, unknown or other
  misc_feature (557)..(557): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatcgggtcctgtcccaggtgcggctgcaggagtccgggcccaggactagtagaacgtccttacacgacggcccttgtacccctcacctgctactgtctcgtaggtcactccatcaggtaggtcgtccgttcctacgtcggacctggactccggctacggtccgcggtacgaacgggctggagtatagtggaactatctagtcggaccgaggtcgggacncctatacctaccgaacccgtccacgtaagacgtacgacgtcacgtactagttcgtactacggtaccgacgtaccgtaccgaacgtaacctacgttacccctacccgtagtaccgtaggtacgttaacgtttaatacgtaccggacccgtaccgacgtaacggaacccgtccgggtaccttaggttaaccgtttacgngggtacgacggtaggtaacggtacggttaccgtttaagttcggaaccgtagtaccgtttaaaccgttaaaccttcccgtaaacggttacggtaccgtacggggtaccgtcgggtcggggaccgtaaacgggaccgttaacgg

SEQ ID NO: 246833 - DNA, 923 bp, Homo sapiens
  misc_feature: GYAE6OF01A7GAE.9.70.G04.1.454.CMB.1.raw
  modified_base (179)..(179): a, c, t, g, unknown or other
  misc_feature (179)..(179): n is a, c, g, or t
tcagtgatacgtctcacgaccggtgctcgatttagtgtagtgtgaagggaaagggccgtgtgaaggcttcactaggtcctggacctcctgtgcaagaacatgaaacatctgtggttcaattcctcctcctgggtggcgagctcccagatgggtacctgtcccgaggtgcggctgcaggngtcggcccaggactagtgaacgccttcaacgacggccctggtccctacgacccgttgccactgtcctcgtgggtcaaccttccaaagtccgaaggtacggttggttccgttacccgtacgtacgggtacccttgggaaccttcccgggactaacgggtccccggaccgggtacgaaaacgggggtcccttagggggtaactttaagtttaacggtttacggggaaaccgtaaacgttccgttaaacgttcgggaaccccgggtagggttaccgggggaacccccgtaccgtaaacggtttaccccgtaaccccggtaaaaccccccggtttccccgtaaagggaaaacccggtaacggttacccggtaacgttacccgaaggtccctaaagttcggtaccgaacggttacccggaaacccgtaaccggttaccccgtaaaccggtaaccccgttaccgtttaccccgtacccgtacggtaccgtacgggttacgtaaccggttaacgttacggtacccgtaccccggtaccggacgtaacggaaccgtaaccgggtaccggttacggtttaaccgtttacggttacggtacggtaaccgggtaacggtaaccggtacgggtttaacccgtttaacggttttaaccgggaccgtaacggttaaccggttaacgtttaaaaccgtccggttaaaccggtacggttcgtacgggtacgtcggtacgggccgaagggaaccgtacggg

SEQ ID NO: 246834 - DNA, 721 bp, Homo sapiens
  misc_feature: GYAE6OF01CA2AO.9.70.G04.1.454.CMB.1.raw
  modified_base (584)..(584): a, c, t, g, unknown or other
  misc_feature (584)..(584): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagcctcccagagtcgggtcctgtcccgaggtcgcggctgcaggaggtccggccaggactaggtgaacgtccttcacgcggcccttcgtcccctcaccgtgacctactcgttctcgtggtcgacctccatcgaggtacggttcgttaccttcctacgtcggacctggtactaccgacgtacggtccccgccggacgaacggtcgtaggattagttagtacggaacgtaatcgtacgtcgacgtagggtaccgggacccacctacgttacccaacccgtaaccccgtccgtaagaacggtcgtaccgacgtccgacgacgtacgttcgtaccgtacgtaccgaacccgtaccgtacccaacgtaacccgtacgttccctaccgtacgacgtaggtacgttagttaacgtgtaccggaccgcgacgaacgtccgacggtcgtacgttacgttcgngtcgacgaggtacggtacgttacgtttaagtttaccggaaccttagttaacgttaaacgttaaccttaccggtacgttaccggttacgacgggttaccggtacgggaccgggaccgggtaacgggtaccgtaccggg

SEQ ID NO: 246835 - DNA, 833 bp, Homo sapiens
  misc_feature: GYAE6OF01CDHQ9.9.70.G04.1.454.CMB.1.raw
  modified_base (241)..(241): a, c, t, g, unknown or other
  misc_feature (241)..(241): n is a, c, g, or t
tcagtgatacgtctcacgaccggtgctcgatttagtgtagtgtgaagggaaagggcctgtgaaggcttcactagtcctggacctcctgtgcaagaacatgaaacatctgtcggttcatcctcctcctgggtggcagctcccagatgggtcctgtcccaggtgcggctgcaggtagtccgggccaggactagtgaagccttcacgacggccctgtccctcacctgcacgttgtctctggtancctaccatcgaggtaggttcgttccgttacctacgtcggaccgtggacgtcccgggactaacggtcccggaccggtacggaaacgggcgtgggtaagttaacgttagttacggaaacggtaacttctaatccggaccgtagggtacgggaccctacctaacgttaccctaaacccaccccgtttccaagtaaacggacgtcgaaacgttcgaacgtctagtcgtacctaacgggtaccaaccgtacccggtaccctaacggaaaacccgttacgtttccccttaacccgtacggtaaccgtacggttaggttaacgtttataaccggtaccggtaaccccgaccggaaccgtaaccggtaaccggtacccgggtaccggtttacgttaaaccgtttacgttcggtaccggtaacgaagggtaagggtaccgggtttaaccggttttaaccgtttaacgggaacccgtaaggttaaccgtttaaaacggtttaaaaccccttacccggttaaacgttaccggggttataccggggttaaccggccgggtttaacggggggaacccggtaaccgggggtaaccgtaaacccggg

SEQ ID NO: 246836 - DNA, 742 bp, Homo sapiens
  misc_feature: GYAE6OF01BZE41.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctctggtgcagctcccagattcgggtcctgtcccgaggtgcggctgcgaggtacggtcgggcccaaggtactaggtgaacgtccttcaacgtcggcccttagtccctcaccgtcgctacgttgtcctcgtggtacacctccattacgaggtaggttcggttccgttaccgttacgtcggtaccgtggtacgtcccggactccggcccggaccggacggaacggggtacttagggtacgtagttacgttacggaactaaacgttcgtaagtcggccgtacgggtcgggtaccacgtacgtacctaaccgaaccccgtcaacgaagtacgtacgagtaccgagtactagtcgtaacgtacgtacgtaccgtaccgtacccgaacgtaaccgttacgttcccgtaccgtgtaaccgtggtaaccttaagttactaacggtcaccgtacacgaacgaccgtacggtcgttaagtacttcgtagtcgtacggaacgtggtacggttacgttaaccgttaggtaaccgtagtaacgtaaacgttaaaccttccgtaacggttaccggttacgtaccggttacggttacgggacggggtttaaccccgaaggggaacccgtaaccggg

SEQ ID NO: 246837 - DNA, 668 bp, Homo sapiens
  misc_feature: GYAE6OF01BS79H.9.70.G04.1.454.CMB.1.raw
  modified_base (349)..(349): a, c, t, g, unknown or other
  misc_feature (349)..(349): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtcgcggctgcaggagtcgggcccaggactagtgaagccttcacaggccctgtccctcacctgccactgtctcgtggtcgactccatcgagaggttggtcctttacctactcggacctggacttccggcacgtcccggccggtcaagggctggagtattagttaggacgtatcgtatgccaggtcgggaccnccgatccaaccgtaacccgtccctagaacgtacgtcgagtccagactatcgtccagtccgacctaccgtacccacgaaccgtagtccctaccgtagacgtacgtagtacgttatacgtcgacccgtcgacgacgaccgtaccggtcgttagttacttcgtacgtgacggtagtacggtacggttacgtttaacgtttacgggacctaacggttaccgttaacggtttaaaacccttccgttaacccggtaccggttacggttaccgtacccggttaccgggtacggggacccggtaaacggggtacccgtaaacccggg

SEQ ID NO: 246838 - DNA, 905 bp, Homo sapiens
  misc_feature: GYAE6OF01EWYU8.9.70.G04.1.454.CMB.1.raw
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcgaggacggtcgggccaggactagtgaacgtccttcacacggccctgtcccctcacctgcacgtcgtcctctggtacacctcccatcgaggtaggttcggtccttcctacgtcggtaccgtggacgttcccggactaccggtcccggaccggacgaaacgggtcgtaggaagttagttacgtacggaacgtaactcgttaagcgaccgtagggttaccggacccgcctaacttcccgtaacccgtaaacccccgttccctaacgaaacggtaccggtacgaacgttaccgaacgtactaagtttccggtaccgtaacgtacccgaacccgtaacccggtaccccgtaaaaccggtaaaccccttaccgtttccccgttaaccccgtacggtaaccgttaacgggtacgttaaacgtttaacgttaccgtacccgggtaaccccgtacccggtaccgaaaccggtaccccggtaaccggggttaccgttaaccggtttaacgtttaaccggtcgggttaacccggaacgggtaaacggtaaccggggttaccgggttttaaccgttttaaacgggttttaacccgaaacccgttaacggttaaacccgttttaaaaaccgtttaaaaaccccgttcccgtttaaacccggttaaccgggttacggtacccgggttaacggttccggggtaaaccccgggggtaaccgggtaaacccggggtaaccgggtaaaccccggg

SEQ ID NO: 246839 - DNA, 793 bp, Homo sapiens
  misc_feature: GYAE6OF01A9W2B.9.70.G04.1.454.CMB.1.raw
  modified_base (173)..(173): a, c, t, g, unknown or other
  misc_feature (173)..(173): n is a, c, g, or t
tcagtgatacgtctcacgaccggtgctcgatttagtgtagtgtgaagggaaagggcctgtgaaggccttcactagtcctggacctcctgtgcaagaacatgaaacatctgtggttcatcctcctcctggtggcagctcccagatgggtcctcgtcccaggtgcggctgcgagngtccgggcccaggactagtgacgccttcacacggccctcgtccctcacctgctactgtctctggtctacctcatcaggtacggtggtccgttcccacggtcggaccttcgggacgtccggcgtaccggtccggccggacgaacgggtcgtggacgttattagtacggaacgaactcgtatccgaccgacggtcggtacccgacctacttaccgaacccgttaaccccgtctacgaaacgtcgtaccggtactacgacgtactacggtcgttaccgtaacggtacccggtaaccgtaacccgtacccgaacggtaaccccttcggtttacccctacccggtagtaaccggtaacggttcgtaacgtttacgaacggtaccgaccccggtaccgaaccgacgggtaacccgtcccgggtacgtttaaccgtaagtttcccggtgggtacgtaccgggtaacgtacggtaccgggtttacccttttaacggttaaccggaaccgttaacgtcccgttaaaacgttaaaacccgtttccgggtaaaccgttaacggggttccgtaaaccggggttccgtcgggttacccgggggaacccgtcgggggtaaacccgttaaccggg

SEQ ID NO: 246840 - DNA, 784 bp, Homo sapiens
  misc_feature: GYAE6OF01D138D.9.70.G04.1.454.CMB.1.raw
  modified_base (103)..(103): a, c, t, g, unknown or other
  misc_feature (103)..(103): n is a, c, g, or t
  modified_base (126)..(126): a, c, t, g, unknown or other
  misc_feature (126)..(126): n is a, c, g, or t
  modified_base (137)..(137): a, c, t, g, unknown or other
  misc_feature (137)..(137): n is a, c, g, or t
  modified_base (154)..(154): a, c, t, g, unknown or other
  misc_feature (154)..(154): n is a, c, g, or t
  modified_base (275)..(275): a, c, t, g, unknown or other
  misc_feature (275)..(275): n is a, c, g, or t
  modified_base (651)..(651): a, c, t, g, unknown or other
  misc_feature (651)..(651): n is a, c, g, or t
  modified_base (657)..(657): a, c, t, g, unknown or other
  misc_feature (657)..(657): n is a, c, g, or t
  modified_base (665)..(665): a, c, t, g, unknown or other
  misc_feature (665)..(665): n is a, c, g, or t
tcagtgatacgtctcacgaccggtgctcgatttagtgtagtgtgaagggaaaggcctgtgaagcttcactagtcctggacctcctgtgcaagaacatgaaacntctgtgttcatcctcctcgtggngcacgcccagngtggtcgtctcgacggngtcgcgcgcgagacggtcggcccgaagacgtagtagtacgtacccgttcaaccgacgccccgttccgtccctaccaccgtctaccgacttcgtcgttcgtacggtcgtaccctcctaacgngtacgggtaggtttaccggttccgtttaccgttaccgttacggtccgttacgacggttcccgcccgacggtccccggccgggtaacgaacgggtaacgtcgggaactttaggttacgtaacgggacgtaacttacgtacggttacgaccggtcggttaacggacccggtccttaaccgtacctaaaccccgtaccccgtactaccgaaagtacggccgtacgttaacgaccgagttaccgttagaccggtacgacccgtaaacccgaccccgtaaccgtaccgtaaccttacccgtccttccgtaacgacgttagtacgttacgttaaacgtctccggacccgccgtaagcccgtacggaacgtccgtaatcgttntaccgngacggtanaggtcgttacggtttagtaccgacgaacttaccgttaaaccgttaacgtacccgttacgttacgggtacctaggggccttaccggggacgtacggtaaaacggttcgggaaccttcccg

SEQ ID NO: 246841 - DNA, 704 bp, Homo sapiens
  misc_feature: GYAE6OF01AOHP6.9.70.G04.1.454.CMB.1.raw
  modified_base (145)..(145): a, c, t, g, unknown or other
  misc_feature (145)..(145): n is a, c, g, or t
tcagtgatacgtctcacgaccggtgctcgatttagtgtagtgtgaagggaaagggcctgtgaaggcttcactagtcctggacctcctgtgacaaagaacatagaaaacatctgtggttcactcctcctctggtgcagcctccagngtcgggtcctcgtcccgaggtcgcggctgcgagggacgtccgggcccaaggactagcgaacgtccttacacgcggtccctcgtccctcacctcgctcgttcgtccgtcgtggtacacctccagttcgaggtcggttcgttccttcccgtaacgtcggacccgtggaccgtccggcgtaccggtccggaccggacgaagggtcgtaggtaacgttatacggttacggaacgtattactacgtccggacgtacgggtaccgggaccctcgtaaccgttaccctaaacccgtaccccgttaccgaacgaaacgtcggtacgacgtcgagtcctagtacgtcgacgtcgacaccgtccaacgtaccttcgtcctcccgtagacgagtagtaacgttactacgtacgcccgacgtacgacggccgtaccggtcttagtactcggtcgtaggacgaggcggtacgttacggtttattacggacctaagttcgttaaaacgttaaccctcggttaacggtaccgttcgacggtccggtggtaccgggccggtaggtaccgtaccgg

SEQ ID NO: 246842 - DNA, 829 bp, Homo sapiens
  misc_feature: GYAE6OF01AEGFU.9.70.G04.1.454.CMB.1.raw
  modified_base (105)..(105): a, c, t, g, unknown or other
  misc_feature (105)..(105): n is a, c, g, or t
tcagtgatacgtctcacgaccggtgctcgatttagtgtagtgtgaagggaaaggcctgtgaaggcttcactagtcctggacctcctgtgacaagaacatgaaacntctgtgttcatcctcctcgtggtgcagcctccagagtcgggtcctgtcccgaggtcgcggtctgacgaggcggtccggccaggactagagacgtcccttacgacgaccggtccccttacgtcccctacgaccgtcgacctaccgttgttccgtacggttcgggtactaacccttccgaattaccggtaaggggttacggggttttccggttttacccgttaacccgttacggttaccgggtacccggttacggtacccgtccccggcgttaaccggtcccccgggaaccggtaacggtaaacggtacgtagggtaacttagtcggtaaccgggaacttacgttcgtaacgtcgaccggtacgggtcgaacccctacgtacttacccgaacccgtaccccggtccaaggtaagtccggttaacgactaccgacgtagtacgttcggtacccgtaggtacccacccggtaacgacccgtaacgtaacccgttccgttcccaccgtagtacgtaacggttgtaacttcgacgtacccggaccgccgagaccgtacggtccgttcgttagtacgttcgcggtacgagtcgggtaaccgtaccggtttaacgtttacggacccgttaacttcggttaaacgttaaccgtttaacccgtcggttaccggtccgtacggttacggaccggttcccgggaacgggtacccgggtaaaggtcccgtaaaccgg

SEQ ID NO: 246843 - DNA, 922 bp, Homo sapiens
  misc_feature: GYAE6OF01BDK8D.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctctggtggcagctcccagatgggtcctgtcccaggtgcggctgcaggagtcgggcccaggactagtgaaaccttcacacggccctgtccctcacctgcactgtctcgtggtcacctccatcgaggtagggtcggttccgttcctacgtgggtacctgggactcccgggacacggtcccggccgggacgaaggggtctgggtaagtttaattagttacgggaaacgtaacttcgttagtcggacccgtagggtaccgggacccgtcctaacgtacccgtaaccccaacccccggttccctaacgaaacgtacggtaccggaagtaccaccggtactaacggttacggtacccgtaaaggtacccccggtaaacgtaacccccgggtaacccccgtaaacggaaaccccgtttacggttttccccctaccccggttaagtaaccccggtaaggtttaccggttaaagtttaccgtaaccggtcccggtaaccccggtcccggtaacgaaccggtaaacccgggtacccgggttaaccggtttagttttaacgttacccggttgggtaccggggtaaccggtaaagggtacgggtaacccgggtttacccgtttttaaagggttaaccggttaaacccggtaaacggtttaacccggttaaaaacgttttaaaacccgtttaacccccgttaaacgggtttaacccggggttcggttaacccgggttaccggggttaaccggggtcccgggggtaaccccgggtaaacccgggggaacccggttaaacccggggttaccccgg

SEQ ID NO: 246844 - DNA, 793 bp, Homo sapiens
  misc_feature: GYAE6OF01DT2YG.9.70.G04.1.454.CMB.1.raw
  modified_base (405)..(405): a, c, t, g, unknown or other
  misc_feature (405)..(405): n is a, c, g, or t
  modified_base (430)..(430): a, c, t, g, unknown or other
  misc_feature (430)..(430): n is a, c, g, or t
tcagtgatacgtctcacgaccggtgctcgatttagtgtagtgtgaagggaaagggcctgtgaaggcttcactagtcctggacctcctgtgcaaagaacatagaaacatctgtggttcatcctctcctggtgcagctcccagatgggtcctgtcccaggtgcggctgcaggagtccgggcccaggactagtgaacgccttcaacgacggccctcgtcccctacacctgacctacgttgtcctcgtggtcgacctccgataccgaggtacgggttgttccgtttaccctaacgtcgggaccttgggaaccgttcccggactacggtccccggacgaccggtaaggggtacgtcgggattaagttacggtggaacgtaattcttaagtcgaccgtaggtcgggacccnctactcctaaccgaccccgttccanaaacgtcgacggtatcagactatggtaccacggtaccgaacctaccgaccccgaacgtaaccctaccgtttcccgacccttgaaccgtacggttagtacggtttactgtaacccgacccgaccgtacaacgggtacctaccggggtacgtttaacggttccttaagttccgggtcgaacgggtaaggtacgggtaccggttaccggtttttaagtttaacccgggaccttaacgttaaccgtttaaacggtttaaaaacccgttccgtttaaacccggttaccgggttccggttacgggtaacccgggtttcggggaccgggggtaacccggtaacccggggtaaccgtttaaaaccccgggg

SEQ ID NO: 246845 - DNA, 829 bp, Homo sapiens
  misc_feature: GYAE6OF01B7ORH.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccgagatgggtcctgtcccagttgcggctgcaggagtcgggcccaggactagtgaagtccttcacaggccctcgtccctcactgcactgtctcgtggtcgcctaccatacgagtacgggtggttccgttaccgtacgtcggaccgtggtacgtccggacacggtcccggccggacgaaggggtactagggtagtagttagtcggaacgtagttctagtcgaccgaggtacgggaccaccgtaatccctaaccgtaccccgtaccctacgaaacgtacgtacgtacgtcaagtccagttccgtacgacgtaccgaccgtaccgtaccctaagtaaccctacgtttccctacccgtaggaacctagggttacgtaacgtttacgtaacgtacccgggtaacccgtaccggtaaccgaaccgggtaacccggaaccccgggttaccggtttaacggtttaaccgtttaccgggtagggtaacccgggttaaccgggaaaggttaaccggggttacgggtttaacccgtttttaacggtttaaaccggggaccttaaacggttaccccgttttaaaaaacgtttaaaccccgtttcccgtttaaaccgggtttacccggtttacctaccggggttaacccgggtttacgggttacccgggggaacccgtaacggggttaaaccccggtaacccggg

SEQ ID NO: 246846 - DNA, 807 bp, Homo sapiens
  misc_feature: GYAE6OF01CFTCA.9.70.G04.1.454.CMB.1.raw
tcagtgatacgtctcacgaccggtgctcgatttagtgtagtgtgaaggaaggcctgtgaaggcttcactagtcctggacctcctgtgcaagaacatagaaacatctgtggttcactcctcctccgtggtggcagctcccagagtcgggtcctcgtcccgagggtgccggctgcgaaggtcgtccgggcccaggactagtgaacgccttcacacggcctcgtccctcacctgctactgtctgtcggtcactccagtcgagtcggtcggtcttccgtagtcggaccgtggtacgtcccggataccggtccggacccggtacgaacggggtaccgtagggtaaagtacgtttagtacgggtaacgtaacttcgtaacgtcggacccgtaagggtacggggacccctccaacgttaccccgtaacccgtaacccccggttacctaacgaaacggtacgttaccgggaaggtcccaaggcctaagtccggtacggtacggtacccggaacccgttacccgtaaccccgtaaccggtaacccgttaccgttacccgttaccccgtacgtaaccgtaaggtttaccgtaaggtttaactaacggtccgtaacccgacccgaccggtaacccggtaaccgtacccgggtaccgttacgtttacgttaccggtacggttacggtacggaagggttaaccggtacgggtttacccggttaagtttaccggaccgttacgtaacgttaaacgttaaaccgtcgttaacgtacggtacgtacggacggtacggtacgggaccgtcgggaaccgtaccgg

SEQ ID NO: 246847 - DNA, 726 bp, Homo sapiens
  misc_feature: GYAE6OF01B00ZG.9.70.G04.1.454.CMB.1.raw
  modified_base (234)..(234): a, c, t, g, unknown or other
  misc_feature (234)..(234): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgaggccctgtccctcacctgcactgtctctggtnactccatcaggtaggtggtcgttcctacgtggacctggactcccggctacggtccccggccggacgaaacggggctagggaagttaacgttagttcgggaacgtaattctagtcgccgtaggtcgggaccgccaagttacctaaccgaacccggtccctacgaaggtacgtcggacgtcagcatcgctaagtccgaactaccgtacccaacgaaaccctacgtttcctaccctagaaccgtaggttacgtaagtttaacgtaacgttaccggacccgacccgtaccgaacgtaaccggaacccgggtcgttacggttaacgtttaccgtgggttacgggacggtaacgggtacggtacgggttaccgttttaacgttttaaccggaccgtaagtaccgttaaacgttaaaacccttcccgtaacgttaaccggtcgttacgggtacggttcggtaccggggtacccggtaaggggtacccgttaaaccgggg

SEQ ID NO: 246848 - DNA, 775 bp, Homo sapiens
  misc_feature: GYAE6OF01CKWP4.9.70.G04.1.454.CMB.1.raw
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
tcagtgatacgtctcacgaccggtgctcgatttagtgtagtgtgaagggaaagggcctgtgaaggcttcactagtcctggacctcctgtgacaaagaacatagaaaacatctggttggttcattcctcctccgtgggtcggacaggcctcccgagtacgttcgggtcctcgtacccgagggtcgcggctggcgagggtacggtccgggccgaggactagtagaacgtcctcaacgcggtcctcgtcctcacctgacnctcgtctgtgtacgtacctcancgagtcggtgttaccgttactacgtcggtaccgtaggaccgtccgggactacggtccccggacggtaaggaacgggtaccggtaggtaacgttagttacgtaacgggtaactaacgttctaacgtcggaaccggtacgggtaccgggtaccccaatacccgttaaccaaccccggtaaccctaccgtaacggtaacgtacgtaactaaaccgcggactaaccgtagtccgtaacggaaccttaccgaaccgtacccgttaacgacccgtaacctccgttacccacgtaacgtacgtagtagtaacgtagtaccgccggaccacgaccacggactaccgttagggttacttacgtacggtcgtacgaggttacggaacggttacggttaccgtttaagtaccggaacttggtaaaacccgttaacttaaaccgtccgttaagggtccgtaacgtcggaccggttacgggccgggaaccgtagggaacccgttaccgg

SEQ ID NO: 246849 - DNA, 800 bp, Homo sapiens
  misc_feature: GYAE6OF01AMJMM.9.70.G04.1.454.CMB.1.raw
  modified_base (201)..(201): a, c, t, g, unknown or other
  misc_feature (201)..(201): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctccgtggtggcagctcccagagttgggtcctgtcccgaggtcggccggctgcgaggacggtcgggcccgaggacttagngaacgcccttcacgacggtccctgtcccctcacctgcctacgttgtcctcgtgggtcgtacctcctactacggaggtacgggttcggttcccgttaccgtacgttcggaccgtggtaccggtcccggactccgggttaccccggaccggacggaaacggtaacggttaggtaacgttaaactacggttaacggaacgtaacttgtaactcggtaccgtacgggtacgggacccctactaaccttaccctaaacccgaccccgttcaccgtaaagccgtacgtacgtcaagtccgagtacgtacgacgaccgtaaccgacccgtaccaaccgtaacccgtacgttaccgttacccacggtacgtagttaccgttaagtacttacggtaccgacccgtaccgaccgtaacggaccggtaaccggcccgttaagtaaccgttacgtcggtacgtacggaaggttaccggtacgttaccggttttagttaaccgtaccggtaacgtacgttaaaccggttaaacccttacgtaccggttaacggtcgtaacccgggttcgttacgggaacccgggtacggtaaaccggggtaacgtaacccgg

SEQ ID NO: 246850 - DNA, 669 bp, Homo sapiens
  misc_feature: GYAE6OF01B7HH9.9.70.G04.1.454.CMB.1.raw
  modified_base (237)..(237): a, c, t, g, unknown or other
  misc_feature (237)..(237): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctcgtcccctcacctgcactgtctcgtggtnactccatcgaggaggttcggttccgttacctacgtcggacctggactcccggcacggtccggccggacgaaggggctagggatagttacgttggaccgtaattcctagcgccgtaagggtcgggacccacctactacctaaccgacccccgttcctagaaacgtcgtccgagtccagcaattcgtacacgtcgaacctcccgtacccaacgtaacccttacggtttccctacccgtacgaccgtaggtacgtagtttactacgtccgacccgccgacgaacgaccgtaaccggtcgtagttattcgtgtcgacgagacggacgtaccttaagtttacggtttacgacgtaactacggtttaaacgttaaaaccttccgttaacgttcggttacgtacggacggttcggaccggggtcggtaaccgggaaccg

SEQ ID NO: 246851 - DNA, 928 bp, Homo sapiens
  misc_feature: GYAE6OF01B7PI9.9.70.G04.1.454.CMB.1.raw
  modified_base (484)..(484): a, c, t, g, unknown or other
  misc_feature (484)..(484): n is a, c, g, or t
tcagtgatacgtctcacgaccggtgctcgatttagtgtagtgtgaagggaaagggcctgtgaaggcttcactagtcctggacctcctgtgcaagaacatagaaacatctgtggttcatcctcctcctggtggcagctcccagatcgggtcctgtcccgaggtgccggctgacgagggacggtccgggacccaggtactaggtacgaaccgtccttacgaaccgacgggtcccttccggtacccctcacccgtggcctacgttcgtccttcgtcggtcacctcgtactcgaggtacggttcggttccgttaccgtacgttcggtaccgtggtacgtcccggtactacggcccggaccggtacgaaaggggtcgttaggacgtttaagtcggttacggaacgtattcccgtagtcgcgtaggggcgaacccgctaccgtacccgtaaccaccccggtctaacgtaacggcgttacgtacgcgtacncttaaagttccggtacgtaacgggttaacccgaacccgtacccgtaacccggaaacgttaaaccccttccgggttaccccttacccggtaagtaccggtaacgggtttacgttacgtttaacgttaccggaccccggtaaccccgggtagaaccccggtacgggggaaacccttaacccggggacgttttttaaaccggttaccggtttaaccggacgggtttacgggaaccggttaacgggttaaccggttaaccgggtttttaacgggtttaccgtttaaccggtaaccggttaacgttaaaccccgtttttaaaacggtttaaaacccgttccccggtttaaaccgggtttaccccgttcgggtttaaaccgggttaaccccggggttcggggaaaaccggggtccccgggttaaaacgggggtaaccccgttaacccggg

SEQ ID NO: 246852 - DNA, 664 bp, Homo sapiens
  misc_feature: GYAE6OF01BWFIQ.9.70.G04.1.454.CMB.1.raw
  modified_base (138)..(138): a, c, t, g, unknown or other
  misc_feature (138)..(138): n is a, c, g, or t
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
tcagtgatacgtctcacgaccggtgctcgatttagtgtagtgtgaagggaaagggcctgtgaaggcttcactagtcctggacctcctgtacaagaacatgaaacatctgtggttcatcctctctggtgcagctccagntgggtcctgtcccaggtgcggctgcaggagtcggcccagactagtgaagtccttacacacggcccttagtccctcacctgcctactgtctcgtggtacactccatcgaggaggtcgtcgttcctactggacctggactcggcaggtccgcggagaaggtntggagtatagtaggaacaatctancgacaggtcggaccnctatcctaacaacccgtccagaagtcgtacgagtcgagctagtcgtacgtaacgtcgaacgtacccgtaccaacgtaacctacgttcctaccgtacgacgtacgtagtaagttaactacgtaccgacccgcgacgaacggaaccgtacggtaccgttagtaacgtttaacgtgtacggaacggtaggacggtaggttaccgttaaggttttacggaacctagtaacgttaaacgtttaaaaccgtccgttaaccgttacgggtacgttagggtacccgggttaccggtacggggtaacccggaaccgggtaacggtaggtaaccccg

SEQ ID NO: 246853 - DNA, 943 bp, Homo sapiens
  misc_feature: GYAE6OF01D36A2.9.70.G04.1.454.CMB.1.raw
  modified_base (366)..(366): a, c, t, g, unknown or other
  misc_feature (366)..(366): n is a, c, g, or t
tcagtgatacgtctcacgaccggtgctcgatttagtgtagtgtgaagggaaaggcctgtgaaggcttcactagtcctggacctcctgtgcaagaacatagaaacatctgttggttcatccctcctccgtggtggcagctcccagatcgggtcctgtcccgaggttgcggctgcgagggacggttccgggacccaaggtacttaggtagaacgtcccttacaaccgacggtcccctcgtccccctacgaccctgacctaccttgtccttcgtggtacgtacctacgacgtaccgaggggtacggttcggtttaccgtttacccgttacgtaccggtacccgttagggtacccgttacccgggtaccnccgggttacccggacccgggtaacggaacggggtacggttacgggtaagtttagttaacggtacgggtaaacgtaacgttacgttacgcgaccggtacgggtcgggtaccccgtacctaagttacccctaacccgtaaccccgttacccgtaacgaacggtaccgtaccgtaacgtacgaccggtactacgttcgtacgtacggtaccgaaaccgtacccgtaacccgaacgtacccgttaccgttacccgttacccgtcgtaaccggtaagttacgtaacgtttactaccggttaccgggaccccgtaccgtaccggtaacgtaaccccggtccggttaacggttacgtttaacgtaccggttacgggtacgggtaccgtacgggtaacgttaccgggttttaccgttaaacgggtttaaccgaccggtttaattaaaccggttttaaaacccgttaaaacccggttacccggtttaaacccggtacgggtttaacccggtaacgggtttcccgggttaaacccggggacccgggggtaaccggggtaacccggggtaaaccgttaaaccccgggg

SEQ ID NO: 246854 - DNA, 643 bp, Homo sapiens
  misc_feature: GYAE6OF01AWHNO.9.70.G04.1.454.CMB.1.raw
tcagtgatacgtctcacgaccggtgctcgatttagtgtagtgtgaagggaaagggcctgtgaaggcttcacaggccctgtccctcacctgcactgtctctggtgactccatcagaggtggtcgttcctactggacctggatccggcagtcccgccggcaagggctggagtatattggacgaatctatgccagtgggaccgccatctaccaacccgtccctacaagacgtcgagtcagcatcgtcagtcgacaccgtcccagaaccagttcctccctgacagtgagttatatgacccgccgcgagaccgacggccgtgtattactggtgcgagagtaggccgtttagttttaggaccaggacttacgttaaaaacctccctaagtaccggtcgtcgggacgttcgtggggccgacggggacctacggtcaccgtctcctcacgtccctccaccgaacggccctacgtccggttaccttcccccgtaggcccgtcccgtcgtccgtccacgggacgtccacccgtcgaacgtcgaccgaacacgggtcccggacccggtgggacccgcggtccgtcggtaccgtaaacggtaccttaccttccgaacgtacgtactccgtaacgtcggaaccgggcggtaccggg

SEQ ID NO: 246855 - DNA, 788 bp, Homo sapiens
  misc_feature: GYAE6OF01D9B8Y.9.70.G04.1.454.CMB.1.raw
tcagtgatacgtctcacgaccggtgctcgatttagtgtagtgtgaagggaaaggcctgtgaaggcttcactagtcctggacctcctgtgcaagaacatgaaacatctgtggttcactcctcctcctggtggcagctcccagatgggtcctcgtcccgaggtgcggctgcgaggagtccgggcccaggactagtgaagtccttcacgacggccctcgtccctacaccgtgcacgttgtctcgtggtcgtacctccagttcgaggtacggttcggttccgtttacctacgtccggacctggtacctccggctaccggtccccgaccggacgaacgggtacgtcgggtaagttacgttacggtttacgggaacgttaacttcgttagtacggcgtacgggtacgggaccccgtactacttacccgtaaccccgaaccccgttaccgtaacgaacggtacgtccgagtaccgacgtctagtcgtaccgacgttaccgaaccgtaccgtacccgtaacgtaacccgtaccgtttcccgtacccgtacgtaccgtaggttacgtaagtttacgtaccgtaccggaccgtacccgagacggtaccggaccgggttacgttaggtttacttaggtccggtagaccgggtagaaccggtacggtttaccggttttaagttacccggacttaacggtaaaccgtttaacgttaaaacccgttcccgttaacgttacgggttacgtaccgggttaccggtcgggtacccgggacgggttaaccgggaaccggtacccgg

SEQ ID NO: 246856 - DNA, 905 bp, Homo sapiens
  misc_feature: GYAE6OF01BVT8C.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaacgccttcacgaggcccctgtcccctcacctgcctacgtgtctcgtggtcgacctccatcgaggtaggttcggtccgttccgtacgtcggacccgtggactccggctacggtcccggccggacgaaggggtctgggaagttatacgttacggaacgtaattcgtaagtcggacccgtagggtcggggaccctaccgtaacttacccgtaacccgaacccccggttcccacgaaacggtacgttaccggaacgttccgaacggtcctacgttacggtaccgtaacggtacccgtaaccgtaacccggttaccccgaacgtaaaccccgttacggtttccccttaccccgttacggtaaccgtacggttacggttaacgtttaactacgttaccggaccccggtaccccgtaaccgtaaccggtaacccggtacccgggttacccggttaacgtttaaccgtttaccggtacgggtaccggaccggtaacgggtaaccgggttaaccgggtttaacccggttttaacggtttttaaacccgggaacccgttaaccgggtttaaccgtttaaaaacccggtttttaaaaaaccccgttaccccggtttaaccggtttaaacccgggtttccggttaaccgggggttaacccggtttccggggttaacccgggggtacccgggtaaaccgggggtaaaccccggttaaaccccgggg

SEQ ID NO: 246857 - DNA, 804 bp, Homo sapiens
  misc_feature: GYAE6OF01CESN7.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatagaaacatctgtggttcatcctcctctggtggcagctcccagatgggtcctgtcccaggtgcggctgcaggagtccgggcccaggactagtgaacgtccttacacgacggtccctcgtacccctcacctgctactgtccttcgtggtacgacctccatacgaggtacgggttgttccgttacctacgtcggacctggacctccggcacggtcccggccggacgaacgggctagggtagttaacgttaggttacgggaactaacttcgtaacgtcgaccggtagggtaccggacccgtacctaactcccgtaaacccgtaaccccccgttccgtaaacgaaacgtcggttaccggaacgtaccaaggctacgttcgtacgtaaccggtaaccgaccgtaacccgtacccgaacgtaaccccgtacgtttccctacccgtagaaccgtagttaacggtaactttacgtacggtaccgaccccgtaccgacgaaccgaaccggtaccggttaccggttacgtttaacttcggtaggtaccggtacggtaacggaacggttaccgggttaaccgttttaacggtttaccggaaccgttaaccgtttaaccggttaaacgttttaaaacccggccgtttaaccggtaaccggttcgtaccgggtacgggttccggaacggggtacccggaaacgggtaccgtaaaccggg

SEQ ID NO: 246858 - DNA, 823 bp, Homo sapiens
  misc_feature: GYAE6OF01D20XP.9.70.G04.1.454.CMB.1.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (410)..(410): a, c, t, g, unknown or other
  misc_feature (410)..(410): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttnacaggccctgtcctnacctgcactgtctctggtnactcatcgagtaggttggtacttcctaactggaccttaggacttccgggctaacggtcccgaccggacaaagggggtccttagggacggttaattacgtttagggaaccgtaaatccgttaagtcgacccgtaaggtcgggaaccgacctagtcctaaacccgtaacccgttcccttanaaaggtacgtcgaagtccaggtcagtcgtcaacgtcgaactaccgtccgaagtaacctacggttacctacccgttagaaccgtaacggtgtaacgttaacgtaacgtacgaacccgaccgtaccgaaagaacccggtaaccggttacccggttaagtttaaccgtttaaccggttcgggttacggtaacccgggtaaggtaacgggtacccgggtttaaccgtttttaaacggttttacccgggaaaacccggtaggttaacccggtttaaaacggtttttaaaaaaacccccgttcccgtttaaaaccggtttaaacccgggtttacggttaacccggggtaaacggtttaccggggttaaccgggggtaaccccggtaaaccggggggtaaaccccgttaaaacccggggg

SEQ ID NO: 246859 - DNA, 725 bp, Homo sapiens
  misc_feature: GYAE6OF01CAR6F.9.70.G04.1.454.CMB.1.raw
  modified_base (204)..(204): a, c, t, g, unknown or other
  misc_feature (204)..(204): n is a, c, g, or t
  modified_base (291)..(291): a, c, t, g, unknown or other
  misc_feature (291)..(291): n is a, c, g, or t
  modified_base (377)..(377): a, c, t, g, unknown or other
  misc_feature (377)..(377): n is a, c, g, or t
  modified_base (591)..(591): a, c, t, g, unknown or other
  misc_feature (591)..(591): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcacgcctcccagatcgggtcctcgtacccaggtgcggctgcgaggagtcgggccaggactagtgaacgtccttnacgcggccctgtcccctacacctgcctactgtctgtggtcacctcatcgagtggttcgtccttcctacgtcggacctggactccggntaccggtcccggaccggagaaacggggtctagggtacttattagttacgggaactaatccgtaagcgaccgtaggtcgggaccccnctactacctaaccccgtaacccgtcccataaggcggtcgaacgttcaagtacctgtaccgttccgaagttacccggaaccctaccgtacccgaacgtaaccctaccggtttccctacccggtagtaaccggtaggttacgtaagttttaacacggtacccggtcccgtaccgacgaaacgaccggtaccggttccgttaagttacgtttacggngtaggcggtaagacgggtacgtttaccgttaagttacggaccgtagttaccttaaaccgtaaaccgttcctaacggtacgtccggtacggtccggttacgggtaccggggaccggtaaacgggtcctaaaccgg

SEQ ID NO: 246860 - DNA, 970 bp, Homo sapiens
  misc_feature: GYAE6OF01CGGZZ.9.70.G04.1.454.CMB.1.raw
  modified_base (144)..(144): a, c, t, g, unknown or other
  misc_feature (144)..(144): n is a, c, g, or t
  modified_base (788)..(788): a, c, t, g, unknown or other
  misc_feature (788)..(788): n is a, c, g, or t
  modified_base (886)..(886): a, c, t, g, unknown or other
  misc_feature (886)..(886): n is a, c, g, or t
tcagtgatacgtctcacgaccggtgctcgatttagtgtagtgtgaagggaaagggcctgtgaaggcttcactagtcctggacctcctgtgcaagaacatagaaacatctgtggttcactcctcctcctggtggcagctcccagntgggtcctgtcccagttggccggctgcgaggacggtccgggacccaggactagtacgaacgtcccttacaaccgtaccggtccccttcggtccccccttactaccttcgacctaaccgttcggttccttcgttacggtcgtacctcctaagttaccggacggtaacggggtttcggtttacccgtttaaccccgtaacggtttcccggggtaacccgttacggggtaacccgttccccggggacccgtaaccgggttccccccgggacccggggaaccgtaaaggggggtaacccgtgggggttaacgttaaacgtttcgtaaccggggaacgtaacttcggttaacgtaccggacccgttaaacgggggttccgggaaccccccgtccttaaccgttacccgtaaaacccccgttaacccccgttacccgttaaacgaaaacggtccgggtttaacccggtaacgttaaccgaaacggtctaacggtttcggtaacccgtaacgggttaaccccgacccgtttaaccccggggtacccctaaaacgggttaacccctttccggttttacccccgtaccccggtaggaaccggttacggttaaacggttaacctttaacggtacccgtacggacccccggtaanaccgttaccgaaccccgggtaccgttacgggttactttaaccgtcgtcggggttacaggtaaccgggtacggtaccggtttactttaacgggttaccnccgaaaagtttccttaaaacggttaaccttcggtaccgtggttatcccgggtagtcggaccggggctaaacggggccttaccgg

SEQ ID NO: 246861 - DNA, 747 bp, Homo sapiens
  misc_feature: GYAE6OF01AHTTL.9.70.G04.1.454.CMB.1.raw
tcagtgatacgtctcacgaccggtgctcgatttagtgtagtgtgaagggaaagggccgtgtgaaggcttcactagtcctggacctcctgtgcaagaacatgaaacatctgtggttcatcctcctccgtggtggcagctcccagatgggtcctgtcccaggtgcggctgcgaggaggtcgggacccagggactaggtgaacgtccttcacgtacggccctcgtcccctcaccctgccactcgtctcgtggtgaccttccagtacgaggtagggttcggttcccgtttcctacgtcgggacccttgggaccgttccggcgtacggtccccggccgggaccgaaagggggtaccgtggggtaacgttattaacggttacgggaaaccgtaagtttccgtaaagttccgggaccgtacggggtaccggggtaacccccgtactaacgttccctaaacccccggtaacccccgttaccctaacggaaacgtaccgggtccgtaagtcccgaggtactagtccgttacaacggttaccggaacccacccgtaccaacgaaacctccgtttcccacccgtgacgtaggtcgtaagttactagtcggaccccgtgaccaacggaccgacggtacgttcgttaatcgtggtacgcggtaagtaggtccggtacgttttaagtcggaactagtaccgttaaagttaacctccgtacgtacgtgtacgtcggtacgagggccgtaagggaccctacgg

SEQ ID NO: 246862 - DNA, 734 bp, Homo sapiens
  misc_feature: GYAE6OF01EDJ8Y.9.70.G04.1.454.CMB.1.raw
  modified_base (339)..(339): a, c, t, g, unknown or other
  misc_feature (339)..(339): n is a, c, g, or t
  modified_base (396)..(396): a, c, t, g, unknown or other
  misc_feature (396)..(396): n is a, c, g, or t
  modified_base (534)..(534): a, c, t, g, unknown or other
  misc_feature (534)..(534): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtcccctcacctgccactgtcctctggtcactccatcgagaggttcgtcgttcctacgtcggacctggactccggcacggtccggcggacgaaggggtctaggacgttattagttaggaacgtaatcttancggcctagggtcgggacccgtcctacttacccgtaaaccctaaccccgtcccctaanaaacggtacggtccggaagtacgagacgtaactcgtacgacgttaccggaccctaccggtacccaacggaacccttacgttccctaccgtcgtaacgtagtgtaacgttaataccgtcgacccgtcgacacggtaacncgggttaccgttagttaacgttcgtggtacgtaggaacgtacggtacggttaccgttttaaaggtttaccggaaacctaagttacccgttaaaacggtttaaaacccttacccggttaacggttaaccgggttacgtacgggttccccggttaacggggaccggggtaacccggtaacgggggtacccgttaaaccgggg

SEQ ID NO: 246863 - DNA, 880 bp, Homo sapiens
  misc_feature: GYAE6OF01BN0MQ.9.70.G04.1.454.CMB.1.raw
  modified_base (187)..(187): a, c, t, g, unknown or other
  misc_feature (187)..(187): n is a, c, g, or t
tcagtgatacgtctcacgaccggtgctcgatttagtgtagtgtgaagggaaagggcctgtgaaggcttcactagtcctggacctcctgtgcaagaacatgaaacatctgtgttcatcctcctctggtgcagcctccagagtggtcctcgtaccaggtgcggctgcaggagtccggccaaggactagngaacgccttcacgacggccctgtccctcaccgtgacctacttgtccttacgtggttacgaccttccaacgtcgtaacggtacgggtttcggttaccgtttacccgtaagttaccggacccgttaggggtaccgttccccgggacgtaccggtaccccggaccggggtaacggaaaacgggtacgttacggggtaagtttaacggtttaaggttacgggtaaaaccgttaaagtttaccgttaaacggtccggaccccgggtaagggtttacccggggaacccccgaccccgttaaaacgtttacccccgtaaaccccgttaacccccccggttaacccttaaccggaaaaacggttcggttaaaccggtacgtacaaaccggctaagttcgtaaccgtaaacgtaccgtaacccgtacccgtacccgtaaacgtacccgtaccgtttcccgtaccgtacgaacgtagttaacggtacttaacgtacgtccggacccgtacgaccgacgaccgtacggtccgtaagttacgtcgtaggacctaggaacgtagttacgggttacttttaacggttaacgtacccgtaggttaaccgtttaaaccgttaaccgttacccgttcggttaccggttaccgttacgggttcccggttacggggaccgggtaacccgggaaacggggaaccgttaaccgg

SEQ ID NO: 246864 - DNA, 739 bp, Homo sapiens
  misc_feature: GYAE6OF01C472O.9.70.G04.1.454.CMB.1.raw
  modified_base (170)..(170): a, c, t, g, unknown or other
  misc_feature (170)..(170): n is a, c, g, or t
  modified_base (200)..(200): a, c, t, g, unknown or other
  misc_feature (200)..(200): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcagngtcggccaggactagtgaacgccttcaacnggccctgtacccctcacctgcctacgttcgtctcgtggtcacctccatcgagtacggtgtccttcagtcgactgactcggntacgtccgcgngaggactggactatgtagacgtaatcgtatcgacgacggttcggaccgacctactaccgtaacccaaacccggttcccctagtaaaacgggtcgtcggtaaaccgttcgaaacgtcgtaacgtccgtacgtacgttaccggaacctcccgttaacccgaacgttaacccgtaacgtttccccgtacccgtacgtaaccttaggttaacgtacgtttaaccgtaacgttacccggaaccgcccgtaacgtaacgaacccgggtccgttacggttacgttaacgttacgttggtacgacggtaacgtaagggtaccggttaccgttttaaaggtttaaccggacgttaacgttaccgttaaaacgttaaaacccttcccggttaaacgtaccgggtacgttaggttaaccgtagggttacccgggaacggaccgggtaccgtaaaccgg

SEQ ID NO: 246865 - DNA, 817 bp, Homo sapiens
  misc_feature: GYAE6OF01BKLRX.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgctccatcagaggttggtccttcctactggacctggactccggctacgtcccgccggcaagggctggagtattattggacgtaatctatgacctaggtcgggacctccagtacctaaccgtaaccccgtcccctagaaacgtacgttaccgagttacccgaagcctaagttcggtactaaggtcccgaaccgtaacccggttacccccaaggtaaaacccccgtacggtttacccccttcccccgttaacggaacccgttaacggggttacgtaaggttttaacgtaacgttaccgggaaccccgtaccccggaacgaacggtaacccgacccgggtcccggttagtttaaacgtttaccgtttacgggtacgtaccgggtaaaggtacgggtaacggggttacccggttttaaggtttttaaccggggaaaccccgttaacggtaaccgtttaaacggtttaaaaaaccccttcccgtttaaaaccggttaacccgggtttaccgttaccggggtaaaccggttcccgggttaaccggggggtccccgggtaaaacggggggtaaccccgttaaaaccggggg

SEQ ID NO: 246866 - DNA, 871 bp, Homo sapiens
  misc_feature: GYAE6OF01ASFUF.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtggcagctccagagtcgggtcctcggtccaggtgcggctgcgaggagtccgggcccaggactagtgaacgtccttacacgacggtccctacgtcccctcaccttgacctactcgtccttacggtggtacaccttcagtacgaggtaggtttccggttacccgtttcgtaccggttaggtaccccgttagggtaaccgtcccgggtaccgaacggttccccggacccgggaacggtaacgggtaccggtagggtaacggttaattacggttacggaacgtaaacttcgtacgtcggaccgagggtccgggacccgtctaacctacctaacccgacccgtacccaagtaaacggtccggtcgagtacccgataccgtagttcgtaacgtccgtaaccgacccgtaccgtaaccccgtaagaaccccgtttcggtttaccccaccccgggttagaaccgtttaacggtggtttaacttaaaccgtttcggacccggttaccccggaacccgtcgaaccgggacccggttccgggtacgtttaacgtttaaccggttaggttacggtacgggaacggttacgggacggtttaaccgggttttcggttttaaaacggtttccggaaactaaccgttaggtttaaaaaacccgtttaccttaccgggttttaaacgtccggggttaggtaacccgggtcgtttaacccgggggccgggaaaccggggttccgggtaacggttaacccggg

SEQ ID NO: 246867 - DNA, 784 bp, Homo sapiens
  misc_feature: GYAE6OF01DAJPW.9.70.G04.1.454.CMB.1.raw
  modified_base (736)..(736): a, c, t, g, unknown or other
  misc_feature (736)..(736): n is a, c, g, or t
tcagtgatacgtctcacgaccggtgctcgatttagtgtagtgtgaagggaaagggcctgtgaaggcttcactagtcctggacctcctgtgacaaagaacatagaaaacatctgtggttcactcctcctccgtggtggcagctcccagagttcgggtcctcgtccgaggtcgcggctgcgaggacggtccgggccaggacgtagtacgaacgtcctacgacgacggtccctcgtccctcacctcgctactcgtctcgtcggtactacctactatacgaggtacggttcgttccttccgtacgtacggaccgtacggaccgtcccggacgtaccggtccggaccggaacgtaacggggtactagggtagttacgttaacgtacggaactatcgtacgacggacgtacgggtaccggacctaccgtactaaacctaacccggtaaccccttccgaagtaaacggtcgtacgtaacgtacacgtacgttacgtaccgttaacggcgtaacccgaaccgtacccgtaaccgtaaccgtaaacccgttcctacccgtacccggtagtaccgttaagttacggtacttaactaccgccggaccggcaacggaccggtaacgtcccgggtactttatacgttccggtagtacggaacgtagtaacgggttaccgtttaacggtttaataaccggacgttaacttaaaccgttaaaccgttaaacccttacggtcggttaccggnggttaccgggtacgacgggaaccgggtcccgtaaagggtcctaccggg

SEQ ID NO: 246868 - DNA, 893 bp, Homo sapiens
  misc_feature: GYAE6OF01BKVCN.9.70.G04.1.454.CMB.1.raw
  modified_base (203)..(203): a, c, t, g, unknown or other
  misc_feature (203)..(203): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcaggagtccggcccaggactagtgaacgtcctcacncggccctgtccctcacctgctactcgtctcgtggtcgacctccatcgaggtggttcggttccgttcctacgtcggaccgtggtacgtccggactacggtccccggaccggacggaacgggtacgtagggtaacggttacgttaggttacgggaacgtaacttcgtagtccgaccggtagggtacccggggaaccctacctaacgttacccttaaacccgtaacccccgttacccgtaacgaacgggtaccggttacccggtaagtaccgacgtacgtacggtcgtaaccgtaacggtacccgtaaccgtacccgtaacccgtaaccgtaaccccgttacgtttaccccgttacccggtaaggtaaccgtacggttaacgtttacggtttaacacggttacccggaacccggtccggtaccgaaccggtacccggtacccgggttcgttaacgtttaacggttacccgtaggggttaccgaacgggttaacgggtaaccgggtttaccgggtttaacggtttttaaacgggttaaccggtaaacccgttaaacggttaaacccggttttaaaaccgtttaaaaaccccttccggtttaaacccggttaacggggttaccgttaccggggtaccggtttacggggacccgggggtaacccggtaaaccgggggtaaccgttaaaccccgggg

SEQ ID NO: 246869 - DNA, 674 bp, Homo sapiens
  misc_feature: GYAE6OF01AO9LU.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggcgtcggcccaggactagtgaacgccttacacgacggcccctgtcccctcaccgtgcctacgtcgtctcgtaggtcgacctccatcgaggtaggttcggtccttcctacgtcgaccgtggtacgtccgcgacgtcccggccggagaaggtactggaagttatagtcggaacacttcgatcggactagggtcgggaccctctacgtacctacccgtaaccccgtccctagaaagtcggtacgagtaccgagtactactcgggtacctaggtacccggtaaccctaccgggaccccaacgtaacccgtcgttacccctacccgtagtaacgacgttagtagtacttacggaccaccgtccgacaggtacccacgggtaccttgtacgtgtcgtcgaccgagtacgcggttaacgttggttaaccgacgtagtaaccgttaacgtaaaccttcggtccgttagtccgtacgggtaccgtacggcgggaacgtaccggtacgtaacccgg

SEQ ID NO: 246870 - DNA, 785 bp, Homo sapiens
  misc_feature: GYAE6OF01C98FZ.9.70.G04.1.454.CMB.1.raw
  modified_base (294)..(294): a, c, t, g, unknown or other
  misc_feature (294)..(294): n is a, c, g, or t
  modified_base (462)..(462): a, c, t, g, unknown or other
  misc_feature (462)..(462): n is a, c, g, or t
  modified_base (562)..(562): a, c, t, g, unknown or other
  misc_feature (562)..(562): n is a, c, g, or t
  modified_base (584)..(584): a, c, t, g, unknown or other
  misc_feature (584)..(584): n is a, c, g, or t
tcagtgatacgtctcacgaccggtgctcgatttagtgtagtgtgaagggaaagggcctgtagaaggcttcactagtcctggacctcctgtgacaaagaacatagaaaacatcgtggtggttcactccctcctccgtggtggcagcctcccagacgttcgggtcctcgtcccgaggtgccggctgacgaggacgtaccgggccaaggtacgtagtcgaacgcccttacgaacgcggtcccctcgtccccttcgaaccgtggacctacgttcgtccgttcgttacgggacctaccnccgtaacttacggaaagggtcgggtcggttttcccttaacaacggtacgggaaccgttacggccgttacccggacgtcggtaccccggacggaaggaaacggggtgtaaggtaattaagtaacgtaggaaacgtaacttcctagccgaccgtaggaccgggaccctanacttccaaaccctaacccgtccagaaacgtcgtacgatcgatactacgtgtacgaagtacccgaactacccgaaccaacgtacctcggttaccaccgtanacgtaagtatacggtaactacnccggaaccgctacgaaaccgccggtacggcgtttaaactggttaacgtcggtagacgaggtaacggtacgttaccggttaaattccggaacttaacgttaacgttaaaaccgtaaaccgttaccgttaaacccggttacgtcgttaacccgggttaggtacggggtcccggggaaaccgggtacggtaaacccggtaacgg

SEQ ID NO: 246871 - DNA, 774 bp, Homo sapiens
  misc_feature: GYAE6OF01DI7BK.9.70.G04.1.454.CMB.1.raw
  modified_base (164)..(164): a, c, t, g, unknown or other
  misc_feature (164)..(164): n is a, c, g, or t
  modified_base (481)..(481): a, c, t, g, unknown or other
  misc_feature (481)..(481): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggntgcaggagtcgggcccaggactagtgaacgtccttcacgacggccctgtcccctcacctgctactgtctctggtcgactccatcgaggtagggtgttaccgttcctacgtggaccctggactccgggctacggtcccggccggacgaagggtactgggaacgttagtacgttagggaacgtaattcgtaagtcggaccgtaagggtcgggacccgaccgtatacctaaccgaaccccgttccctaacgaaacgtcggtaccgagtacagctagtcgtacgacgttccgactaccgtacccaacgaccgttacttccncccgtagaccgtaggtacgtacgttactagttaccggacccgtaccgcgtaaacgacccggtaccggtccggttaagttaaccgtttacgtacggtcggaaccgggtacggtaacgggtaccgggtttaaccggtttttaacgtttaacgggtaaccccgttaaggttaccgtttaaaaccggtttaaaaacccgttccggtttaaacccggttacgggtttaccgttacggggttaccggttaccgggtaccggggaacccgggtaacgggggtaacccgttaaacccgggg

SEQ ID NO: 246872 - DNA, 875 bp, Homo sapiens
  misc_feature: GYAE6OF01EMD63.9.70.G04.1.454.CMB.1.raw
  modified_base (561)..(561): a, c, t, g, unknown or other
  misc_feature (561)..(561): n is a, c, g, or t
  modified_base (580)..(580): a, c, t, g, unknown or other
  misc_feature (580)..(580): n is a, c, g, or t
  modified_base (714)..(714): a, c, t, g, unknown or other
  misc_feature (714)..(714): n is a, c, g, or t
tcagtgatacgtctcacgaccggtgctcgatttagtgtagtgtgaagggaaagggcctgtgaaggcttcactagtcctggacctcctgtgacaaagaacatagaaacatctggttggttcacttcctcctccgtgggtcggacagtcctccgaagtacgttcgggtcctcggtacccgagggtcggccggtctcggacggaggggtaccgggtccgggacccgtagggaactaggtacggaaccttccgttacgacggtaccggtcccgttcgtaccccactaccgtgaccttacgtcggttccgttacggttcgggtacctacccgtacctagtaacgggtacgggttacggggttaccggttttcctttaacccggtaacggtccggggtaaacgtccgggtaccggtacccggtacgtaccggtccccgggaccggtaaggtaacggggtcgtaaggtaacggttatttacggaacggaactactaccggtgtcggaaccgtggggacccgacctacacggtcccaaacccgtaccctcgtaaagacggtacacgtanacgacgttataccgggtanacgttacgggaccctacggtaaccctaccaacgttaacccgtgttcccaacgtggtaaacgtggtaacgaatttccgaacgcccggtaacacccgttaggaacctacccggtagtacgttaagttgtaacccgngggaacgaggttaacggtacggtaccggttttagtaaaccgggtcctaaacggttacgttaaaccggtttaaaaccctaacggttcccgtaccggttacggagggttacccggttacgggacccgggttaaggggaacgtaacccgggtaccgttacccgg

SEQ ID NO: 246873 - DNA, 801 bp, Homo sapiens
  misc_feature: GYAE6OF01CVXHJ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctctggtgcagctcccagatcgggtcctgtcccaggtgcggctgcgaggagtccgggcccaaggacctagtcgaacgtcccgttcaacgacggccccttcgtcccctcaacccgttgacctacgttcgttccttcgttgggtacgaccctacctagtaccgtaaggtacgggttcggttccggtttccctaacggtcgggtacccgttagggaaccgttcccgggacgtaaccgggttcccccggacccgggacggtaaaacgggggacgttggggtaaaggtttaagttacggttcgggaaaccgtaatccgtttagtcgaccgtagggtaccgggacccgccttaataccctaaccccgaacccttccgtaacgaaacggtagtccggtaatccagccgtatcgtcgtacgccgaacaccgtacccgaacgacccgtacgttcctaccgtacgacgtaagttagtaccgttatacgtccgacccggccctacgaaccggaccgtaccgggtcgttaacgttaacgttcgttacggtcgaagtaggtaacggttacggttacgtttaacgttacggaccgttagtaaccgttaaacgttaaacccttaccggttaacgttacggtaccgtacggttaccggtacggtaggggaacccgtacggggtaaacctaaccggg

SEQ ID NO: 246874 - DNA, 900 bp, Homo sapiens
  misc_feature: GYAE6OF01EHGEE.9.70.G04.1.454.CMB.1.raw
  modified_base (205)..(205): a, c, t, g, unknown or other
  misc_feature (205)..(205): n is a, c, g, or t
  modified_base (256)..(256): a, c, t, g, unknown or other
  misc_feature (256)..(256): n is a, c, g, or t
tcagtgatacgtctcacgaccggtgctcgatttagtgtagtgtgaagggaagggcctgtgaaggcttcactagtcctggacctcctgtgcaagaacatagaaacatctgtggttcactcctcctcctggtggcagctcccagatgggtcctcgtcccgaggtgcggctgcgaggagtcgggccaggactagagaagtccttacanacggtccctcgtaccctcacctgcacgtcgtctcgtaggtccgtacctacnctacgaggtacggttacggttaccgtaccgtagtacggtaccgtaaggtaccgtccggacgccgtacccggccgaacgggaacggtacgtaggaagtagtaggtacgaacgtactacgtacgtacgacgtaggtaccggaccgtcaaaatcccgttaccaaaccccggtacccgtacgtaaacgaagtttaccgaaggttcccaaaggtccctaaatacgggttccgaaaaggtttcccggaacctaacggtaccccctaagggttaaaccccaacggtttaccgtaacccccttcggtaaccgaacggtttacgtaaacggttttaacgtaaaccgttacggaacccgggtacccggtaacccgaacgggtaacccgtaaccgggtaacccggttacgggttaaccgtttaacccgttacgggttaacggaaccgggttaaacgggtaacgggttaacgggttacccgggttaaacgtttttaaccggggtacccgttaaacggtaacccgtttaaccggtttaaaaaaaacccgttcccggttaaacccggtttaccgggttaacccgttacgggtaacccgggttaccgtaaccggggggtaccccgtaaaaccggggggtcccccgtaaaaacccggggg

SEQ ID NO: 246875 - DNA, 738 bp, Homo sapiens
  misc_feature: GYAE6OF01ACPTD.9.70.G04.1.454.CMB.1.raw
tcagtgatacgtctcacgaccggtgctcgatttagtgtagtgtgaagggaaagggcctgtgaaggcttcactagtcctggacctcctgcgcaaagaacatagaaacatctgtggttcatcctcctcctggtgcagctcccagatgggtcctgtcccaggtcgcggctgcgaggagtccgggacccaggtactaggtgaacgtccttcacgacggccctgtccctcacctgctactgtctcgtggtcgacctcatcgagtggttcgttccgttccacgtcggacccgtggaccgtcccggacgtacggtcccggccggagaacgggtacgtgggtaagttacgttagtaggaaacgtaattcgtaacgtccggaccgtagggtccgggaccctcctaataccctaacccgaaccccctccaagaacgtcgtacgaagtcaacgctagtcgtacgtacgtccgaccacccgtaccgaacgtaccgttaccgtccctccgtacgacgtagtagttaacttacgtacgtccggacccgccacgaaccggaccgtacccgggttcgtttacgttaacgttacggtcggtacggaacggtagggtacggtaccggttacgttttaacgttaccggacgtaaccgttaacgttaaaccgttaaacccgttcccgttaacggttcccggtacggtaccgggtaccggttcgggtaccgggaccggtaccggggaacccgttaccgg

SEQ ID NO: 246876 - DNA, 790 bp, Homo sapiens
  misc_feature: GYAE6OF01EVWS9.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcactcctcctctggtgcagcctcccagatcggtcctcgtccaggtcgcggctgcgaggcgtccggccaggacttagtacgaacgtccttacacgtacggcccttcgtcccctccgtaccttgacctacgttcgttccgttccgtagggttaccgacccttccaattccgaaggtacggggtttccggttcccgtttacccgttaccggtacggtacccgtacgggtaccgtttccccgggactaaccgggttccccgggtacccgggaacgtaaaacggggggtaccgttaagggggtaacgtttaagtttaacggttacggggaaacctaaacgttcctaagtccggtaccgtaaggggtccgggacccctactacgttaacccgtaaccccgaaccccgttccgtaagaacggtcgtacgaacgtaccgaagtctagttaccgacgtccggaccgacctacccgaccgaactaccgtaccgttccacccgtagtacgtagtcgtaacgttatacgtccgaccgccgagactaccggacgtcgttagtactcgtgcgacggtacaggttacgttacctttagttacgacccgtagttaaccgtttaaacgttaaccctcgtaacggttcggtacgtacgtccgggtaggtaccgggccggtacgggacttaccgg

SEQ ID NO: 246877 - DNA, 609 bp, Homo sapiens
  misc_feature: GYAE6OF01A1580.9.70.G04.1.454.CMB.1.raw
  modified_base (234)..(234): a, c, t, g, unknown or other
  misc_feature (234)..(234): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtnactcatcagaggtgtcgttccacgtggacctggactccggcacggtccgccggacgaagggtccgtgggtagttattagttacggaacgtaatctaagtcgaccgaggtcgggacccgcctaacttcctaacccaaccccgttccctaacgaacgtcgtacgacgtcacgctatgtcagtcgacaccgtccaacgaaccctgttcctcctacgactagtagtagttatacgtcgtacgtcgaccgacgacgacgacggtcgttagttacgtacgtggtacgacggagacggtacggtacgtttagttacgacctagtaccttaagttaaacctcgtacgtacgtcgtggtcgtaggcgggaccgtagggtaaccg

SEQ ID NO: 246878 - DNA, 715 bp, Homo sapiens
  misc_feature: GYAE6OF01BQSBL.9.70.G04.1.454.CMB.1.raw
  modified_base (217)..(217): a, c, t, g, unknown or other
  misc_feature (217)..(217): n is a, c, g, or t
tcagtgatacgtctcacgaccggtgctcgatttagtgtagtgtgaagggaaagggcctgtggaaggcttcactagtcctggacctcctgtgcaagaacatgaaacatctgtggttcatcctcctcctggtggcagctcccagatcgggtcctgtcccaggtgcggctgcaggagtcggcccaggactagtgaacgccttcacacggccctgtccctnacctgcctacgtgtctcgtggtcactccatcgaggtaggttgtcgttccagtcggacctggactccggcaggtccgcggacaaggctggattactagtcggaactagtctagcgccaaggttcgggaccctacacgtccgttaacccgaaaccccggttctaacgaaggtacgtacggaacgtcaagtcctaagtcgttaacacggttaccacgaccgtccaacgacccgtagttccctacgtacgacgtagtacgtagtttaactacgtcgaaccccgacgaccgtaacgaccgtaaccgggtcgttaggtaaccttaacgtggtcggtacggtacggaacggtaccgggttacgtttaacgtttaacgggaccgtaacggtaaccgttaaacggtttaaaaacccttcggttaaaccggttaccgggttaccgtaccggggttaaccgttccggggtaccggggtacccggtaacgggggtaacccgtaaaccggg

SEQ ID NO: 246879 - DNA, 918 bp, Homo sapiens
  misc_feature: GYAE6OF01CUZBT.9.70.G04.1.454.CMB.1.raw
tcagtgatacgtctcacgaccggtgctcgatttagtgtagtgtgaagggaaagggcctgtgaaggcttcactagtcctggacctcctgtgacaagaacatgaaacatcgtgtggttcactcctcctcctgggtggcagctcccagatcgggtcctgtcccagggtcgcggctgcgagggacggtcccgggcccgaaggacgtaagtagaacgtccttccaacgacggccctcgtccccttcacctgaccacttcgtctcgtggtacgacctccagtaccgagggtacgggttcggttccgtttaccgtaccgtacgggtaccgtacgggaccgttcccgggacgtaccgggtccccgggaccgggaacggtaacggggtacggttacgggtaaacgttagttaaggtttcgggaaacgttaaattccgttaagtccgggtaacggtaccggggtaccgggtaaccccgtacctaaccgttaccctaaacccccggttaccccgttacccgtaaacggaacggtaacggttccgaacgtaacggacttcgtaagtcggtaccgtaacgtacccgggaaccctcccggtaccaaacgtaacccgtacgtttaccccgacccgtaacgtacgtaacggtacgttaagtttacgtaaccgtcccggaacccgaccgtaaccggaacgtaaccggtacccggtaacggtttacgttaacgttaccggtacgggtaccggtacggaacgggttaccggtaggtttaaccccggttttaagttaaccggtaaccgtacgttaaaacccgtttaaaccgttaaacccgtttacccgtttaaacggttccgggtaaccggtttacgggtaccgggtaaccgggacgggggtaacccggtaaacccggggtaacccggtaaccccggg

SEQ ID NO: 246880 - DNA, 797 bp, Homo sapiens
  misc_feature: GYAE6OF01ESX92.9.70.G04.1.454.CMB.1.raw
  modified_base (428)..(428): a, c, t, g, unknown or other
  misc_feature (428)..(428): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtccggcccaggactagtgaacgccttcacacggccctgtcccctcacctgccactcgtctctggtcgacctccatcgaaggtaggttcggttcgttacccgtacgtcggaccctggacttccggcgtacgtcccggcccggacgaaagggcctggagttaagtactaggaacgtaatcttaagtcgaccgaggtcgggacccgccacttaccaacccgtaaccccgtccctaacaacgtacgtacgaacgtccgancgtactcgtacgaacgtaccgaaccgtacccgtacccgaacggtaaacccgtccgtttaccctacccgtaaggtaacgtcggttaggttaaacgtttactacgttaccggaaccccggtccgtacgaaacggtacccgtaccgggtacccgttaacgtttaaacgttacccgtagggttaccggacggtaacggaacgggttaaccgggtttaaccggttttaacgtttaaccgggaacccgttaaagtaccgttttaaaaaccgttaaaacccgttcccgttaacggttacccggttacggtttaccgggaacccggtttcgggtaacccggggtaaccggtaacccgggggtaaccgtaaacccggg

SEQ ID NO: 246881 - DNA, 685 bp, Homo sapiens
  misc_feature: GYAE6OF01AKYM6.9.70.G04.1.454.CMB.1.raw
  modified_base (234)..(234): a, c, t, g, unknown or other
  misc_feature (234)..(234): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagcctccagatgggtcctgtcccaggtgcggctgcaggagtccgggcccaggactagtgaagccttcacaggccctgtccctcacctgcactgtctctggtnactccatcaggaggttcggtcttcctacgtcgacctggactccggcacgtccgccggacgaaagggtctagggattaatgttagggaactaatcctagtcgcctagggtacgggacccaccgagtaccctaaccggtaaaccccgtcctacgaaaggacggtcgaggtaccaggctagtcgtagcgtaccgacaccgtacccaacgtaacctgttacccctcccgtaataacggtagtacggttaagttataacgttaccgacccggtacggcgaaacgtacgacccggttaacgtgttaacttagtacggtgtaaccggaaggtacgtaccgggtttacgtttaacgttacgggaacgtacgttaacgttaaacgtaaacccttaccggtaacgttacggtcgttacggtaacgttcgggaacgggtccggaacggggtaccctaacggg

SEQ ID NO: 246882 - DNA, 1009 bp, Homo sapiens
  misc_feature: GYAE6OF01BFBLR.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccagagtgggtcctgtcccgaggtgcggctgcaggaggtccgggccaggactaggtgaacgtccttcacacggccctcgtccctcacctgctacttgtctcgtgggtcacctccatcgaggtacggtcgttccgttacctacgtcggtacctaggacgtccggcgtaccggtccggaccggacggaaagggtccgtagggtacgttaagttacgttacggaacgtaacttacgttagtaccggtaccgagggtaccgggaacccgcctaacttacccgtaaacccgtaaccccgtacctacgaaacggtacgtacggacgtacgacgtctaacgtcgtacggtaaccgtaccgtaaccgtaaccccgtaacccgtaaccgtaacccgttaaccgtttccccgttaacccgtacggtaaaccgttaacgggttaaacggttaaccgttttaacgttaaaccggttaccgggaaccccccggttaaccggtaacccggtaacccggttaaaccccgggtaaccggggtttccccgggtttaaacgtttttaaccgtttaaaccggggttcgggtaaaccggggtaaccgggttaaagggggtaaccccgggttaaccgggggtttaaaccggttttttaaaccggggtttaaaaccccgggttaaaccggttaaaacccgggttttaaaaccggttttaaaaaacccccggtttttaaaaacccccggttacccggtttttaaaaacccgggttccccgggggttttaacgggtaaaccccggggttttaccggggttcccgggggtttaaacccccgggggggtaaaccggtaaaccccggggggggtaaacccccggttttaaaccccggggg

SEQ ID NO: 246883 - DNA, 812 bp, Homo sapiens
  misc_feature: GYAE6OF01EV209.9.70.G04.1.454.CMB.1.raw
  modified_base (530)..(530): a, c, t, g, unknown or other
  misc_feature (530)..(530): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagcctcccagatgggtcctgtcccaggtgcggctgcaggagtccgggccaggactagtagaagccttcacacggccctgtacccctcacctgctacgttcgtctcgtggtactacctcatcgaaggtagggttcggttccgttacctacgtacgggacctggtacgtccggacacggtccccggccgggacgtaaaggggtaccgttagggaacggtttagttaagttacgggaacgtaaacttcgttagtaccggaccgtaagggtccgggaaccctaccgtaaccttaccctaacccgtaaccccggtacccaacgaacggtacgtacgacgtcaagctagttacgtctaggtacccgactaccgtaccgaaccgtaacctagttccctaccgtanaactggtaacgtaacgttacgtaacgaccggtacccggcccgacggtaaccggtaccgggtaccgtaccgttagttaaccgtttccgtacgggttacggaccggtaagggtaacggttacggtttaccggttttaagtttaaccggacctaaagggtttaaccgtttaaacggtttaaaaccctcccggtttaaacggttaaccgggtccggtttaacggggttaccgtacccggggttaccgggggtaaccgggtaaaccggggtaacccgttaaaccggg

SEQ ID NO: 246884 - DNA, 721 bp, Homo sapiens
  misc_feature: GYAE6OF01BRMK4.9.70.G04.1.454.CMB.1.raw
  modified_base (238)..(238): a, c, t, g, unknown or other
  misc_feature (238)..(238): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccaggactagtgaacgccttcacgacggccctcgtccctcacctgcctagtcgtctctggngactcatcagtggtcgtcgttcctacgtcggtacctggactccggactcggtcccgcggtacgaacggcgttggaacgttagttacgttacggaacgtaatactagtccgtacgtagggtacggaccctaccgtaactaccgtaaccctaaccccgtcctaacgaaacgtacggttacgaacgtcctaaggcctacgtacggtaccgaagttcccgtaacgacccgtacccgaaacgtaaccctcggtttacccttacccgtacgtaacgtacggttaacgttaagtttacgtacgttacggaccccgtccgaccgtaacggaccgtaaccgggtaccgttagtaacgttacgtacggtacgaccggtagaccggtacgggttacctttaagttacggaaccgtagttacgttaaagttaaacccttccgtacgtacgtcgtacgtaccgtcggtaacgggaccgtacgggtactaacccggg

SEQ ID NO: 246885 - DNA, 691 bp, Homo sapiens
  misc_feature: GYAE6OF01A3BPT.9.70.G04.1.454.CMB.1.raw
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtccgggcccaggactagtgaagccttcacacggccctgtccctcacctgcactgtcctctggtcgacctccatcgaggaggttcggtcgttccacgtcggacctggactccgcacggtccgccggcgaaggctaggatatagtaggacgtaactctaagtcgaccgaggtacgggacccnctagtacccacccgtaaccccgtcctacgaagtacggtcgacgtacacgctacgtacgacctaggtcccgaccgtaccgtacccgaacgtaaccctacgtttaccctccgtagaccgtacggtagtaacgttaacttcgtaccggacccgtacgaccaacggaccgtaccggtaccgttagttaacctacgttggtacgtacggaagtacggtacggttaccgtttaaggttacggaaccgacgttaaccgttaaacgttaaaaccctcccgttaaacgttacggtaccgttacgggtacccgttacgggacgggaccggtaacggggtcctaacccggg

SEQ ID NO: 246886 - DNA, 894 bp, Homo sapiens
  misc_feature: GYAE6OF01EZ7F9.9.70.G04.1.454.CMB.1.raw
tcagtgatacgtctcacgaccggtgctcgattttagtgtagtgtgaagggaaagggccgtgtgaaggcttcactagtcctggacctcctgtgcaagaacatgaaacatctgtggttcatcctcctctggtggcagcctcccagtgtcgggtcctgtcccaggtcgcgctgacgaggacgtccgggacccaggactagtcgaacgtccttcacgacggtcctcggtccctacacctgcctactgtccttcgtcggtacgacctaccagtacgtagggtacggtttccggtttccgttaacccgttaccgttaccgggtaccctaggggtaaccgttcccggaccgtaccggttcccccgggacccgggtaacgaaaccggggttacttagggggtaaagtttacgtttaacgggtttacgggaaaaccgttaaacgttttccgtacgtaccggtaaccgttacgggggttcggggaaacccccgtccctaacttaaccccgtaaaccccgtaacccccggtttaccgtaacgtaacggtacggtacggaacgttacgacgtacttacgtacggttcctaaacggtccgtaacccgtacccggaactaaccgtaacccgtcgttacccttccgtagaacgtacgtactttaagtactacgtaccgcccgtaacacgaacgtaccgtacggtcttacgttaactcgttagacggtagtacggtacggttaccggtttactttaacggtacgtaccggaaacgttttaaccggtttaaaaccgttaacccgttcccggtttaaaacgggtttccgggttaacccggttacgggttacccggggtttaccgggaaccggggtaacccgggtaaacggggttaaccccttaaccccgggg

SEQ ID NO: 246887 - DNA, 747 bp, Homo sapiens
  misc_feature: GYAE6OF01C71AR.9.70.G04.1.454.CMB.1.raw
  modified_base (104)..(104): a, c, t, g, unknown or other
  misc_feature (104)..(104): n is a, c, g, or t
  modified_base (162)..(162): a, c, t, g, unknown or other
  misc_feature (162)..(162): n is a, c, g, or t
  modified_base (197)..(197): a, c, t, g, unknown or other
  misc_feature (197)..(197): n is a, c, g, or t
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (301)..(301): a, c, t, g, unknown or other
  misc_feature (301)..(301): n is a, c, g, or t
  modified_base (514)..(514): a, c, t, g, unknown or other
  misc_feature (514)..(514): n is a, c, g, or t
tcagtgatacgtctcacgaccggtgctcgatttagtgtagtgtgaagggaaaggcctgtgaagcttcactagtcctggacctcctgtgcaaagacatagaaacntctgtggttcatcctctcctggtgcagctaccagagtcggtcctgtccgagtgcgtcngcgaggacgtcggccaggactagtagacgccttanacgacgtcccgtcgtaccctanacctgacctagtcgtctcgtggtacncctacgatcgaaggtcgggtattacccgttctacgtcggaccttggaacttcccgngtacgtacccggacgacggtaaggcttaggaactagcgttaacgaactacgtctaaggtcgaaccgtagggacggaccctactaacttcccggtaaccctaacccggttaacgacgaaaaggtacgttacccggaaagtcacgtactacgttaagacctaagtaacccgaacctccgtaacccgaagtaaccctacgttccctacccggttanacgttaacggtatacgtttaaagtcggttaaccgacccgtacccgggattaaccggacccgtaacgtccgttaacgttaacgtttacgtagttcgacggtaaggacggttacggttaccgtttaacgttaaccggacgtacgttaaataaaccgtaaacctttacgtaaccggtacgttctaaccggggttcgtaacggggtccggtaaccgacggggttaacctaacccggg

SEQ ID NO: 246888 - DNA, 725 bp, Homo sapiens
  misc_feature: GYAE6OF01A4DMS.9.70.G04.1.454.CMB.1.raw
  modified_base (216)..(216): a, c, t, g, unknown or other
  misc_feature (216)..(216): n is a, c, g, or t
  modified_base (235)..(235): a, c, t, g, unknown or other
  misc_feature (235)..(235): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgacggccctgtccctnacctgcactgtctctggtnactcatcagaggttggtccgttacctagtcggtacctggacttccggcagtcccggaccggcgaaagggcctggagtattagttcggaacgtaatcctaagtgcccgtagtcgggaccgctagtcctacaaccccggttcctagaacgtcgtccgaagttccaacggctaaacgttcgtacgtacgttaccgaaccgtaccgtacccaacggtaaccctacggttacccttacccgtacggtaccgtaaggtacgttaacgttaagtacgttcggaccccggccgtacgaacgtaccggacccggtaccgttacggttaaccttacggtacgtacggtacggacggttaacggacggtacccgtttaaggtttacggtaacccgtacgttaccgttaacgtttaaaacccgtcccgttaacgttaccggttaccgttacgggtaaccggttcggtaccggggcccgtacggggtaacccggtaacccggg

SEQ ID NO: 246889 - DNA, 735 bp, Homo sapiens
  misc_feature: GYAE6OF01D68FR.9.70.G04.1.454.CMB.1.raw
  modified_base (162)..(162): a, c, t, g, unknown or other
  misc_feature (162)..(162): n is a, c, g, or t
  modified_base (201)..(201): a, c, t, g, unknown or other
  misc_feature (201)..(201): n is a, c, g, or t
  modified_base (416)..(416): a, c, t, g, unknown or other
  misc_feature (416)..(416): n is a, c, g, or t
  modified_base (522)..(522): a, c, t, g, unknown or other
  misc_feature (522)..(522): n is a, c, g, or t
  modified_base (580)..(580): a, c, t, g, unknown or other
  misc_feature (580)..(580): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcgntgcaggagtccgggccaggactagtgaacgtccttcacncggccctcgtccctcaccgtgcctactcgttcctcgtggtcacctccatcgaggtacggttcggtccttcctacggtcggaccgtggacgtccggactccggtcccggccggacggtaaaggggcgttgggaattacgtaggttacgggaactatcgtagtccgacgtagggtccgggaccctactacgtacctaacccgtaccccgtccgtaanaaggtacgtcgaacgtcgacgctacgtcggtacgaacgtccgaactacccgtacccaacgtaacccttcgttccctaccgtaacgctaacgggttataacgtttanaccgtaccgcccgtccaacgaacggtaccgtaccggtacgttcgttaaactttccggnggtaaccggtacggtaagggccggttaacgggttaaccgttttaacggtaaccgaaacgttaacgtttaacgtaaaccgtttaaaccctcggttaacgtcccgggttagtacgggtaccggtcggtaccggggtaccgaaggggtaccctacggg

SEQ ID NO: 246890 - DNA, 910 bp, Homo sapiens
  misc_feature: GYAE6OF01CXOIN.9.70.G04.1.454.CMB.1.raw
  modified_base (406)..(406): a, c, t, g, unknown or other
  misc_feature (406)..(406): n is a, c, g, or t
tcagtgatacgtctcacgaccggtgctcgatttagtgtagtgtgaagggaaagggcctgtgaaggcttcactagtcctggacctcctgtgcaaagaacatagaaacatctgtggttcatcctcctcctggtggcagctcccagagtcgggtcctatcccaggtgcggctgcgagggaggtccgggcccaggactaggtgaacgtcctcacgacggccctcgtccctcacctgacctacgtgtccttcgtggtcgtacctccatcgaggtacgggttcggttccttacccgtacgtcggaccgtggacgtccggcgtacggtccccgggaccggaggaacgggtactaggggtacttagtagttacggaacgaacttcgtatccggaccgtagggtaccgggacccncctaacgttacccgtaacccgtaaccccggttaccctaacgaaacgggtaccggttaccgacggttaccaacggtacctaacgttacgggtaaccgtacggttaacccggaacccgtaacccgtaaccccgtaaaccggtaacccctttaccggtttaaccccgtaccccggttaacggtaacggttaacgggtttaacgtaacgggttttacctaaccggttacccgggtaaccccgaccggtaacggaaacccggtacccggttaaccgggtccggttttaacggtttaacgttttaaccggtgggttaccggaacgggttaacggaacggggttaccggtttaaccgggttttaaacggtttaaccgggtaaccgttaacggtttaaacgttaaacccgttttaaaccgtaaccctttaaccgggttaccggttaccggtacgggttaccccgggtacgggttccggggaaacccgggtaccgggggtaaacgtacccggg

SEQ ID NO: 246891 - DNA, 943 bp, Homo sapiens
  misc_feature: GYAE6OF01BRGQ7.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggccaggactagtgaagccttcacgaggccctgtcccctcaccgtgaccacttgtcttcgtggtacgactccattccgaggtggttcgtccgttcctaacgtcggacctggactccggctacggtccgccggagaacggggtctaggtagtacgttagttggaacgtatcgtagtcggcccgtagggacggacccgacctaacgttcccgtaaaccgtaacccccggttcctaacgtaaacgggtaacgttccggtaacgttacaacggtctaaacgggttccgtcggtaaccggttacccggaaaccccgttaacccggtaccccccgttaaagtaaaacccccgttcgggttttaccccctaaccccggttacgggtaaaaccgtttaacgggttacgtttaaaaccggttttagtaacccggttcccgggtaaacccccgggccccgggtttaacaaacccggggttaaccccgggttaaacccggggttctttaaccggggttttaacttttacccggggacgttccgggtaaacgggttaacggggtaaaccggtaccgggtttttaccggtttttaaaacccgtttaaacgggggaacccccttaaggggtttaaaccccgttaaaaaccggtttttaaaaaccccccgtacccggttttacgggttaaacccggggtttccgggttaacccggggttaaaccggtttcccggggaacgggggtaacccccgggttaaagggggttcccttaaaaccccgggg

SEQ ID NO: 246892 - DNA, 784 bp, Homo sapiens
  misc_feature: GYAE6OF01AOKPY.9.70.G04.1.454.CMB.1.raw
  modified_base (258)..(258): a, c, t, g, unknown or other
  misc_feature (258)..(258): n is a, c, g, or t
tcagtgatacgtctcacgaccggtgctcgatttagtgtagtgtgaagggaaagggcctgtgaaggcttcactagtcctggacctcctgtgacaagaacatgaaacatctgtggttcatcctcctcctggtggcagcctcccagactcgggtcctgtcccaggtgcggctgcagggagtccgggcccaggactagtagaacgtccttcgaacgcggcccttcgtccctactaacctgcctacttcgttcctagtcggtnacctcgatagaggtaggtcggtcctttaccgacgtccggacccgttagggaccgttcccgggacctaccggtccccggacggaacggtaaacgggtctaagggtaagtaacgttagttaggaacccgttaattccgtaggtacgaacccggtacggggttaccgggacccctaacgtacgttaacccccgttaaccgaaacccccggtttcccaaacgtaaaggaacccggttacggaaacgtccaaggtactagttcgtaaccgtacggttacccggaaccaacccggtaaccctaacggtaacccttcgttaccccgtttacccgaacgtacggtaagttacgtaaattacgtacgaccggtaacccgcgactaacggtcgaccggttaccgtagttactcgtgtacgaggtacgaagtcggtttacgttaagttaccggagtaccgttaaactttacgtaaacctcgttagtaccgggtacgtacgggtcctacggggcgggaacgtaccgggacggttaccg

SEQ ID NO: 246893 - DNA, 871 bp, Homo sapiens
  misc_feature: GYAE6OF01B72YO.9.70.G04.1.454.CMB.1.raw
  modified_base (260)..(260): a, c, t, g, unknown or other
  misc_feature (260)..(260): n is a, c, g, or t
tcagtgatacgtctcacgaccggtgctcgatttagtgtagtgtgaagggaaagggcctgtgaaggcttcactagtcctggacctcctgtgacaagaacatgaaacatctgtggttcatcctcctcgtggtggcagctcccagacgtcgggttccctcgtcccagggtcgcggtctgcgaggacggtccgggaccaaggactagtagaacgtccttacacgacggccctcgtcccacacctgctatcgtctcgtaggtacncctccgaagtacgaagggttacgggttcggttacccgtttaccgttacgacggggtaacgtggtaaccggtcccgggtacgaacccggggttcccgggcccggggaaaggtaacggggtaaccggttagggaaacgtttattacggttaaccggaaacgtaacttcccgttaagccgacggtaaaccgggtccgggaaccctaccgtacctaacccgtaaccccgaccccgttccaaaggaacggtagtacccggagtaccgataacccgtaagttccgtaacggtaaccggttccccgaacccgttaacgtaaccccgaacggttaaacccgttaccgtttacccgacccgtaggtaaccgttaacgggttattaacggttaacaacgtacccggtacccggacgtaaccgaccgaacggtaccgggtacctttaggttaacccttacggtcggaaccggttacggaaacggtacgggtttaaccggttaacggttttaaggttaacccgtaaagtaaccgttaacgttaaaccgttaaaccggtctttaaccggtacggtacgtaccgggtcggacggttaccggggacgtaaccgggaacgtacccgg

SEQ ID NO: 246894 - DNA, 820 bp, Homo sapiens
  misc_feature: GYAE6OF01ARHHM.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagcctcccagagtgggtcctgtcccgagggtcgcggctagcgagggaggtccgggacccaggactagtagaacgtccttcacgacggccctcgtcccctacaccgtcgactacttcgtcctcgtgggtcacctcctatcgaggtacgggttcggttccgttacctacgtcgggacccttggaccgtcccggctaccggtcccggacccggggacgaaaggggtccgtgggtaagttaactacggttacggaaccgtaacttaccgtaagtccggaccgtaggggtaccgggaccccacctaacgttacccgtaaccccgaaacccccggttcctaacggaaacggtccggttaccgtacgtaccgaacgtccgtaagttccggtacctaacgggtcccaaccgtaacccggtacccgaacgtaacccgttcgttaccctcccgtagaacgtacggtagtaacgttacaccggttaccggaccctccgacgaccgtaccggtacccgggttaacgtttcttaacgttccggtaggttccggaacggtggtaaccgggttccgtttaacgttttaaggtacccggaaccttaacggttaaccgtttaaaccgttaaacccgttccgtcgttaccggtggtaccggtaccggttcggggaacgggttaccccggaaagggtcccgtaaccgg

SEQ ID NO: 246895 - DNA, 938 bp, Homo sapiens
  misc_feature: GYAE6OF01AIN57.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtcgcggctgcaggtacggtccgggccaggactagtggaacgtcctcaacgacggtcccttgtccccgtacaccgttcgacctacgttcgttccgttcgtaaggggttctaccgttacccaagttcgaacgggtacggttcggttccgttaccgtacggtcggtaccgtacggtaccgtaccggacgtaccgggtacccggaccggaacggtaaaccgggtacgtagggtaacttaacgttacggtaacggtaactacgttcgtacggtcgaccggtacgggtaccggacctacgtactaacccgtaacccgtaacccgtcgtaacgggtaacggtacgtacggtacgtacgacgtacgttaggacgttccgtaaccggtaccggtaacccgtaacccggtaaccgtaaccggtaccctttacccggtacccgtaccgtaacggttaacgtaacggttaggttaaccgttaacggtaccggttaacccggacccggtaacggaacccgtaaccgggtaaccgttaccgggttaagttaaccggttaaccggttacggtaccgggttaacggtacggtaacgggttaaccgggtttaccgggttttaaccggttaaacgggttacccggtaaaccttaaccggttttaaacccgtttaaaacccggtttaaacccgttaccccgggtttacggggttaacccgttaacgggttaaccgggttacccggggttaccggggtaacccgggggaaccgggttaaaccggggttaaccggtacccgg

SEQ ID NO: 246896 - DNA, 667 bp, Homo sapiens
  misc_feature: GYAE6OF01BQHR0.9.70.G04.1.454.CMB.1.raw
  modified_base (489)..(489): a, c, t, g, unknown or other
  misc_feature (489)..(489): n is a, c, g, or t
  modified_base (505)..(505): a, c, t, g, unknown or other
  misc_feature (505)..(505): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaacgccttcacacggccctgtccctcacctgccactgtctctggtcgactccatcgaggtacggttcggttccgttcctaactcggacctggacttcccgggctacggttcccgccggacgaaagggtaccgtggagttaattagtttcgggaacgtaatcgtaagtcgaccgtaggttcggggaacccgtaccacgttacctaaccgaaccccgttcctacaagtacgtcgagtcagcagtcgtacagtccgactaccgtacccgagaacccgtgttcctcctagactagtgtagttanacgtcgaccgaccganacgacgaccgtcgtagttacttacgtgtcgacgtagacggtacggtccgtttaagtttacggacctaggtaccgttaacgttaaaacccttcgttaacgtaccggttacgtacgggtaccgttcgggttaccgggacccgtaacggggtaaccgtaaccggg

SEQ ID NO: 246897 - DNA, 901 bp, Homo sapiens
  misc_feature: GYAE6OF01C5A5B.9.70.G04.1.454.CMB.1.raw
  modified_base (179)..(179): a, c, t, g, unknown or other
  misc_feature (179)..(179): n is a, c, g, or t
tcagtgatacgtctcacgaccggtgctcgatttagtgtagtgtgaagggaaagggcctgtgaaggcttcactagtcctggacctcctgtgcaaagaacatagaaaacatctggttggttcattccctcctccgtgggtggcacgctcccagtagtcgggtcctcgtcccgaggtgcggntgcgagggacgtccgggccaggacgtagtgaacgtccttcacgtcggccctcgtcccctcacctcgacctacgttcggttccttcgttacgggtactacctaccagtaccggaaagggttccggggttccggtttacccttttccggtaaccggttaccggggtaacccgttcgggtaacccggttcccgggaccgtaacccggggttccccgggaaccggggtaaacggtaacggggtacgttaacggggggtaaactttaaggtttacgggtttaaccggggaaacgtttaacttccgttacggtaccgggtacccggtaaggggtaccccgggtccccgaaccttacccggttacctaaacccccgttaaccccggtaccgtaagtaaaacggtcgggtacccagttccaacggtcctaggtttcacgttaacgggcctaacgacccggtaaccctaacgacccgttacttccccgtaccgtagtaccgtagttacggttaagtttacctacggtaccggaccccgtcggtaaccgaacggacccgtaccggttacggtttaacttaccggttacggtcgttaacgggacgtagggtaaccggttacggttaccgttttaagtacccgagttacgttaccgttaaaacgttaacctcttaaccggtacggtacgtcgggtaacgttccgggaagggtaccggaccgggtaaccgtacgg

SEQ ID NO: 246898 - DNA, 523 bp, Homo sapiens
  misc_feature: GYAE6OF02IRGW1.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgtggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagagtcgagtcagcatgtcagtcgacacgtcccagaaccagttctccctgacagtgagttatatcgaccgccgcagacacggccgtgtattactgtgcgagagaggccgttatttaggacagctagttaaactcctaactacgtctggtacgtcgtgggccagggactaacgg

SEQ ID NO: 246899 - DNA, 531 bp, Homo sapiens
  misc_feature: GYAE6OF02G0D06.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccaagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaccagttctccctgacagtgagttatatgaccgcgcagacacggccgtgtacttactgtgcgagagaggtccgttagtttaggacctagcgtagttaaaacctcctaactacgtctcggtacgtcgtggggccaggggacctaacgg

SEQ ID NO: 246900 - DNA, 553 bp, Homo sapiens
  misc_feature: GYAE6OF02HBPN9.9.70.G04.1.454.CMB.1.raw
  modified_base (216)..(216): a, c, t, g, unknown or other
  misc_feature (216)..(216): n is a, c, g, or t
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggccgtgtgaaggcttcactagtcctggacctcctgtgcaagaacatgaaacatctgtggttcatcctcctcctggtggcagctcccagatgggtcctgtcccaggtgcggtctgcaggagtcgggcccaggactagtgaagccttcacaggccctgtccctnacctgcactgtctctggtgactccatcagaggtggtcgttcctactggacctggatccggcagtccgccggcaagggctggagtatagttggacgaatctatgccagtgggaccncatcacaacccgtcctcaagngtcgagtcagcatgtacagtcgacaccgtcccacgaccagttctccctgacagtgagttatatcgaccgccgcacgacacgcgtgtacttactgtgcgagacgacggccgtttagtttacggacctagtacttaacgttaaaacttccgtaactaaccggttctacggtacgtcgttcggggcctacggggacctaacggg

SEQ ID NO: 246901 - DNA, 526 bp, Homo sapiens
  misc_feature: GYAE6OF02I9QE3.9.70.G04.1.454.CMB.1.raw
  modified_base (331)..(331): a, c, t, g, unknown or other
  misc_feature (331)..(331): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaaggggactgggagtatattggacgaatctatgccagtgggaccnccatctacaacccgtccctcaagagtcgagtcagcatgtcagtcgacacgtcccagaaccagttctccctgacagtgagttatatgaccgccgcagacacggccgtgtattactgtgcgagagacggccgttatttacggacagctagttaaactctactacgtctacggacgtcgtgggccagggacctaacgg

SEQ ID NO: 246902 - DNA, 526 bp, Homo sapiens
  misc_feature: GYAE6OF02ICC5K.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctatggacctggatccggcagtccgccggcaagggactggagtatattggacgaatctatgccagtgggaccgccatcctacaacccgtccctcaagagtcgagtcagcatgtcagtcgacacgtccagaaccagttctccctgacagtgagttatatcgaccgcgcagacacggccgtagtattactgtgcgagagagccgttatttaggacctagcgtagttaaactcctaacttacgtcgtggacgtcgtgggccagggacctaacgg

SEQ ID NO: 246903 - DNA, 532 bp, Homo sapiens
  misc_feature: GYAE6OF02HWHK4.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggccaggactagtgaagccttcacaggccctgtccctcacctgcactgtctctggtgactccatcagaggtggtcgttcctactggacctggatccggcagtccgccggcaaggggactggagtatattggacgaatctatgccagtgggaccgccatctacaacccgtccctacaagagtcgagtcagcatgtcagtcgacacgtcccacgaaccagttcctccctgacagtgagttatatcgaccgccgcagaccacggcgtgtattactgtgcgagagaggtaccgttatttaggactagctagttaaacctctaactacgtctaggacgtcgtgggaccgagggacctaacgg

SEQ ID NO: 246904 - DNA, 534 bp, Homo sapiens
  misc_feature: GYAE6OF02HXEU0.9.70.G04.1.454.CMB.1.raw
  modified_base (329)..(329): a, c, t, g, unknown or other
  misc_feature (329)..(329): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccnccatctacaacccgtcctcaagagtcgagtcagcatgtcagtcgacacgtcccagaaccagttctccctgacagtgagttatatcgaccgccgacagacaccggcgttgtattactgtgcgtagagaggccgtttatttacggacagtctagttaaaactcctaacttacgtcttaggacgtcgtggggacctagggactaacgg

SEQ ID NO: 246905 - DNA, 613 bp, Homo sapiens
  misc_feature: GYAE6OF02G00ET.9.70.G04.1.454.CMB.1.raw
tcagtgatacgtctcacgaccggtgctcgatttagtgtagtgtgaagggaaagggtccgtgtgaaggcgttcacaggccctgtccctcacctgcactgttctctggtgactccatcagaggtggtcgttcctactggacctggatccgggctaggtccgccggcaagggtacctggagtatatttggacgaatctatgccagtggaccgccatctacaaccgtcctcaaggagtcgagtcagcagtcgtcagtcgacacgtcccagaaccagttcctccctgacagtgagttaatatgaccgcgcagacacggccgtgtattactgtgcgagaggaggccggtttatttacggaccagctagttaaaaactctactacggtctaggtacgtctgggccaggggaccaaggtcacgtctcctcacgcctccaccaagggcccatccggtccttaccccgtggccgccctgcctccgaggacgaccacctccgagacgtccgaacgacggcggccccgtggggcccgttcggcccgtttgggtaaccgtaaacgggtaccttaccgttaccgtaacggaccgtttaactccgtaacgttcgggacggcgggtcgg

SEQ ID NO: 246906 - DNA, 531 bp, Homo sapiens
  misc_feature: GYAE6OF02F9G5V.9.70.G04.1.454.CMB.1.raw
  modified_base (353)..(353): a, c, t, g, unknown or other
  misc_feature (353)..(353): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagngtcgagtcagcatgtcagtcgacacgtcccagaaccagttcctccctgaccagtgagttatatgaccgccgcagacacggccgtgtattactgtgcgagagaggccgttagtttaggaccagtctagttaaaactcctaactacggtctcggtacgtcgtgggccagggacctaacgg

SEQ ID NO: 246907 - DNA, 523 bp, Homo sapiens
  misc_feature: GYAE6OF02ITXIV.9.70.G04.1.454.CMB.1.raw
  modified_base (494)..(494): a, c, t, g, unknown or other
  misc_feature (494)..(494): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagagtcgagtcagcatgtcagtcgacacgtcccagaaccagttctccctgacagtgagttatattgaccgccgcagacacggccgtgtattactgtgcgagagaggcgttatttagaccagctagttaaacctctaactacggtntggacgtcgtgggcctagggacctaacgg

SEQ ID NO: 246908 - DNA, 533 bp, Homo sapiens
  misc_feature: GYAE6OF02IY7Q2.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtgactccatcagaggtggtcgttcctactggacctggatccggcagtccgccggcaagggactgggagtatattggacgaatctatgccagtgggaccgccatctacaacccgtcctacaagagtcgagtcagcatgtcagtcgaacacgtcccagaaccagttctccctgacacgtgagttatatgaccgcgcagaccacggccgtgtattactgtgcgagagagtcgttatttaggacagtcgtagttaaaacctccgtaactacggtctaggacgttcgtgggccgagggacctaacgg

SEQ ID NO: 246909 - DNA, 516 bp, Homo sapiens
  misc_feature: GYAE6OF02HIL5V.9.70.G04.1.454.CMB.1.raw
  modified_base (350)..(350): a, c, t, g, unknown or other
  misc_feature (350)..(350): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccgcatctacaacccgtcctcaagngtcgagtcagcatgtcagtcgacacgtcccagaccagttctccctgacagtgagttatatgaccgccgcagacacggccgtgtacttactgtgcgagagaggtcgttatttagactagctgttaaactctactacgtctcggacgtcgtgggccagggactaacgg

SEQ ID NO: 246910 - DNA, 554 bp, Homo sapiens
  misc_feature: GYAE6OF02J0BVN.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggctggagtatattggacgaatctatgccagtgggaccgcatctacaacccgtcctcaagagtcgagtcagcatgtcagtcgacacgtcccagaaccagttcctccctgactagtgtagttatatcgaccgccgacacgaccacggccgtgtacttactgtcgcgagacgaggtaccgttagtttacggacctagtacgtacgttaaaacctcgttaacgtacggtcgtacggtacgtcgtcggggacgtacggggacctaacggg

SEQ ID NO: 246911 - DNA, 555 bp, Homo sapiens
  misc_feature: GYAE6OF02I2DVI.9.70.G04.1.454.CMB.1.raw
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (420)..(420): a, c, t, g, unknown or other
  misc_feature (420)..(420): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgcggcaagggctggagtatatggacgaatctatgccagtggaccncatctacacccgtcctcaagntcgatcagcatcgcagtcgacacgtcccagaaccagttctccctgacagtgagttatatgaccgccgcagaccncggccgtgtacttactgtcgcgagagacggtccgttaagtttacggacctagtacgttaagttaaaaccctccttaacgttaccggttacgtacgggtacgttcgtcggggacccgtacgggggaccctaacggg

SEQ ID NO: 246912 - DNA, 533 bp, Homo sapiens
  misc_feature: GYAE6OF02JBOPL.9.70.G04.1.454.CMB.1.raw
  modified_base (348)..(348): a, c, t, g, unknown or other
  misc_feature (348)..(348): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggcagtcccgccggcaagggctgggagtatattggacgaatctatgccagtgggaccgccatctaccacccgtccncaagagtcgagtcagcatgcagtcgacacgtcccagaaccagttctcctgacagtgagttatatcgaccgccgcacgacgacggccgtgtacttacgtgtgcgagagacggtccgttagtttacggaccagtctaagttaaacctcctactacggtctaggcgtcgtgggaccgagggactacgg

SEQ ID NO: 246913 - DNA, 517 bp, Homo sapiens
  misc_feature: GYAE6OF02G3Y3X.9.70.G04.1.454.CMB.1.raw
  modified_base (352)..(352): a, c, t, g, unknown or other
  misc_feature (352)..(352): n is a, c, g, or t
  modified_base (490)..(490): a, c, t, g, unknown or other
  misc_feature (490)..(490): n is a, c, g, or t
tcagtgatacgtctcacgaccggtgctcgatttagtgtagtgtgaagggaaagggcctgtgaaggcttcgctagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagngtcgagtcagcatgtcagtcgacacgtcccagaaccagttctccctgacagtgagttatatgaccgccgcagacacggccgtgtattactgtgcgagagagccgttatttaggacagctagttaaactctactacgtntggacgtcgtgggccagggacctacgg

SEQ ID NO: 246914 - DNA, 782 bp, Homo sapiens
  misc_feature: GYAE6OF02JNR07.9.70.G04.1.454.CMB.1.raw
tcagtgatacgtctcacgaccggtgctcgatttagtgtagtgtgaagggaaagggccgtgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcaccctgccactgtctctggtgactccatccagaggtggtcgttcctactggaccttggactcccggcagtcccgccgggcaaaggggacctgggacgtatagtttgggaccgtaaattccgtaatcggcctaagggtgggaacccgcctacgtctaaccgaaaccccgttccctacctaaaggacgttaccggaagttccaacggtcctaagtcgtaccaacggttccgaaccgtacccggtacccgaacgtaaaccccgtaacgtttacccgtacccccgttacggtaaccgtaacggttacggtaacgtttaaacgttacgttacggtaaccccggcccggacccgaaccgaccgaaccgggtacccggtacggtttaactttaccgttaggttacggaccggttaacggaacggtaacgggtccggtttaaacgttttacgggacccgtaacggtccgtttaacggtttaaaaaccttcccgttaaaccgttacccggttaccggttacgggtaaccggttccgttaccgggggacccgtaacgggggaccctaaaccggggg

SEQ ID NO: 246915 - DNA, 529 bp, Homo sapiens
  misc_feature: GYAE6OF02I0P0F.9.70.G04.1.454.CMB.1.raw
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgcggcaagggctggagtatattggacgaatctatgccagtggaccncatctacacccgtcctcaagngtcgagtcagcatgtcagtcgacncgtcccagaaccagttcctccctgacagtgagttatatcgaccgccgcagacacggccgtgtattacgtgtgcgagagaggtcgttagtttagaccagtctagttaaaacctcctaacgtacggtctacggacgtcgtacgggccgtagggactaacgg

SEQ ID NO: 246916 - DNA, 547 bp, Homo sapiens
  misc_feature: GYAE6OF02IAEL6.9.70.G04.1.454.CMB.1.raw
  modified_base (328)..(328): a, c, t, g, unknown or other
  misc_feature (328)..(328): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccnccgatctacaacccgtccctacaagagtcgagtcagcatgtcagtcgacacgtcccagaaccagttctccctgacagtgagttatatcgaccgcgacagacacggccgtagtattactgtgcgagaggaggtacgttagtttagactagtctacgttaaaacctccgtaactacggttctacggtacgtcgtacggggtaccgacggggacctaacggg

SEQ ID NO: 246917 - DNA, 567 bp, Homo sapiens
  misc_feature: GYAE6OF02GVPJ9.9.70.G04.1.454.CMB.1.raw
  modified_base (329)..(329): a, c, t, g, unknown or other
  misc_feature (329)..(329): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatagttggacgaatctatgccagtgggaccncatctacaacccgtcctcaagcgtcgagtcagcatgtcagtcgacacgtcccagaaccagttcctccctgacagtgtagttatatcgaccgccgcacgacgaccggccgtgtacttacgtgtgcgagaggacggtaccgtttagtttacggacctagtacgttaacgttaaaaccttccgttaacgtaccggttcgtacggtacgttcgtacggggaccgtacggggaccgtaacggg

SEQ ID NO: 246918 - DNA, 547 bp, Homo sapiens
  misc_feature: GYAE6OF02HILMV.9.70.G04.1.454.CMB.1.raw
  modified_base (233)..(233): a, c, t, g, unknown or other
  misc_feature (233)..(233): n is a, c, g, or t
  modified_base (328)..(328): a, c, t, g, unknown or other
  misc_feature (328)..(328): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctactggacctggatccggcagtccgccggcaagggactggagtatattggacgaatctatgccagtgggaccnccatctacaacccgtccctacaagagtcgagtcagcatgtcagtcgacaccgtcccagaaccacgttcctccctgacagtagagttatatcgaccgccgcagaccacggccgtgtattactgtgacgagagaggtcgttagtttacggactagtacgtaagttaaacctcctaacgtacggtcgtacggacgtcgtcggggaccgaggggacctaacgg

SEQ ID NO: 246919 - DNA, 559 bp, Homo sapiens
  misc_feature: GYAE6OF02IR4G5.9.70.G04.1.454.CMB.1.raw
  modified_base (232)..(232): a, c, t, g, unknown or other
  misc_feature (232)..(232): n is a, c, g, or t
  modified_base (375)..(375): a, c, t, g, unknown or other
  misc_feature (375)..(375): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggccaggactagtgaagccttcacaggccctgtccctcacctgcactgtctctggtnactccatcagaggtggtcgttctactggacctggatccggcagtccgcggcaagggctggagtatattggacgaatctatgccagtggaccgcatctaccaacccgtcctacaagagtcgagtcagcatgtacagtccgaacnccgtacccacgaaccacgttctccctgacagtgagttatatcgaccgccgcacgacaccggcgtgtacttacgtgtgacgagaggacgtacgtttagtttacggaccacggtacgttaagttaaaacctccttaacgtacggttcgtacggacgttcgcggggacccgtaggggacctaacggg

SEQ ID NO: 246920 - DNA, 520 bp, Homo sapiens
  misc_feature: GYAE6OF02GWOVN.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctaccaacccgtcctcaagagtcgagtcagcatgtcagtcgacacgtcccagaaccagttctccctgacagtgagttatatcgaccgcgcagacacgcgtgtattactgtgcgagagagccgttatttaggacagcgtagttaaaacctcctactacgtctaggcgtcgtgggcagggacctaacgg

SEQ ID NO: 246921 - DNA, 523 bp, Homo sapiens
  misc_feature: GYAE6OF02F971S.9.70.G04.1.454.CMB.1.raw
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccncatctacaacccgtccctcaagngtcgagtcagcatgtcagtcgacacgtccagaaccagttctccctgacagtgagttatatgaccgcgcagacacggccgtgtattactgtgcgagagaggtccgttatttaggacagctagttaaaacctctaactacgtcgtggacgtcgtgggccgagggacctaacgg

SEQ ID NO: 246922 - DNA, 526 bp, Homo sapiens
  misc_feature: GYAE6OF02F48O1.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccgcatctacaacccgtccctcaagagtcgagtcagcatgtcagtcgacacgtcccagaaccagttctccctgacagtgagttatatgaccgcgcagacacggccgtgtattactgtgcgagagaggtccgttagtttagaccagcttagttaaaacctcctaactacggtctggacgtcgtggggccagggacctaacgg

SEQ ID NO: 246923 - DNA, 581 bp, Homo sapiens
  misc_feature: GYAE6OF02IM9AZ.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggatatagttggaacgaatctatcgccaggtgggaccgccatcctacaacccgtccctacaagagtcgagtcagcatgtcagtcgacacgtccagaaccagttcctccctgacagtgtagttatatcgaccgccgcagacacggccgtgtattacgtgtcgcgagacgaggtccgtttagtttacggaccgtagtccgttaacgttaaaaccttccgttaaccgttaccggttacgttcgggtaaccgttcggttacggggtacccgtacggggtaacccgtaacggg

SEQ ID NO: 246924 - DNA, 543 bp, Homo sapiens
  misc_feature: GYAE6OF02HSVLW.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatcctacaacccgtccctacaagagtcgaagtcagcatgtcagttcgacaccgtccagaaccagttcctccctgacagtgagttatatcgaccgcgcagacacggcgtgtacttactgtgcgagagagtccgttatttacggaccagtactaagttaaaacctcctaactacggtctacggtacgtcgtcggggaccaggggacctaacggg

SEQ ID NO: 246925 - DNA, 599 bp, Homo sapiens
  misc_feature: GYAE6OF02JBRX2.9.70.G04.1.454.CMB.1.raw
  modified_base (333)..(333): a, c, t, g, unknown or other
  misc_feature (333)..(333): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtccgccggcaagggctggagtatagttggacgaatctatcgccaggtcgggaccncatctaccaacccgtccctacaagcgtcgagtcagcatgcagtcgacacgtccacgacctagttcctccctagaaagtgtagttatatcgaccgccgacacgaccgaccggccgtagttacttacgtgtgcgagagtacggtaccgtttagtttacggaccgtagtaccgttaacgtttaaaacctccgttaaccgttaaccggttccgttacgggtaccggttcggttacggggacccgaacgggggtacccgtaaggtacccgg

SEQ ID NO: 246926 - DNA, 654 bp, Homo sapiens
  misc_feature: GYAE6OF02J2LTH.9.70.G04.1.454.CMB.1.raw
  modified_base (233)..(233): a, c, t, g, unknown or other
  misc_feature (233)..(233): n is a, c, g, or t
  modified_base (276)..(276): a, c, t, g, unknown or other
  misc_feature (276)..(276): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtccttcctactggacctggactccggnacgtccgccggcaagggactggagtatagttggaacgtaatctagtcgccagggtcgggaccgctatcctaaccgaacccgtccctacaaaggtcgttccgagtccaagtcaatgtacaggtccgaacctaccgtacccacgtaaccctacgtttccctacccgtagaaccacggttcgtaaagttactaagtacggtacccgccgaccacgaaccgtaccgggcgttagttacttacgtagtcggacgtaggacggtacggtccgtttaacgtttacggaccgtagtaccgttaacggttaaaacctccgttaacgttaccggttacggtacgggtaccggtcggtacggggaccggtacgggtaacccgtaacggg

SEQ ID NO: 246927 - DNA, 623 bp, Homo sapiens
  misc_feature: GYAE6OF02JNB9K.9.70.G04.1.454.CMB.1.raw
  modified_base (334)..(334): a, c, t, g, unknown or other
  misc_feature (334)..(334): n is a, c, g, or t
tcagtgatacgtctcacgaccggtgctcgatttagtgtagtgtgaaggaaagggaccgtgtgaaggcttcactagtcctggacctcctgtgcaagaacatgaaacatactgtggttcatcctcctcctggtggcagctcccagatgggtcctgtcccaggtgcggctgcaggagtcgggcccaggactagtgaagccttcacaggccctgtccctcacctgcactgtctctggtgacctccatcagtaggtggtcgttcctactggacctggatccggcagtccgccggcaagggcctggagtatattggaacaatcctatgccagtgggaccnccatcctacaacccgtcctacaaagcgttcgagtccaggcctaatcgtacacgtaccgacgtaccgtcccaacgaacccaacgttcctacccgtcgaactacgtcgtaacgttagtatacgtacccgtccgcctaacgaccgaaccgggccgtagtaacttacgtgtacgccgtagacgtacggtaccgttagtttacggaccgtagtcgttaacgttaaaacctccgttaacgttaccggttcgttaccggtcggttaccgtacggggccgtacggggactaaccggg

SEQ ID NO: 246928 - DNA, 526 bp, Homo sapiens
  misc_feature: GYAE6OF02GMQWU.9.70.G04.1.454.CMB.1.raw
  modified_base (327)..(327): a, c, t, g, unknown or other
  misc_feature (327)..(327): n is a, c, g, or t
  modified_base (348)..(348): a, c, t, g, unknown or other
  misc_feature (348)..(348): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccaagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgcggcaagggactggagtatattggacgaatctatgccagtggaccncatctacacccgtcctcaagngtcgagtcagcatgtcagtcgacacgtccagaaccagttctccctgacagtgagttatatgaccgcgcagacacggcgtgtattactgtgcgagagacggtccgttatttaggacagtactagttaaaacctcctaacgtacgtcgtacggtacgtcgtcgggcgacgggactaacgg

SEQ ID NO: 246929 - DNA, 538 bp, Homo sapiens
  misc_feature: GYAE6OF02JEUY9.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgcatctacaacccgtcctacaagagtcgagtcagcatgtcagtcgacacgtccagaaccagttcctcctgacagtgagttatatgaccgccgcagaccacggccgtgtacttacgtgtcgcgagagaggtaccgttagtttaggacctagacgtagttaaaactcctaactacggttcgtggacgttcgtcgggccgagggacctaacgg

SEQ ID NO: 246930 - DNA, 539 bp, Homo sapiens
  misc_feature: GYAE6OF02GSBV5.9.70.G04.1.454.CMB.1.raw
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagttgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccgcatctacaacccgtccctcaagngtcgagtcagcatgcagtcacacgtcccagaaccagttctccctgacagtgagttatatcgaccgccgcagacacggccgtgtattactgtgcgagagaggtccgtttagtttacggactagtacgtaagttaaaacctcctaacgttacggtcgtacggtcgtcgtggggccgaggggacctaacgg

SEQ ID NO: 246931 - DNA, 546 bp, Homo sapiens
  misc_feature: GYAE6OF02F8SIT.9.70.G04.1.454.CMB.1.raw
  modified_base (329)..(329): a, c, t, g, unknown or other
  misc_feature (329)..(329): n is a, c, g, or t
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaaggggactggagtatattggacgaatctatgccagtggaccncatctacaacccgtcctcaagngtcgagtcagcatgtcagtcgacacgtcccagaaccagttcctccctgacagtgagttatatcgaccgccgacacgacacggccgtgtacttacgtgtcgcgagagaggtccgttagtttacggactagtacgtacgttaaaactccttaacgtacgtcgtacggtacgtcgtcgggccgacgggaccgtaacgg

SEQ ID NO: 246932 - DNA, 547 bp, Homo sapiens
  misc_feature: GYAE6OF02JBO8B.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactgacctggactcggcagtccgcggcaagggactggagtatagttggacgaatctatcgccaggtggaccgcatctaaccaaacccgtccctacaaagacgtcgagtccagcatcgtcagtcgacacgtacccagaaccagttcctcctgaacagtagagttatatgaccgcgcagacacggcgtgtattacgtgtgcgagagacggtcgttatttaggacctagcgtaacgttaaaactcctaactacggttctacggtacgtcgtgggaccgtacggggactaacgg

SEQ ID NO: 246933 - DNA, 553 bp, Homo sapiens
  misc_feature: GYAE6OF02H5KSZ.9.70.G04.1.454.CMB.1.raw
  modified_base (347)..(347): a, c, t, g, unknown or other
  misc_feature (347)..(347): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggactgggatatagttggacgaatctatgccagtgggacccatcacaacccgtccctanaagagtcgagtcagcatgtcagtccgacacgtcccagaacctagttcctccctgacagtgagttatatcgaccgccgcacgacacggcgtgttacttacgtgtgcgagagtaggtccgtttagtttcgaccgtagtactacgttaaaactcctaacgttaccgttcgtaggtacgtccggtacgggaccgacggggacctaacggg

SEQ ID NO: 246934 - DNA, 632 bp, Homo sapiens
  misc_feature: GYAE6OF02J109W.9.70.G04.1.454.CMB.1.raw
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
tcagtgatacgtctcacgaccggtgctcgatttagtgtagtgtgaagggaaagggccgtgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggngacctccatcagaggtgtcgttcctacnggacctggactccggcagtcccgccggtnaaaggactgggatatatggacgtaatctatcgccaggtcggaccgccatcctaaccacccgtcctacaagacgtcagtccagacatggtacaggtcactaccgtacccacgaaccctagttccctaccgtgacgtacgtagtagttactattcggacccgccgccaacggaccgtccgggtacccgttagttacgttacgtacggtacgaccgtagaacggacggttaccgtttaagtttacggaccgtagtaccgttaaacggtttaaaacccttcctaaccgttaacggtccgttacgggtaccgtccggtcgggacccgtacggggacccgtaaccggg

SEQ ID NO: 246935 - DNA, 516 bp, Homo sapiens
  misc_feature: GYAE6OF02HPKS4.9.70.G04.1.454.CMB.1.raw
  modified_base (327)..(327): a, c, t, g, unknown or other
  misc_feature (327)..(327): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggctggagtatattggacgaatctatgccagtgggaccncatctacaacccgtccctcaagagtcgagtcagcatcgtcagtcgacacgtccacgaaccagttctccctgacagtgagttatatcgaccgccgcagacacggcgtgtattctgtgcgagagagcgttatttaggactagctagttaaactctactacgtctggacgtcgtcgggacgagggactacgg

SEQ ID NO: 246936 - DNA, 527 bp, Homo sapiens
  misc_feature: GYAE6OF02IHJPD.9.70.G04.1.454.CMB.1.raw
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgcatctacaacccgtcctcaagngtcgagtcagcatgtcagtcgacacgtcccagaaccagttctccctgacagtgagttatatgaccgcgcagacacggccgtgtacttactgtcgcgagagaggccgtttatttaggacctagctagttaaactctaactacggtctggtacgtcgtcgggccgacgggactaacgg

SEQ ID NO: 246937 - DNA, 592 bp, Homo sapiens
  misc_feature: GYAE6OF02I9Z7W.9.70.G04.1.454.CMB.1.raw
  modified_base (356)..(356): a, c, t, g, unknown or other
  misc_feature (356)..(356): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcacggtcccgccggcaagggactggagtatagttggacgaatctatgccagtcgggaccgcatcctaccaacccgtcctanaagacgtcgagtcagcatcgcagtccgacacgtccaacgaacctagttcctacctgacagtgtagttatatcgaccgccgacacgacgaccggcgtgttacttacgtgtcgacgagacggtacggtaccgtttagtttacggaccgtagtacgttaacgttaaaacctccctaacgttaccggttcgtacggtaccggttcggtacggggtacccggacggggtaccgtaaccggg

SEQ ID NO: 246938 - DNA, 534 bp, Homo sapiens
  misc_feature: GYAE6OF02GQ83W.9.70.G04.1.454.CMB.1.raw
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccncatcacacccgtcctnaagngtcgagtcagcatgcagtcgacaccgtccagaaccagttcctccctgacagtgagttatagtcgaccgccgcacgacacggccgtgtacttacgtgtgcgagagaggtccgttatttaggaccagtacgtagttaaaacctccgtactacgtctacggtacgtcgtgggccgtagggacctaacgg

SEQ ID NO: 246939 - DNA, 575 bp, Homo sapiens
  misc_feature: GYAE6OF02JT3G4.9.70.G04.1.454.CMB.1.raw
  modified_base (233)..(233): a, c, t, g, unknown or other
  misc_feature (233)..(233): n is a, c, g, or t
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (381)..(381): a, c, t, g, unknown or other
  misc_feature (381)..(381): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctactggacctggactccggcagtccgccggcaagggctgggatatattggacgaatctatgccagtggaccncatctacaccgtcctnaagntcgagtcagcatgtcagtcacacgtccagaccngtctcctgacagtgtagttatatcgaccgccgacacgacgaccggtcgttgtaacttactacgtgacgagtacgacggtaccgtttagtttacggacctaagtaccgtaacgtttaaaaccttccgttaaccgttaacggttcgttacgggtaccggttccgtacggggacccgtaacggggacccgtaacggg

SEQ ID NO: 246940 - DNA, 556 bp, Homo sapiens
  misc_feature: GYAE6OF02IRPSW.9.70.G04.1.454.CMB.1.raw
  modified_base (396)..(396): a, c, t, g, unknown or other
  misc_feature (396)..(396): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcagaagtcgggcccaggactagtgaagccttcacaggccctgtccctcacctgcactgtctctggtgactccatcagaggtggtcgttcctactggacctggatccggcagtccgccggcaaggggactgggatatagttggacgaatctagtgccagtcgggaccgcatctacaacccgtcctacaagagtcgagtcagcatgtcagtcgacacgtccagaccagttcnccctgacagtgagttatatacgaccgccgcagaccaccggcgtcgtattcgtgtagcgagagaggtccgtttagtttacgactagtactaacgttaaacctccgttaaccgtacggttcgtacggtacgtccgtaggggaccctacggggacctaacggg

SEQ ID NO: 246941 - DNA, 770 bp, Homo sapiens
  misc_feature: GYAE6OF02H45MP.9.70.G04.1.454.CMB.1.raw
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcccggtggcagctcccacgatgggtccgtgtcccaaggtggcggcctgcgaggaggtcgggccccgaggacgtaagtgaaggccttcacaagggcccctcgtccctacaccctgcactgtctctggttagacttccatcagaggtggtcgttcctactggctagngtcgcgngtccgccggcaacgggacgtacggagtatagttggacgtaagtctactgccgagtggaccggccatcgtacctaaacccggtacccctcgaacgtaaacggcgtacgtaccgagacgactgtacctaggttaccgacgtaacccggtaccctaacctaaccgtaaccgtttaccgtttacccctaccgtaaccgtaccggttacggtaaaggttaacgttaacgtaacggtaacccgtacccggaccaaccgggtaaaccgaccggtacccgggttacgttaacgtttaacgttcggttacggtaccggagtaacgggaacgggaccggttttaacgtttttacgggacgttaaccggtacgtttaaccggttaaaaacgttaacccgtttaaccgttaaccggttaccgttacgggtaaccggtcggtaccggggtacccgggtaacggggtacccggaaagggttaaccccgg

SEQ ID NO: 246942 - DNA, 529 bp, Homo sapiens
  misc_feature: GYAE6OF02GQ1KK.9.70.G04.1.454.CMB.1.raw
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgcggcaagggactggagtatattggacgaatctatgccagtggaccncatcacacccgtcctnaagngtcgatcagcatgtcagtccgacacgtcccagaaccacgttctccctgacagtgagttatatcgaccgcgcagacacggcgtgtattacgtgtgcgagagaggtccgttagtttaggactagacgttaacgttaaacttcctactacgtcgtacgacgtcgtgggccgacgggacctaacgg

SEQ ID NO: 246943 - DNA, 640 bp, Homo sapiens
  misc_feature: GYAE6OF02GUM9C.9.70.G04.1.454.CMB.1.raw
  modified_base (235)..(235): a, c, t, g, unknown or other
  misc_feature (235)..(235): n is a, c, g, or t
  modified_base (279)..(279): a, c, t, g, unknown or other
  misc_feature (279)..(279): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgaggccctgtccctcacctgcactgtctcgtggtnactccatcagaggtggtccttcctactggacctggactccggcncgtccgcggacaagggctggatatgttggacgaatctatcgaccgaggtcgggacccgctatcctaaccaaccccgttcccacaagacgtccgagtccagtccaagtcgtacgagtccgaacctaccgtacccaacgaacctacgttccctcccgtagaactaggttagtacgttaatacgtccgacccggcccgacaccggaaccgaccggtccggttagttaacgttacgtcggtcggacggagaaggtacggtaccgtttagttttaacggacctagtacgttaaacgttaaaccttccgttaaccgtacggttacgtacggaccggttcggtacgggacgtacgggaccgtaacggg

SEQ ID NO: 246944 - DNA, 514 bp, Homo sapiens
  misc_feature: GYAE6OF02F86O6.9.70.G04.1.454.CMB.1.raw
  modified_base (326)..(326): a, c, t, g, unknown or other
  misc_feature (326)..(326): n is a, c, g, or t
  modified_base (349)..(349): a, c, t, g, unknown or other
  misc_feature (349)..(349): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggctggagtatattggacgaatctatgccagtggaccncatctacaacccgtccctcaagngtcgagtcagcatgtcagtcgacacgtccagaaccagttctcctgacagtgagtatatgaccgccgcacgacacggccgtgtattactgtgcgagagaggtcgttatttacgacagctagtaaactcctactacgtctggacgtcgtgggccgagggaccaacgg

SEQ ID NO: 246945 - DNA, 613 bp, Homo sapiens
  misc_feature: GYAE6OF02JN7FK.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtcccggccggacaaggggactgggagtatagttggacgtaatctatgcctaggtcgggaccgccatcctaaccaacccgtccctacgaagcgtcgagtcagctagtcgtacacgtcgacaccgtccaacgaacctacgttcctcctgactagtagtacgttactagtcgaccgccgacgacgaccgaccggccgtagtacttacgtcgtacgacgtaagacggtacggtaccgtttaacgtttacggacctacgtacgtaacgttaaacctccgttaacgttacggtacgtacggtacgtaccggtacggggtaccgtacgggtacccgtaacgg

SEQ ID NO: 246946 - DNA, 544 bp, Homo sapiens
  misc_feature: GYAE6OF02F4HBY.9.70.G04.1.454.CMB.1.raw
  modified_base (328)..(328): a, c, t, g, unknown or other
  misc_feature (328)..(328): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggactggagtatattggacgaatctatgccagtgggaccnccatctacaacccgtccctcaagacgtcgagtcagcatgtcagtcgacacgtcccagaaccagttcctccctgacagtgagttatattcgaccgccgcagaccacggccgtgtattacgtgtgcgtagagaggtccgtttatttacggactagacttaacgttaaactcctaacgtacggtctcggtacgtcgtagggccgtaggggacctaacgg

SEQ ID NO: 246947 - DNA, 550 bp, Homo sapiens
  misc_feature: GYAE6OF02GMP6L.9.70.G04.1.454.CMB.1.raw
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaaggggactggagtatagttggacgaatctatgccagtcgggaccgtccatctacaacccgtcctcaagngtcgagtcagcatgtcagtcgacncgtccagaaccagttcctcctgacagtgagttatatcgaccgcgcagacacgggcctgtacttacgtgtcgcgagagacggtccgtttaagttacggaccagcttaacgtaaactccgtaacgtacggtctacggaccgttcgtacggggccgtacgggtaccgtaacgg

SEQ ID NO: 246948 - DNA, 518 bp, Homo sapiens
  misc_feature: GYAE6OF02GRZGA.9.70.G04.1.454.CMB.1.raw
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtggaccgcatctacaacccgtccctcaagngtcgagtcagcatgtcagtcgacacgtcccagaaccagttctccctgacagtgagttatatgaccgccgcagacacggccgtgtattactgtgcgagagaggcgttatttagaccagctagttaaactcctactacgtctggacgtcgtgggcacgggacctaacgg

SEQ ID NO: 246949 - DNA, 846 bp, Homo sapiens
  misc_feature: GYAE6OF02GZJIV.9.70.G04.1.454.CMB.1.raw
tcagtgatacgtctcacgaccggtgctcgatttagtgtagtgtgaagggaaagggccgtgtgaaggcttcactagtcctggacctcctgtgcaagaacatgaaacatactgtggttcatcctcctcctggtgcagctcccagatgggtctgtcccaggtgcggctgcaggagtcgggcccaggactagtgaagccttcacaggccctgtccctcacctgcactgtcctgtggtgacttccgatcagtaggtggtcgttcctacgtcggtacctggactccggacacggtcccggccggacaaacggggtactgggaagttattacgttcggaacgtaagttcctaagtcggaccgtagggtaccgggtaacccgtcctaagttacctaacccgaaccccggttccctacgaaacggtcggttacggaacgtacgtaaggccctaagttccggtacctaacgggtacccgaacctacccggttacccgtaaaccggtaaacccgttaacggtttacccctacccgttaacggtaaccgtaacgggttacggtaacgtttaacgttaacggtaccgtaaccccggtaccggtaccgtaacgaacccggtacccgggtaccggttaacggttaaaccgttaccgtttacgggtaccgtaaccgggttaacggtaaccgggtaacgggttaaccgttttaaacgttttaccggggtaaccttaacggtaccggtttaaaccgtttaaaaacccggtttcccgtaaaccggtttaaccgggttaccgttacgggttaccggttaccggttaccggggtaccggttaaccggggtaacccgttaaaccgggg

SEQ ID NO: 246950 - DNA, 794 bp, Homo sapiens
  misc_feature: GYAE6OF02H2FPK.9.70.G04.1.454.CMB.1.raw
  modified_base (349)..(349): a, c, t, g, unknown or other
  misc_feature (349)..(349): n is a, c, g, or t
tcagtgatacgtctcacgaccggtgctcgatttagtgtagtgtgaagggaaagggccgtgtgaaggcttcactagtcctggacctcctgtgcaagaacatagaaacatctgtggttcatcctcctcctggtggcagctcccagatgggtcctgtcccaggtgcggctgcaggagtcgggcccaggactagtgaagccttcacacggccctcgtccctcacctgctactgtctcttaggtcgaccttccatcagaggttcggtccgttcctacgtcggtacctggactccggcaggtcccggcggacgaagggacctgggaataacgtagttacggaacgtacttactancggtaccgaagggtcgggtaacccgacctaacgttccgttaacccgaaaccccccggttccccttaacgaaaacgggtacggttccggtaaacggttcgaacggcctaactttcgggtaccgacggttaccgaaccccgtaacccggtacccgaaacggtaaacccctaacgggtttttcccctaacccgtacgtaaaccgtaacgggttacgtaacgttttaacgtaaacgttcgtaacccgttgacccgacgaacgtaacccggaccgggtaccgttagttaccgtttaacgcggttaccggtaacgacgggtaacggtaacgggttccgtttttaagtttaccgggacctaacgtacgtttaaacgtttaaaaccctccgttaaacgttcggttacgtacgggaccgtttaccgggtacggggacccggtaggggaaacccg

SEQ ID NO: 246951 - DNA, 693 bp, Homo sapiens
  misc_feature: GYAE6OF02I1OE8.9.70.G04.1.454.CMB.1.raw
  modified_base (321)..(321): a, c, t, g, unknown or other
  misc_feature (321)..(321): n is a, c, g, or t
  modified_base (364)..(364): a, c, t, g, unknown or other
  misc_feature (364)..(364): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtcggtcgttcctacgtggacctggactccggcacggtccgccggacaagggctggagtatagtggacgtatctancgaccaggtcggaccgccattcctaaaccgaacccgtccctanaacgacgtcgatcgagctacgtcgttcaaggtccgaacgacccgtaccccgaagaaccctacgtttcccctcccgtagtaacgtagtttaacgttacacgttcgaacccgccgacgtaaccgaacgtaccgggtacccgttgtttaacgttaccgttggtccggacgtaacggaacgggtaccgggtacccgtttttaaggtttaaccgggtaacctacgttaccgttaaaggtttaaaacccttccgttaacggttaaccggttccgttacgggtaccggtccgggttacggggacccgtaacgggggtaacccgtaaggtaccccgg

SEQ ID NO: 246952 - DNA, 538 bp, Homo sapiens
  misc_feature: GYAE6OF02IYU5W.9.70.G04.1.454.CMB.1.raw
  modified_base (331)..(331): a, c, t, g, unknown or other
  misc_feature (331)..(331): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtcccgcggcaagggctggatatagttggacgaatctatgccaggtcgggaccnccatcctacaaccccgtccacaagcgtcgagtcagcatgcagtcgacacgtcccagaacctacgttctccctgacagtgagttatatgacccgccgacacgaccacggccgtgtacttacgtgtgcgagaggaggtccgtttatttagacagtactaagttaaactcctactacgtctcggcgtcgtgggaccgagggacctaacgg

SEQ ID NO: 246953 - DNA, 730 bp, Homo sapiens
  misc_feature: GYAE6OF02JKZBN.9.70.G04.1.454.CMB.1.raw
tcagtgatacgtctcacgaccggtgctcgatttagtgtagtgtgaagggaaagggccgtgtgaaggcttcactagtcctggacctcctgtgcaagaacatgaaacatctgtggttcatcctcctcctcggtggcagctcccagatgggtcctgtcccaggtgcggctgcaggagtcgggcccaggactagtgaagccttcacaggccctgtccctcacctgcactgtctctggtgactccatcagaggtggtcgttcctactcggacctggactccggcagtccgccggcaacgggctggatatattggacgaatctatcgccgagtcgggaccgcactcctaaccaacccgtccctacgaagagtccgaggtcaggtccaagtcgtcacggtccgaacgtaccgtacccaacgtaaccctaacgtttccgtaccccgttagaaccgtaaggttacggtaagttaacttacggttacgtaacccggtcccgaccgtaacgaacccgtaccgggtacccgttaggtttaaccgtttaccgttaggttacggaccgttaaggacggtaacgggtaccgttttaacggttttaacggtacccgtaaggtacccgtttaaacggtttaaaaacccttacccgtaaaccggttaaccgggttaccggtttacgggtaacccggttccgggttacgggggtaccccggtaacggggggtaccccttaaaccggggg

SEQ ID NO: 246954 - DNA, 613 bp, Homo sapiens
  misc_feature: GYAE6OF02HFTRI.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcacgtccgccggcaagggactggagtatagtggacgatctatcgcgaggtcgggaccgcctatctaccgaacccgtcctacgaagacgtacgagtcagcatgcacgtcgacgaccgtaccgacgacctacgttccctcccgtgactagtgtagttactagtcgacccgccgacgacgaccgtaccggcgttagttactttacgtggtacgacggaagacggtacggttaccgtttacgtttacggacctacgtacgttaacgttaaaaccttccgttaaccgttacggttcgttacggtacggttccggtacgggaccggtacgggaccgtaaccggg

SEQ ID NO: 246955 - DNA, 559 bp, Homo sapiens
  misc_feature: GYAE6OF02JE4MW.9.70.G04.1.454.CMB.1.raw
  modified_base (233)..(233): a, c, t, g, unknown or other
  misc_feature (233)..(233): n is a, c, g, or t
  modified_base (331)..(331): a, c, t, g, unknown or other
  misc_feature (331)..(331): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttctactggaccctggactccggcaggtcccgccggcaagggctgggagtatattggacgaatctatgccagtggaccnccatctacaacccgtccctgaagcgtcgagtcagcatgtcagtcacacgtcccagaaccagttctccctgacagtgagttatatcgaccgccgacacgaccacggccgtgtacttacgtgtgcgagagacggtaccgtttagtttacggactagacgttaacgttaaaacctccgtaacgtacggtacgtcggtacgttcgtacggggaccgtacggggactaacggg

SEQ ID NO: 246956 - DNA, 568 bp, Homo sapiens
  misc_feature: GYAE6OF02I4DVC.9.70.G04.1.454.CMB.1.raw
  modified_base (352)..(352): a, c, t, g, unknown or other
  misc_feature (352)..(352): n is a, c, g, or t
  modified_base (542)..(542): a, c, t, g, unknown or other
  misc_feature (542)..(542): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtcccgcggcaagggctggagtatattggacaatctatgccagtcgggaccgccatcctaaccaacccgtccctanaagagtcgagtcagcatgtcagtcgacacgtccagaaccagttcctccctgacagtgagttatatcgaccgccgcacgaccgacggccgtagtacttacgtgtcgcgagagacggtccgtttagtttacggacctagtacgttaagttaaaaccttcctaacgttaccggtacttcgggtaccgttcggnggggtacccgaggggaccctaacggg

SEQ ID NO: 246957 - DNA, 570 bp, Homo sapiens
  misc_feature: GYAE6OF02FX88D.9.70.G04.1.454.CMB.1.raw
  modified_base (333)..(333): a, c, t, g, unknown or other
  misc_feature (333)..(333): n is a, c, g, or t
  modified_base (476)..(476): a, c, t, g, unknown or other
  misc_feature (476)..(476): n is a, c, g, or t
  modified_base (503)..(503): a, c, t, g, unknown or other
  misc_feature (503)..(503): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcaggtccgccggcaagggactgggagtatagttggacgaatctatgccaggtgggaccncatctaccaacccgtccctcaagcgtcgagtcagcatgtacagtccgacacgtcccaagaaccctgttcctcctgacagtgtagttatacgtcgacccgccgacacgaccaccggtccgtagtacttacgtgtcgcggtaagnggtacggtacgtttagtttacggaccngtacgttaagttaaacctccgtaacgtacgtgtacggtcgtcggtcgggaccgtagggacctaacgg

SEQ ID NO: 246958 - DNA, 548 bp, Homo sapiens
  misc_feature: GYAE6OF02H37O7.9.70.G04.1.454.CMB.1.raw
  modified_base (233)..(233): a, c, t, g, unknown or other
  misc_feature (233)..(233): n is a, c, g, or t
  modified_base (334)..(334): a, c, t, g, unknown or other
  misc_feature (334)..(334): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (418)..(418): a, c, t, g, unknown or other
  misc_feature (418)..(418): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtnactccatcagaggtggtcgttcctactggacctggatccggcagtcccgccggcaagggctgggagtatagttggaacgaatctatgccaggtcgggaccncatctaccaacccgtccctanaagngtcgagtcagcatgacngtcacacgtccagaacctagttcctccgtgacagtgagttanagtcgaccgcgacagacaccggcgtgtattcgtgtgcgagagaggtccgtttagttacggactagtcttaacgttaaacctcttaacgtacggtcttacggacgtcggtcgggacgacgggacctaacgg

SEQ ID NO: 246959 - DNA, 548 bp, Homo sapiens
  misc_feature: GYAE6OF02IXYPN.9.70.G04.1.454.CMB.1.raw
  modified_base (233)..(233): a, c, t, g, unknown or other
  misc_feature (233)..(233): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctactggacctggatccggcagtccgccggcaagggactggagtatattggacgaatctatgccagtgggaccnccatctacacccgtccncaagngtcgagtcagcatgtcagtcgacacgtcccacgaaccagttcctcctgacagtgagttatatgaccgccgcacgacacggcgtgtacttacgtgtgcgagagacggtccgttagtttacggaccagtcttaacgttaaaacctcgtaacctacggtcgtacggtacgtccgtacgggccgtacgggaccgtaacggg

SEQ ID NO: 246960 - DNA, 593 bp, Homo sapiens
  misc_feature: GYAE6OF02GHAXZ.9.70.G04.1.454.CMB.1.raw
  modified_base (172)..(172): a, c, t, g, unknown or other
  misc_feature (172)..(172): n is a, c, g, or t
  modified_base (247)..(247): a, c, t, g, unknown or other
  misc_feature (247)..(247): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
tcagtgatacgtctcacgaccggtgctcgattttagtgtagtgtgaagggaaaggggaccgtgtgaaggcttcactagtcctggacctccctgtgcaagaacatgaaacatctgtggttcatcctcctcctggtggcagtctcccaggatgggtcctgtcccaggtcgcggntgcaggagtcgggcccagggactagtgaagccttcgacgagggccctcgtccctcaccctgcactgtctctggtnactccatcagtaggtcgtcgttccactggtacctggactccggcacgtcccgcggcgaagggctggagtatgtggaacatctatcgcagtcggacncatcacaccgtcanaagcgtcgtagtcgagctatcgtcagtccgactcgtccacgaccacgtcctcctgactacgtcgacgtatacgtcgaccgacgcacgacctaccggccgtagtaccttacgtcggtcgcgtagacggacggttacgttaagtttacggacctagtaccgttaaagttaaaccttccgtaaccgttacggtacgttacgggaccgttacggcgggtaccggtacgggaccgtaacgg

SEQ ID NO: 246961 - DNA, 629 bp, Homo sapiens
  misc_feature: GYAE6OF02H1URK.9.70.G04.1.454.CMB.1.raw
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctacgtggaccctggactccggcaggtcccggccggcgaaaggggctgggagttatagtttggacgaattctatcgccaggtcgggaccnccactcctaaccaaccccgtccctanaagagtcgagtcgagccaagtcgtaccagtccgaacgtaccgtacccgaacgaacctacgtttcctcccgtacgtactagtagtagttatactcgaccgccgcgacgaccgacggacgtagttacttacgtgtcgcgagacggtacggtacgtttagtttacgaccgtacgtacgttaacgtttaaaaccttcccgttaacgttaccggtacgtacggtaccggttccgtcggggaccgtaccggggacgtaaccggg

SEQ ID NO: 246962 - DNA, 785 bp, Homo sapiens
  misc_feature: GYAE6OF02J3IXQ.9.70.G04.1.454.CMB.1.raw
  modified_base (169)..(169): a, c, t, g, unknown or other
  misc_feature (169)..(169): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (674)..(674): a, c, t, g, unknown or other
  misc_feature (674)..(674): n is a, c, g, or t
tcagtgatacgtctcacgaccggtgctcgatttagtgtagtgtgaagggaagggcctgtgaaggcttcactagtcctggacctcctgtgacaagaacatagaaacatcgtgtgttcacttccctcctccgtggcgcacgcctcccgagacgttcgggtcctcggtccgngggttgcggctaggacgtaacgggcggtccgggaccgagtactagtacgaccgtccttacncgccggtcctcgtacccncactcgctcgtgtcgtacgtcggtactacctccgaagtcgtaaggttccggttcggttaccctttaccgacgtccggtaccgtgggaccccgttccgggaccgacccgggaccggtaccggaacggtacggtagtcgttaagtactttacggtacggacttaaccgtgtacgaacccggcggtaacggtcccggaccctacctaaccggtacccttaaacccccgacccgttacgaacggtagtaccggtcgataccgagtcctacggtccgtaaccgtccgaaccgtacccctaacccgtacctaacgtaaccccgtttcgttacccgaccgtaagtacgtacggttacgtaacgttaccgaaccggttccgaacccgtccgaacggtaccgtaacggtccgtacgttagttacgacggttacgnggtaccgtagtaccgtacgttaacgttacgacctacgtacgttacctaaaccgtaccgagtaccggtagtcggtacctacgggtccggaaccggcggtacccgtgtacccg

SEQ ID NO: 246963 - DNA, 616 bp, Homo sapiens
  misc_feature: GYAE6OF02HL0OV.9.70.G04.1.454.CMB.1.raw
  modified_base (275)..(275): a, c, t, g, unknown or other
  misc_feature (275)..(275): n is a, c, g, or t
  modified_base (330)..(330): a, c, t, g, unknown or other
  misc_feature (330)..(330): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccagggactagtgaagccttcacaggccctgtccctcacctgcactgtctctggtgactccatcagaggtggtcgttcctactggacctggatccggnagtccgcgcaagggctggagtatagttggacgtaatctatgccagtcggggaccnccgatcctaacaaccccgttccctanaagngtcgagtcagcaatcgactagcgacaccgtacccagaaacccagtttccacccctgaaccagtgacgttatacttcggacccgcgtcgagaccgacggtcccgtgttaactttctcggtacgccgtaagaaggtacggtaccgttttaattttacgggaccctagtccgttaaaggtttaaaaccctccgttaccgttaaccggtcgtacgggtaccgttcggtccgggggaaccgtaggggtaccctaaaccggg

SEQ ID NO: 246964 - DNA, 573 bp, Homo sapiens
  misc_feature: GYAE6OF02FHFHR.9.70.G04.1.454.CMB.1.raw
  modified_base (326)..(326): a, c, t, g, unknown or other
  misc_feature (326)..(326): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtccgccggcaaggctggatatattggacaatctatgccagtgggaccnccatcctacaacccgtccctcaagagtcgagtcagcatgtcagtcacacgtcccagaaccagttcctccctgacagtgagttatactcgacccgccgccacgaccaccgggccgttgtacttacgtgtagcgagagacggtccgtttaagtttaggaccagtaccgttaagttaaaaacctccgttaacgttaccggtcgttacggtaccggttacggtcggggtaccgacggggtaccctaacggg

SEQ ID NO: 246965 - DNA, 658 bp, Homo sapiens
  misc_feature: GYAE6OF02I2PED.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtgactccatcagaggtgtcgttcctactggacctggactccggcacgtcccggccggcgaaaggggacctgggagtatagttggaacgtaatctaagtcgccgaaggtcgggacccgacacgttacctaacccgaaccccgttcccctacgaaacgacggttcggaacgttcaaggacctaagttcggtacaacggtccgaacctaccgtaccccgaacgaaaccctacgtttccctacccgtacgaccgaggttagtaagttactaagtcgaacccggtccgcgacgaccgaccggtccgttagttacttacgtgtacggcgagaggtacggtcgttaagtttacgactacgtacgttaacgttaaactcctaaccgtacggtacgtcggtaccggttcgtcggggaccgacgggtaccgtaacgg

SEQ ID NO: 246966 - DNA, 701 bp, Homo sapiens
  misc_feature: GYAE6OF02GBZAK.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtcccgccggcgaagggactgggagtattagtacggacgtaatctatcgccgtaggtcgggaccgcctatacctaacctaaccccgtccctacgaagtacgtcgaacgtacgacgctagtcgtacgtacggtaccgacgtacccgtacccgaacgaaaccttacgtttccctacccgtacgaacctacgggtacgttaacgtttactacggttacccggacccgtccggtacgaacgtacccgacgggtacccgttagttaacgttaccgtggtacggacggagtaacggtacggttacgttttaacgtttacgaccgtacgtacgtttaaacgttaaaacctttcccgtaaccgttaccggttacggttaccggtacggttaccggtaccggggtaccggtaccggggtaaccgtaacccggg

SEQ ID NO: 246967 - DNA, 569 bp, Homo sapiens
  misc_feature: GYAE6OF02HQ8U2.9.70.G04.1.454.CMB.1.raw
  modified_base (316)..(316): a, c, t, g, unknown or other
  misc_feature (316)..(316): n is a, c, g, or t
  modified_base (374)..(374): a, c, t, g, unknown or other
  misc_feature (374)..(374): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctangccagtgggaccgccatctaccaaccccgtccctcgaagacgtcgagtcagcatgtcngtcgacacgtccagaaccagttcctccctgacagtgagttatatgacccgcgtccagaccacggccgttagtattacgtgtgcgagaggaggtcccgtttagtttacggacctagtcgttaagttaaaaccttccttaacgttaccggtcgttacggtaccggttcgtcgggggaccgtacggggacctaacggg

SEQ ID NO: 246968 - DNA, 564 bp, Homo sapiens
  misc_feature: GYAE6OF02IXQHC.9.70.G04.1.454.CMB.1.raw
  modified_base (383)..(383): a, c, t, g, unknown or other
  misc_feature (383)..(383): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatcgtatgccaggtgggaccgccatcctaccaaccccgttccctacaagagtcgagtcagcatgtcagtcgacncgtcccagaaccagtctccctgacagtgagttatatcgaccgccgcacgaccacgggccgtgtattacgtgtgcgagagacggtcgttagtttacggacctagacgttaagttaaaacctccgtaacgttaccggtcgttacggacgttccggtcggggacccgtacggggacctaacggg

SEQ ID NO: 246969 - DNA, 556 bp, Homo sapiens
  misc_feature: GYAE6OF02GD5HV.9.70.G04.1.454.CMB.1.raw
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggctggagtatattggacgaatctatgccagtggaccgcatctaccaacccgtccctacaagngtcgagtcagcatgtcagtccgacaccgtcccagaaccagttcctcctgacagtgagttatatcgaccgccgacacgaccacggtccgtgtacttacgtgtgcgtagagtacggtccgtttattacggactagtcttaagttaaaccttccgtaacgttacggtctacggtacgtccggtggggacccgagggtaccgtaaccgg

SEQ ID NO: 246970 - DNA, 556 bp, Homo sapiens
  misc_feature: GYAE6OF02HMW0L.9.70.G04.1.454.CMB.1.raw
  modified_base (286)..(286): a, c, t, g, unknown or other
  misc_feature (286)..(286): n is a, c, g, or t
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggnaagggctggagtatattggacgaatctatgccagtcggaccncatctaccaacccgtccctanaacgngtcgagtcagcatgtcagtcacacgccagaccagttcctcctgacagtgtaagttatagtcgaccgccgacacgaccacggccgtgtacgttactgtcgacgaagaggacgtacgttagtttacggacagtactaacgttaaacctccttaacgttacggtcgttacggacggttacgtacgggaccggagggacctaacgg

SEQ ID NO: 246971 - DNA, 618 bp, Homo sapiens
  misc_feature: GYAE6OF02IXF60.9.70.G04.1.454.CMB.1.raw
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatagttggacgaatctatcgccaggtcgggaccgcaatcctaaccaaccccgtccctanaacgacgtcgagttcaacgctaatcgtacaggtccgaccaccgtacccacgaaacctacgttcctccctgaactagtcgaagttatattacggaccgtccgacaacgaccgacggtccgtagtagttacgtggtcgacgtagacggtacggtaccgtttagttttaacggaccctagtaccgttaaacgttaaaaccttcctaacgttaccggttgtacgggtaccgttacggtcggggacccgacggggtacctaacggg

SEQ ID NO: 246972 - DNA, 535 bp, Homo sapiens
  misc_feature: GYAE6OF02F8OG1.9.70.G04.1.454.CMB.1.raw
  modified_base (414)..(414): a, c, t, g, unknown or other
  misc_feature (414)..(414): n is a, c, g, or t
  modified_base (451)..(451): a, c, t, g, unknown or other
  misc_feature (451)..(451): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggtagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtcccgccggcaagggactggagtatattggacgaatctatgccagtgggaccgccatctacaacccgtccctacaagagtcgagtcagcatgtcagtcgacacgtcccagaaccagttctccctgacagtgagttanatgaccgccgcacgacacggccgtgtattactgtcgngagagagcgttagtttagacctagactacgttaaaactcctactacggtctggacgtcgtcgggaccgagggaccgaggtaccg

SEQ ID NO: 246973 - DNA, 565 bp, Homo sapiens
  misc_feature: GYAE6OF02GD9FP.9.70.G04.1.454.CMB.1.raw
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgcatctacaacccgtcctcaagngtcgagtcagcatgtcagtccgacaccgtcccagaaccagttcctccctgacagtgagttatatcgacccgccgacacgacgaccggccgtgtacttacgtgtgcgagacgaggtccgtttagtttacgaccgtagtcgttaacgttaaaacctccgtaacgttaccggttacgtcgggtaccgttcggtcggggccgacggggacctaacggg

SEQ ID NO: 246974 - DNA, 548 bp, Homo sapiens
  misc_feature: GYAE6OF02ICRQK.9.70.G04.1.454.CMB.1.raw
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcagaggtggtcgttcctactggacctggatccggcagtcccgccggcaagggactgggatatagttggacgaatctatgccagtcgggaccncatctacaacccgtcctanaagcgtcgagtcagcatgtcngtcgacacgtacccagaaccacgttctccctgacagtgtagttatatcgaccgcgacacgacacggccgtagtacttacgtgtcgcgagagacggtacgtttagtttacgactagtacgtaacgttaaaactcctaacgtacgtcgtggacgtcgtcgggacgacgggacctaacgg

SEQ ID NO: 246975 - DNA, 615 bp, Homo sapiens
  misc_feature: GYAE6OF02JELJB.9.70.G04.1.454.CMB.1.raw
  modified_base (288)..(288): a, c, t, g, unknown or other
  misc_feature (288)..(288): n is a, c, g, or t
  modified_base (336)..(336): a, c, t, g, unknown or other
  misc_feature (336)..(336): n is a, c, g, or t
  modified_base (363)..(363): a, c, t, g, unknown or other
  misc_feature (363)..(363): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcacgtccgccggnaagggactggagtatagtggacgtaatctatcgcctaggtcgggaccnccatcctaaccacccggtcccacaagngtcgagtcagactatcgtacagtccgactacgtacccaacgaaccctagttcctcccgtagactacgtagtagttagtatacgaccgaccgacgacgaccgacggtccgtagttacttacgtcgtacggacgagacgtacggtacgtttagtttacgaccgtacgtacgttaacgttaaaaccgttccttaaccgttacggttacgttacggtacggttcggttacggggaccggtacgggacccgtaacgg

SEQ ID NO: 246976 - DNA, 626 bp, Homo sapiens
  misc_feature: GYAE6OF02F8RRR.9.70.G04.1.454.CMB.1.raw
  modified_base (233)..(233): a, c, t, g, unknown or other
  misc_feature (233)..(233): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctactggacctggactccggcacgtcccgccggcaagggctggagtatagttggaacgaatctatcgacctaggtcgggacctccattacctaaccacccgtccctacaagcgtacgagtcagctatcgtcagtcgacaccgtacccaacgaacctacgttcctcccgtagactagtagtacgttagtacgtacgaccgccgacacgaccgaccggtaccgtagttacgttacgtgtcgacgagacggtacggttaccgtttaagtttacggtaccgtacgtaacgtttaacgttaaaacctcccgttaaccgttacggtacgtacgggtaccgttacggtccgggtaccggtacgggtaccgtaaccggg

SEQ ID NO: 246977 - DNA, 557 bp, Homo sapiens
  misc_feature: GYAE6OF02GQPJI.9.70.G04.1.454.CMB.1.raw
  modified_base (353)..(353): a, c, t, g, unknown or other
  misc_feature (353)..(353): n is a, c, g, or t
  modified_base (390)..(390): a, c, t, g, unknown or other
  misc_feature (390)..(390): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctaccaacccgtcctcaagngtcgagtcagcatgtcagtcgacacgtcccagaaccngttcctccctgaccagttcgagttatagtcgacccgcgcagaccacggccgtagtacttacgtgtcgcgagagacggtacctttagtttacgactagcttaacgttaaacctccgttaacgtacggttacgtggtaccgtcggtcggggaccgacgggactaacggg

SEQ ID NO: 246978 - DNA, 622 bp, Homo sapiens
  misc_feature: GYAE6OF02HUV4J.9.70.G04.1.454.CMB.1.raw
  modified_base (243)..(243): a, c, t, g, unknown or other
  misc_feature (243)..(243): n is a, c, g, or t
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
  modified_base (502)..(502): a, c, t, g, unknown or other
  misc_feature (502)..(502): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcagnggtggtcttcctacgtcggacctggactccggcacggtccgccggacgaagggactggatatagttggaacgtaatctancgccgaggtcgggaccncatccaccaacccgtcctacaagcgtcgagtcagcaagtgtaccaggtcaaccgtaccgtacccgaacgtaaccctcggttaccctcccgtagaccgtagtagtagttactacgtcgaccgtccgacgaacgaccgtaccggtcgttacgttaactttacgngtacgacggtaagacggtacgtaccgttttaagttacggacctagtacgttaaacgttaaaccttcgttaaccgtacggtcgtacggtaccgtcggacggggccgtacggggactaacgg

SEQ ID NO: 246979 - DNA, 559 bp, Homo sapiens
  misc_feature: GYAE6OF02GXNH2.9.70.G04.1.454.CMB.1.raw
  modified_base (332)..(332): a, c, t, g, unknown or other
  misc_feature (332)..(332): n is a, c, g, or t
  modified_base (360)..(360): a, c, t, g, unknown or other
  misc_feature (360)..(360): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccgacaagggactggagtatagttggacgaatctatgccaggtcgggaccncatcctaaccaaccccgtccctacaagngtcgagtcagcatgtcagtccgacaccgtcccaagaacctagttcctccctgacagtgagttatactcgaccgccgcagacgacggcgtgtacttactgtgcgagagacgtcgttagtttacggaccagtacgttaacgttaaaacctccttaacgtacgtcgtacggtacgtcggtcgggaccgagggacctaacggg

SEQ ID NO: 246980 - DNA, 630 bp, Homo sapiens
  misc_feature: GYAE6OF02HBEC5.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctacgtggacctggactccggcacgtcccgccggacgaaggggactggagtatagttggaacgaatctatcgaccgaggtcgggaccgcatactaccaacccgtccctagaagcgtacgagtcagacagtcgcacgtccgaacaccgtcccaacggtaaccctacggtttccctaccccgtagtaaccgtaggttagtaacgtttaatacgttacggacccgtccgacgaacgaccgaccgggtcccgttagttacttacgtgtacgacgagacgtacggttactttagtttacgacgtagtacttaaaggttaaacctccgtaacgtacggtcgtcgggtaccgtacggtcggggaccgacgggacctaacggg

SEQ ID NO: 246981 - DNA, 545 bp, Homo sapiens
  misc_feature: GYAE6OF02G4Q2A.9.70.G04.1.454.CMB.1.raw
  modified_base (350)..(350): a, c, t, g, unknown or other
  misc_feature (350)..(350): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcatcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccgggcagtccgccggcaagggactggagtatagttggacgaatcgtatgccagtgggaccgccatctacaacccgtccncaacgagtcgagtcagcagtgtcagtcgacacgtcccagaaccagttcctccctgacagtgagttatatcgaccgccgcacgaccgacggtccgtagtatactgtcgcgagagacggtcgttatttacggactagtctaacgttaaactcctaacgtacgtacgtcggtacgtcggtcgggaccgtagggaaccg

SEQ ID NO: 246982 - DNA, 568 bp, Homo sapiens
  misc_feature: GYAE6OF02IP9ZW.9.70.G04.1.454.CMB.1.raw
  modified_base (234)..(234): a, c, t, g, unknown or other
  misc_feature (234)..(234): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (391)..(391): a, c, t, g, unknown or other
  misc_feature (391)..(391): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtnactccatcagaggtggtcgttcctactggacctggactccggcagtccgccggcaaggggctgggagtatagttggacgaatctatgccaggtcgggaccgccattccaccaaaccccgtccctanaaagngtcgagtcagcatgtcagtccgaacnccgtacccacgaaccacgttcctccctagacagtgtagttatatcgaccgccgacacgaccacggcgtgtacttacgtgtcgcgagagacggtacgttagtttagactagtactaagttaaaacctcctaacgttacggtactaggtacgttcgtcgggaccgaggggacctaacgg

SEQ ID NO: 246983 - DNA, 522 bp, Homo sapiens
  misc_feature: GYAE6OF02GT37Y.9.70.G04.1.454.CMB.1.raw
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgcggcaagggctggagtatattggacgaatctatgccagtgggaccncatctacaacccgtcctcaagngtcgagtcagcatgtcagtcgacacgtccagaccagttctccctgacagtgagttatatcgaccgcgcacgacacggcgtgtattactgtgcgagagagtcgttattagacagctaagttaaaactcctaacgtacgtctacggtacgtcgtacgggcgacgggacctaacgg

SEQ ID NO: 246984 - DNA, 550 bp, Homo sapiens
  misc_feature: GYAE6OF02GI6VX.9.70.G04.1.454.CMB.1.raw
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggaccctggatccggcagtccgccggcaagggattgggagtatattggacgaatctatgccagtgggaccnccatctacaacccgtccctcaagngtcgagtcagcatgtcagtcgacacgtcccagaacctacgttcctccctgacagtgagttatatcgacccgccgcacgacacgggccgtgtacttactgtgcgagagacggtcgtttagtttagtaccagtcgtaacgttaaaactccgtaactacggtctaggtaccgtcgtcgggccgtagggaccgtaacgg

SEQ ID NO: 246985 - DNA, 670 bp, Homo sapiens
  misc_feature: GYAE6OF02IIT8H.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgactccatcagaggtggtccgttctactggacctggactccggcacgtccgccggacaaggggactgggacgtatagttcgggaacgaattccgtagtcgccgtaaggtcggggaacccgcctaacgttcccgtaaccctaaacccccggttcccctacgaaaacggtacgtacggtaacggtccgaaggtcctaagttcggtaccacggttaccgaacctaccgtcccaacgtaaccctacgttcctaccctgaactacgtagtattatacgtcgaccgccgcgacgaccgacggtccgtagttacttactgtcggcgaaggagtacggtaccgtttacgtttacggacctagtacgtaacgtttaaaaccgttcttaaccgtacggttcgttacggtaccggtcggtacggggaccggtacggggaccgtaacgg

SEQ ID NO: 246986 - DNA, 595 bp, Homo sapiens
  misc_feature: GYAE6OF02HG9AB.9.70.G04.1.454.CMB.1.raw
  modified_base (332)..(332): a, c, t, g, unknown or other
  misc_feature (332)..(332): n is a, c, g, or t
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactcgtctctggtcgactccatcagaggtggtcgttcctactggacctggactccggcagtccgcggcaaggctggatatagttggacgaatctatcgccaggtcgggaccnccatcctaaccaacccgttccctanaagcgtcgagtcagtcagtcgtcacgcgaccacgtacccaacgaaccctagtttccctcccgtagtacgagtgtaagttatagtcgaccgccgcacgacaccggccgttagtacttcgtgtcgacgagtagtacggtacgtttagtttacggacgtagtaccgttaagttaaaaccttcctaacgttacggtcgttacggtacgtccggtacggggaccgtacggggtacctaacggg

SEQ ID NO: 246987 - DNA, 625 bp, Homo sapiens
  misc_feature: GYAE6OF02H402Z.9.70.G04.1.454.CMB.1.raw
  modified_base (246)..(246): a, c, t, g, unknown or other
  misc_feature (246)..(246): n is a, c, g, or t
  modified_base (346)..(346): a, c, t, g, unknown or other
  misc_feature (346)..(346): n is a, c, g, or t
  modified_base (372)..(372): a, c, t, g, unknown or other
  misc_feature (372)..(372): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctccatcgagnggtggttcgttcctacgtggacctgggactccggcaggtccgccggacaagggctggagtattagttggacgaattctagtcgaccgtaggtcgggaccnccgtatcctacctaacccgtccctanaaacgcgtcgagtcagaccagttcgtcaacggtccgacctaccgtacccaacggaacctacgtttccctacccgtgacctaggttcgtaacgtttacttatcggtaaccgccgtacacgaccgaaccggtcgttagttaacttacgtgtgacgagcggtacggtcgttagtttacgacctgtacgttaacgttaaacctccgttaacgttacgtcgtaggtacgtacggtcgggaccgaggggtacctaacgg

SEQ ID NO: 246988 - DNA, 559 bp, Homo sapiens
  misc_feature: GYAE6OF02IVI9A.9.70.G04.1.454.CMB.1.raw
  modified_base (330)..(330): a, c, t, g, unknown or other
  misc_feature (330)..(330): n is a, c, g, or t
  modified_base (378)..(378): a, c, t, g, unknown or other
  misc_feature (378)..(378): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctacgtggacctggactccggcagtccgcggcaagggctggatatagttggacgatctatgccaggtcgggaccncatcctaaccaacccgtccacaagcgtcgagtcagcatgcagtcgacnccgtaccagaacctcgtcctcctagacagtgtagttatagtcgaccgccgacacgaccacggtccgtgttacttacgtgtcgacgagaggtacggtcgttagtttacggactagtacgttaacgttaaacctcgtaacgtacgtcgtacggtacgtcggtcgggacgacgggacctaacgg

SEQ ID NO: 246989 - DNA, 596 bp, Homo sapiens
  misc_feature: GYAE6OF02G8YB4.9.70.G04.1.454.CMB.1.raw
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcagaggtggtcgttcctactcggacctggactccggcacgtcccgccggacaaggggctgggagtatagtggacgatctatgccagtggaccncatcctaccaacccgtcctacaagngtcgacgtcacgacatcgtcagtcgaactacgtacccacgaaccctacgtttccctccctagaccaggtagtaagttatacgtcgacccgtccgacacgaccgaccgggtccgtagttacttaccgtggtcgacgagtacggacggtaccgtttaagtttacggacctagacttaacgttaaacctccgtactacggtcgtacggtacgtcgtacggggaccgacgggacctaacgg

SEQ ID NO: 246990 - DNA, 656 bp, Homo sapiens
  misc_feature: GYAE6OF02HOD4I.9.70.G04.1.454.CMB.1.raw
  modified_base (172)..(172): a, c, t, g, unknown or other
  misc_feature (172)..(172): n is a, c, g, or t
  modified_base (378)..(378): a, c, t, g, unknown or other
  misc_feature (378)..(378): n is a, c, g, or t
  modified_base (407)..(407): a, c, t, g, unknown or other
  misc_feature (407)..(407): n is a, c, g, or t
  modified_base (439)..(439): a, c, t, g, unknown or other
  misc_feature (439)..(439): n is a, c, g, or t
  modified_base (537)..(537): a, c, t, g, unknown or other
  misc_feature (537)..(537): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatccctcctcctggtggcagctcccagatgggtcctgtcccaggtgcggctgcaggngtccgggcccaggactagtgaactccttcacgacggccctgtccctcacctgccactgtcctgtgggacacctccaatcgaggtaggttggttccttccctagtcgggacctgggactccggcacgtcccggaccggagaaacggggtcttgggaacttagttagttacgggaactaattactagtcgccgtaaggtcgggacccncctattaccaaccgaaccccgttcccaanaaaggtcgtcgaagtcaacgcagtggtaaccncgtacaactaccgtaccaacgaacctacgttacctcctagactagtagtagttatacgacgaccgcgacgagaccgtacggtcgttacgtacttacgngtacgacgtagacggtacgtaacgtttacgttacgaccgtagtaccgttaaacgttaaacctccgttaaccgtacgtacgtacggtcgtacgggtacgggacgtacgggaaccgtaacg

SEQ ID NO: 246991 - DNA, 586 bp, Homo sapiens
  misc_feature: GYAE6OF02IWV6D.9.70.G04.1.454.CMB.1.raw
  modified_base (233)..(233): a, c, t, g, unknown or other
  misc_feature (233)..(233): n is a, c, g, or t
  modified_base (334)..(334): a, c, t, g, unknown or other
  misc_feature (334)..(334): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctacgtggacctggactccggcagtcccgcggcaagggctggacgtatagttggacgaatctagtgccaggtcgggaccncatccgtaaccaacccgtcctacaagcgtcgagtcagcatgtacagtcgacacgtaccacgaacctacgtctcctgacagtagagttatatcgaccgccgacgacgacgacggcgttagttacttacgtcgtgacgagacgtacggtaccgtttaagttttacgaccgtagtacgttaaacgttaaaccttccgtaacgttaccggtcgtacggtacgtaccggtacggggaccgtacggggaacctaacgg

SEQ ID NO: 246992 - DNA, 585 bp, Homo sapiens
  misc_feature: GYAE6OF02IX0UN.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgctccatcagaggtggtcgttcctacgtggacctggactccggcacggtccgccggcgaagggctgggatagtagttggaacgaatcgtatcgccgaggtcgggaccgccaagtcctaaccaaccccgtccctacaagtacgtcgagtcagctaatgcagtccgactaccgtacccacgaacctacgttcctcccgtcgacgagtagtacgtatacgtcgaccgccgcacgaccacggtccgtgtattacgtgtcgacgagacggaggtaccgttagtttacgactagtcgtaattaaactccgtaacgtacgttcgtcggtacgtcggtcggaccggacgggacgtaacgg

SEQ ID NO: 246993 - DNA, 712 bp, Homo sapiens
  misc_feature: GYAE6OF02HXFY0.9.70.G04.1.454.CMB.1.raw
  modified_base (233)..(233): a, c, t, g, unknown or other
  misc_feature (233)..(233): n is a, c, g, or t
  modified_base (364)..(364): a, c, t, g, unknown or other
  misc_feature (364)..(364): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactcatcagaggtggtcttcctagtggacctggactccggcaggtcccgcggcgaagggctaggagtatagttaggacaattctagtcgacctaggtcgggaccgccagttaccaaccgaccccgtcctanaagacgttcgacgtcagctaagtcgtacgcgtacgaaccaccgtacccaacgaacccgtacgtttccctacccgtaggactacggtacgttagtttaacgtactacggtacccggccgtacgaacgtaccggaccgggtaccgttaggttaaacctttaccgttacggtcgtaacgggtaaggtaaccggggtaacggttacccgggtttttaaagttttaccgggaaccctacggtttaccgttaaacggtttaaaacccttccggttaaacccgttaacgggttccgttacgggtaaccggttccggtaccgggggtaaccgtaccgggggaaccttaacccgggg

SEQ ID NO: 246994 - DNA, 558 bp, Homo sapiens
  misc_feature: GYAE6OF02HR1IP.9.70.G04.1.454.CMB.1.raw
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccgacagtccgccggcaagggactggagtatagttggacgaatctatgccaggtgggaccgcatctaaccaacccgtcccncaagacgtcgagtcagcatgtcagtcgacacgtccagaacctagttcctcctgacagtgagttatatcgaccgcgcagacacggcgtgtattacgtgtgcgagagacggtaccgttttagtttacggaccaggtaccttaacgtttaaaacctcctaacgttacggtcgttaggaccgtcggtggggaccgaggggaccctaacggg

SEQ ID NO: 246995 - DNA, 576 bp, Homo sapiens
  misc_feature: GYAE6OF02IMTIS.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtccgccggcaaggggctggagtatagttggacgaatctatgccaggtggaccgccatcctacaacccgtccctacaagagtcgagtcagcatgtacagtcgacaccgtaccagaaccagttcctacctgacagtgtagttatatcgaccgccgacgagaccgacggccgtagtacttacgtgtcgcgagaggtacggtaccgtttaagttttacggacctagtacgttaacgttaaaaccttcctaacgttacggtcgtacggtacgttcggtcgggaccgacggggtacctaacggg

SEQ ID NO: 246996 - DNA, 646 bp, Homo sapiens
  misc_feature: GYAE6OF02I5QWY.9.70.G04.1.454.CMB.1.raw
  modified_base (279)..(279): a, c, t, g, unknown or other
  misc_feature (279)..(279): n is a, c, g, or t
  modified_base (334)..(334): a, c, t, g, unknown or other
  misc_feature (334)..(334): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtcgactccatcagaggtggtcgttcctactggacctggactccggcngtccgccggcaaggctggagtatagttggacaatctatcgaccaggtcgggaccnccatacctaccaacccgtccctacaagacgtcgagtacacgcaatcgtcacggtccgaacgtaccgtacccagaaaccctacgttaccctcccgttacgactaggtacgtaacgttactactacgtacccgaccgacgaacgtaccgaccgggtaccgttaggttacttaacgtgtcggacgaaggtaaggacggttaacgtttagtttaccggacctaggtaccttaaaggttaaaacccttcgttaaccgttacggttccgtacgggtaccgttacggtacggggacccggacgggtaacccgtaaccgg

SEQ ID NO: 246997 - DNA, 570 bp, Homo sapiens
  misc_feature: GYAE6OF02JGS1P.9.70.G04.1.454.CMB.1.raw
  modified_base (244)..(244): a, c, t, g, unknown or other
  misc_feature (244)..(244): n is a, c, g, or t
  modified_base (367)..(367): a, c, t, g, unknown or other
  misc_feature (367)..(367): n is a, c, g, or t
  modified_base (468)..(468): a, c, t, g, unknown or other
  misc_feature (468)..(468): n is a, c, g, or t
tcagtgatacgtctcacgaccggtgctcgatttagtgtagtgtgaagggaaagggccgtgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcngaggtggtcttcctactggacctggatccgggcagtccgccggcgaagggactggagtatattggaacgaactcgtatcggccaggtcgggaccgcatcctaccaacccgttcccacgaacgngtcgagtcagcatgtcagtcgacaccgtcccacgacctgttacctcctgactagtacgagttatacgtcgacccgcgcacgacgccggcgtagtacttcgngtcgacgagcgaggtccgtttagttacgactagtcgtaacgttaaactccgtaactacggtctacgggtacttacgggcgggtcggacgggtaccgtaacgg

SEQ ID NO: 246998 - DNA, 541 bp, Homo sapiens
  misc_feature: GYAE6OF02GF95C.9.70.G04.1.454.CMB.1.raw
  modified_base (233)..(233): a, c, t, g, unknown or other
  misc_feature (233)..(233): n is a, c, g, or t
  modified_base (328)..(328): a, c, t, g, unknown or other
  misc_feature (328)..(328): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctactggacctggatccggcagtccgcggcaagggctggagtatattggacgaatctatgccagtcgggaccncatctaccaacccgtcctcaagcgtcgagtcagcatgtcagtcgacacgtccagaaccagttctcctagacagtcgagttatatcgaccgccgacacgacaccggcgtgtacttacgtcgtgcgagagtacggtccgttagtttacggactagacgtaagttaaaactcctacgtacggtacgtcggacgtcgtcgggcacgggacctaacgg

SEQ ID NO: 246999 - DNA, 641 bp, Homo sapiens
  misc_feature: GYAE6OF02IXR9M.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtcccctcacctgcactgtctctggtgactccatcagaggtgtcgttcctactcggacctggactccggcacggtcccgcggacaacggggctagggagtattagttacgggaactaagtcctaagtgacccgtaggtcgggacccgtctaagtacccttaaccaaccccccgttcctagaaacgtcgtacgagtcagctagtcgtacgagtccgaactacccgtacccgacgaacctagttcccctccgtacgaccgtaggtagtaagttactaacgtcgacccgcgaccacgaccgaccggtcgtagttacgtttacgtgtacgacgagaggtacggtaccgtttaagtttacggacctagtacttaacgttaaaaccttctaacgtacgttcgtaggtccggtacgtacgggtccggacgggacctaacgg

SEQ ID NO: 247000 - DNA, 571 bp, Homo sapiens
  misc_feature: GYAE6OF02IDV45.9.70.G04.1.454.CMB.1.raw
  modified_base (233)..(233): a, c, t, g, unknown or other
  misc_feature (233)..(233): n is a, c, g, or t
  modified_base (330)..(330): a, c, t, g, unknown or other
  misc_feature (330)..(330): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcttcctactggacctggatccggcagtccgcggacaagggctggagtatagttggacgtaatctatcgccagtgggaccncatctacaacccgtcctnaagngtcgagtcagcatgtacagtcgacaccgtccacgaacctacgttcctccctagacacgtgagttatagtcgaccgcgacagacgacggcgtgtattactgtgcgagagtaggtaccgtttagtttacgacctagtacgttaacgttaaaaccttcctaacgttacggtacgttcggtaccggttcggtacggggacccgtacggggtacccgtaacggg

SEQ ID NO: 247001 - DNA, 568 bp, Homo sapiens
  misc_feature: GYAE6OF02GP0AN.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatagttggacgtaatctatgccaggtcgggaccgcatctaccaacccgtccctacaagcgtcgagtcagcatgtcagtccgacaccgtccacgaaccacgttcctccctagacagtgtagttatatacgaccgaccgcacgacgaccgggtccgtgtacttacgtgtcgcgagaggacggtaccgtttagtttacggaccagtcgtaacgttaaacctccgtaacgttacgtcgtacggacgtcgtcgggccggtagggaccgtaacgg

SEQ ID NO: 247002 - DNA, 535 bp, Homo sapiens
  misc_feature: GYAE6OF02HYOP9.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaaggggactggagtatagttggacgaatctatgcctaggtcgggaccgccatcctacaccccgtcctcaagagtcgagtcagcatgtcagtcgacacgtcccagaccagtctccctgacagtgagttatatcgaccgccgcacgacgacggccgtagtattacgtgtgcgagagaggccgttagtttagacagctagttaaactctacgtacgtcgtggtacgtcgtagggccgtacgggaccgtacgg

SEQ ID NO: 247003 - DNA, 603 bp, Homo sapiens
  misc_feature: GYAE6OF02HUXRC.9.70.G04.1.454.CMB.1.raw
  modified_base (343)..(343): a, c, t, g, unknown or other
  misc_feature (343)..(343): n is a, c, g, or t
  modified_base (487)..(487): a, c, t, g, unknown or other
  misc_feature (487)..(487): n is a, c, g, or t
  modified_base (560)..(560): a, c, t, g, unknown or other
  misc_feature (560)..(560): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcagaggtgtcttcctactggacctggactccggcacggtcccgccggacaaacgggactgggagtattagttggaacgtaattctatcgccgaggtcgggaccnctatcctaccaaccccgtcctacgaagacgtcgaagtcagcatcgtcagtcgacaccgtacccacgaaccctacgttcctccctgactagtacgtagttatatacgacccgccgaccacgaccaccggtcgttagttattacgngtacgacgagtaggacggtaccgtttaagtttacgactagtacgtaagttaaaacctcctaacgttaccggtntacgggtaccgtcggtacggggaccgtacggggacctaacggg

SEQ ID NO: 247004 - DNA, 531 bp, Homo sapiens
  misc_feature: GYAE6OF02IEXS3.9.70.G04.1.454.CMB.1.raw
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactcatcagaggtggtcgttcctatggacctggatccggcagtccgcggcaagggctggagtatagttggacgtaatctatcgccagtcgggaccnccatccacaacccgtccctanaagngtcagtcagcatgtcagtcgacacgtccagaaccacgttctccctgacagtgtagttatattcgaccgcgcacgacacggcgtgtattactgtgcgagagagtcgttatttagaccagtactagttaaaactcctaacgtacgtcgtggtacgtcgtcgggaccacgggactaacgg

SEQ ID NO: 247005 - DNA, 568 bp, Homo sapiens
  misc_feature: GYAE6OF02HM4QR.9.70.G04.1.454.CMB.1.raw
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtcccgccggcaagggctggatatagttggacaatctatgccaggtgggacccnccatcctaaccaaccccgtcccanaaagngtcgagtcagcatgtcagtcgacacgtcccagaaccacgttcctccctgacagtgaagttatatcgacccgccgacacgacaccggtcgtgtattactgtgcgagaggacggtacgtttagtttacggactagtacgttaacgttaaaacctccgtaacgttacggtacgtacggtacgttcgtcggggtaccgacgggacctaacgg

SEQ ID NO: 247006 - DNA, 569 bp, Homo sapiens
  misc_feature: GYAE6OF02IUP12.9.70.G04.1.454.CMB.1.raw
  modified_base (328)..(328): a, c, t, g, unknown or other
  misc_feature (328)..(328): n is a, c, g, or t
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgcggcaagggactggagtatagttggacgatctatgccagtcgggaccncatctacaacccgtcctacaagngtcgagtcagcatgtacagtcgacaccgtccagaaccagtcctccctgacagtgagttatagtcgaccgccgcacgacgaccggccgttagtacttacgtgtggacgagagaggtaccgtttagtttacggacctagtacgttaacgttaaaaccttccgtaacgttaccggttacgtacggtacggtcggtacgggaccgacggggtacctaacggg

SEQ ID NO: 247007 - DNA, 551 bp, Homo sapiens
  misc_feature: GYAE6OF02FLPQE.9.70.G04.1.454.CMB.1.raw
  modified_base (353)..(353): a, c, t, g, unknown or other
  misc_feature (353)..(353): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggactggagtatagttggacgaatctatgccagtgggaccgccatctacaacccgtccctcaagngtcgagtcagcatgtcagtcgacacgtcccagaaccagttcctcccgtgacagtgagttatatgaccgccgcagaccacggccgtgtacttacgtgtgcgaagagaggtccgtttagtttacggaccagtcgtaagttaaaacctcctaacgttacggtcgtacggtacgttcggtggggccgaggggacctaacggg

SEQ ID NO: 247008 - DNA, 647 bp, Homo sapiens
  misc_feature: GYAE6OF02F5JMW.9.70.G04.1.454.CMB.1.raw
  modified_base (333)..(333): a, c, t, g, unknown or other
  misc_feature (333)..(333): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcgagaggtgtcgttcctactggacctggactccggcagtccgcggcaagggctggagtatattcggactaatctaagtcgctagtcgggaccnctactcaccgacccgtccacgaacgcgtacgagtcagctatcgtcgagtccgactccgtaccgaacgtacctacgttccgtaccgtacgtacgtacggttacgtaacgttatacgtcgaacccgtccgacgacgtaccgtacggtccgttagttacgttaccgtgtcgtacggtagtacgtacggttaccgtttaacgttttacggaccgttaggtacgtttaacggttaaaaccttccgttaaccgttaccggttacgttacgggtaccgttccgggttacgggtacccggtacggggtaacccttaacgggg

SEQ ID NO: 247009 - DNA, 691 bp, Homo sapiens
  misc_feature: GYAE6OF02G4H84.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccatatgggtcctgtcccaggtgcggctgcaggagtcgggccatgactagtgaagccttcacacggccctgtccctcacctgcactgtctctggtgactccatcaggaggtggttccgttcctacgtcggacctggacgtcccggcacgtccggccggcgaagggactgggagttagtagttgggaacgtaatctagtcggaccgtagggtcgggacccgacctatccgtaaccctaccccgtccctacgaacgtacgtcgacgtcagctacgttgacgacgtaccgacacccgtacccaacgtaacccgtcgtttccctacccgtagaaccgtaggttgtaacggtttactacgtaccggtaacccgccgtacgaccggaaccggaccgggttcccgttagttacgtttaccgttggtacggacggtaagggacgttacggttaccggttttagttacgggacctacggtacttaaacgttaaaacctcccgttaacgttacggttacgtacgggtaccgttaccgggacgggtacccggtacggggtaacccg

SEQ ID NO: 247010 - DNA, 552 bp, Homo sapiens
  misc_feature: GYAE6OF02H3WF0.9.70.G04.1.454.CMB.1.raw
  modified_base (233)..(233): a, c, t, g, unknown or other
  misc_feature (233)..(233): n is a, c, g, or t
  modified_base (328)..(328): a, c, t, g, unknown or other
  misc_feature (328)..(328): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactcatcaggaggtggtcgttcctactggacctggatccggcagtccgccggcaagggctggatatagtggacgatctatgcctaggtcggaccncatctacgaacccgtccacaagagtcgagtcagcatcgtcacgtcgaaccaccgtacccagaaccacgttctccctagactagtgagttatatcgaccgcgacagacacggccgtagtacttacgtgtgcgagtaggaggtaccgtttagtttacgaccgagtacgtagttaaacctcctaactacgttcgtacggacggtcgtcgggccacggggactaacgg

SEQ ID NO: 247011 - DNA, 535 bp, Homo sapiens
  misc_feature: GYAE6OF02HB8EL.9.70.G04.1.454.CMB.1.raw
  modified_base (330)..(330): a, c, t, g, unknown or other
  misc_feature (330)..(330): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatagttggacgaatctatgccagtcgggaccnccatctacaacccgtcctacaagcgtcgagtcagcatgtcagtcgacacgtccagaacctagttcctcctagacagtgagttatatcgaccgccgacacgaccacggtcgtagtacttacgtgtgcgagagacggtcgttagttacgactagtacgtacttaaactctacgtacgtcgtaggacgtcgtcgggcgagggacacgg

SEQ ID NO: 247012 - DNA, 552 bp, Homo sapiens
  misc_feature: GYAE6OF02HOYOX.9.70.G04.1.454.CMB.1.raw
  modified_base (353)..(353): a, c, t, g, unknown or other
  misc_feature (353)..(353): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccgccatctacaacccgtccctcaagngtcgagtcagcatgtcagtcacaccgtcccagaccagttctccctgacagtgtagttatattcgaccgcgacgagacgacggccgtgtattactgtgcgagaggacggtaccgtttagtttacggacctagtacgtaacgttaaaacctcctaacgtacggtcgtcggacgttcgtcggggccgtagggaccgtaacgg

SEQ ID NO: 247013 - DNA, 834 bp, Homo sapiens
  misc_feature: GYAE6OF02HX83N.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtggcagctcccagatgggtcctgtcccaggtgcggctgcaggagtcgggccaggactagtgaagccttcacacggccctgtcccctcacctgccactcgtctcgtggtcacctcatcagaggtcggtcttcctacgtggacctggactccggctacggtcccgccggacgaaacggggtacgtaggtagtaagttacggttacgggaacgtaaacttcgtagtcgccgtaagggtcgggaacccgtccacgttaccctaacccgtaaacccccgttcccctaacgaaacggtacggtaccggtaacgtccgaacggctaaggttccgtaccgtaaccgggttcccgaaaccgtaaccccggttaccccgtaaacggtaaaaccccgtaccggttttcccctaccccgtacggtaacccgtaagggttacgttaacgttttaaacgttaacgtacccgggaaccccgtcccgtaaccgaaccggtaacccggaaccgggttccgttaaggtttaacgtttacgtacggtaccggacggtaacggtaaccgggtaacggtttaccggttttaagttttaaccggaccgttacggttaaccgttaaacggtttaaaacccttcccggttaacgttaacccgggttcggttaacgggtaccgggttaccggtcgggggtaaccccggtacgggggtaacccgtaacccggg

SEQ ID NO: 247014 - DNA, 667 bp, Homo sapiens
  misc_feature: GYAE6OF02JNPR5.9.70.G04.1.454.CMB.1.raw
  modified_base (200)..(200): a, c, t, g, unknown or other
  misc_feature (200)..(200): n is a, c, g, or t
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (362)..(362): a, c, t, g, unknown or other
  misc_feature (362)..(362): n is a, c, g, or t
tcagtgatacgtctcacgaccggtgctcgatttagtgtagtgtgaagggaaagggccgtgtgaaggcttcactagtcctggacctcctgtgcaagaacatgaaacatctgtggttcatcctcctcctggtggcagctcccagatgggtcctgtcccaggtgcggctgcaggagtcgggcccagggactagtgaagccttnacaggccctgtccctcacctgcactgtctctggtgactccatcagagtgtcgtcctacgnggacctggactccggcagtccgccggnaaggggctgggatntagtagacgtaatcttagngacctaggtgggacccnctaatcctaactaaccccgtcctanaaacggcgttacgagtccaaggcctagtcgtcgaacggttccgaacgtcccgtacccacgaacctacgttcctacccgtcgtacgtaacgtcggtaagttaagtacgttacgacccgtaccggtacaacgtaccgaccggcgttacggttacttacgtggtacgtaccggaagtaacggtacggttaccgtttacgttttaaccgggactacgtacgtttaacgttaaaaccttccgtaaccgttacgttccgtacggtaccggttaccggtacgggtacccggtaccgggtacccgtaaccggg

SEQ ID NO: 247015 - DNA, 579 bp, Homo sapiens
  misc_feature: GYAE6OF02F4FKM.9.70.G04.1.454.CMB.1.raw
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccgacagtccgcggcaagggctggagtatattggacgaatctatgccagtgggaccncatctaccaacccgtccctnaagngtcgagtcagcatgtcagtcgacncgtcccaagaaccagttcctcctgacagtgtacgttatagtcgaccgccgacgacgaccgaccggtcgttagttacttacgtgtcgacgaggaagacggttaccgtttagtttacggacgtagtacgttaaagttaaaccttccgtaacgttacggttcgtacggtaccggttcggtacgggaccggtacggggacctaacggg

SEQ ID NO: 247016 - DNA, 574 bp, Homo sapiens
  misc_feature: GYAE6OF02IQBNT.9.70.G04.1.454.CMB.1.raw
  modified_base (330)..(330): a, c, t, g, unknown or other
  misc_feature (330)..(330): n is a, c, g, or t
  modified_base (444)..(444): a, c, t, g, unknown or other
  misc_feature (444)..(444): n is a, c, g, or t
tcagtgatacgtctcacgaccggtgctcgatttagtgtagtgtgaagggaaagggccgtgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacaatctatgccagtcgggaccnccagtcctaccaacccgtccctacaacgagtcgaagtcagcagtgtcaagtcgactaccgtacccacgaacctacgtactcctacgacgtagtcgaagttagtatcgaccgccncacgacgaccgccgtagtacttacgtgtcgcgagacgacgtacgtttagttacgactaacgtcgttaagttaaaacctctaacgtacggtactacggacgttccgtcgggaccgtacgggaccgtaacgg

SEQ ID NO: 247017 - DNA, 847 bp, Homo sapiens
  misc_feature: GYAE6OF02IL7AB.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatcgggtcctgtccaggtgcggctgcaggaggtccgggcccgaaggactagaggaactctacacgcggcctcgtaccctcaccgtgactacgttcgtccttcgtggtacacctacactcgaaggtcggttcggttaccttaccgtaagtcggaccgttaggaccgtaccggcgtacggtcccggaccgggtaacggaaacgggtcgtagggtaacgttaagttaacggttacgggaaaacttaacttcgttaacgaccggtacccggtaaggggtaccggggaaccccgtaccttaacgttaccgtaaaaccccgaacccccgttacccgtaaagtaacgggtaccgtacggtaacgtaacgacgtacgtaacgttccggtaacgtaccgttaccgaaccctaacccgtaacccgaaacggtaaaccttaccgtttaccccgtaaccgtaggtaaaccttaggtaaccgttaagttaaataccgtaaccggaccccgtacgaaccaacggtaaccggtaccgggttacgtaagtttaacttaacggtcgtaaggtaaccggaaggtaacgggtaccgttaacggttttaagttaaccggacgtaacgttaaccgtttaaaaacgtaaacccgttaccgtaacggttaaccggtagtacggttaccggtcggtaccgggaaccggtaaccgggtaaccgtaaccggg

SEQ ID NO: 247018 - DNA, 559 bp, Homo sapiens
  misc_feature: GYAE6OF02GF3FW.9.70.G04.1.454.CMB.1.raw
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactgggagtatattggacgaatctatgccagtgggacccgccatctaccaacccgtccctcaagngtcgagtcagcatgtcagtcacncgtcccagaaccagttctccctgacagtgagttatatgacccgccgcagacacggccgtgtacttacgtgtgcgagagacggtcgttagtttacggaccagtacttaacgttaaaaccttccttaacgttaccggttcgttacggacgttccgtacgggccggacggggacctaaccggg

SEQ ID NO: 247019 - DNA, 551 bp, Homo sapiens
  misc_feature: GYAE6OF02JIMUL.9.70.G04.1.454.CMB.1.raw
  modified_base (353)..(353): a, c, t, g, unknown or other
  misc_feature (353)..(353): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggaatggagtatagttggacgaatctatgccaggtgggaccgccatctaccaacccgtccctanaagagtcgagtcagcatgtcagtccgacaccgtcccagaaccagttcctccctgacagtgtagttatactgaccgccgcacgacgacggccgtagttacttacgtgtgcgagagacggtccgttagtttacgactagcttaagttaaacctcctaacgtacgtctacggtacgtcggtcgggccgagggacctaacgg

SEQ ID NO: 247020 - DNA, 688 bp, Homo sapiens
  misc_feature: GYAE6OF02I55JW.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccaggactagtgaagccttcacaggccctgtccctcacctgctactgtctcgtggtgactccatcagaggtggtcgttcctacgtcggaccgtggacgtccggcacgtccgccggcaagggctggagtatagttcggacgaatctagtcgacctaggtcgggaccctaccattacctaacctaaccccgtccctacaaggtaccgtcgaacgttacacgctaagtcgtactacggttaccgaacctaccggttccccaaagtaacccctagtttcccctacccgttagaccgtaacggttggttaacgtttaactacggttaccggaaccccggtccggacgaacggtaccggtaaccggtaccgttaaggtttaaccttacgtggtacgacggacggtaaggtaccggtttacgtttaagtttacggacctacgtacgttaaacgttaaacctcctaaaccgttacgtaggtacgaccggttagtcggggaccgtacgggtacctaacgg

SEQ ID NO: 247021 - DNA, 598 bp, Homo sapiens
  misc_feature: GYAE6OF02IGCAM.9.70.G04.1.454.CMB.1.raw
  modified_base (233)..(233): a, c, t, g, unknown or other
  misc_feature (233)..(233): n is a, c, g, or t
  modified_base (355)..(355): a, c, t, g, unknown or other
  misc_feature (355)..(355): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctactggacctggatccggcagtccgccggcaagggctggagtatagttggacgaatctatgcctaggtcgggaccgccatctaaccaacccgttccctanaagcgtcgagtcagcatgtcagtcgacaccgtacccagaacctcgttacctccctgacgagtgagtttatatcgaccgccgacacgacaccggtccgttgtacgttacgtgttcgacggtagagtacggtaccgtttaagttttacggacctacggtacgttaacgtttaaaaccctaccgttaaccgttacgtcgtacggtaccggttcgtacgggggaccgtacggggtaccgtaaccggg

SEQ ID NO: 247022 - DNA, 580 bp, Homo sapiens
  misc_feature: GYAE6OF02HWLDM.9.70.G04.1.454.CMB.1.raw
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtcccgccggcaagggactggagtatagttggacgaatctatgccagtgggaccgccatctaaccaacccgtcctacgaagngtcgagtcagcatcgtacagtccgacaccgtcccacgaaccacgttcctccctgacaggtcgtagttactagttcgacccgccgacacgaccacggccgtagtacttactgtgcgagacggacggtccgtttagtttacgaccgtagtacgttaacgttaaaacctccgttaacgttacgtacgtacggtacgtcgtcggggaccgtacggggaccgtaacgg

SEQ ID NO: 247023 - DNA, 721 bp, Homo sapiens
  misc_feature: GYAE6OF02G2CIB.9.70.G04.1.454.CMB.1.raw
  modified_base (239)..(239): a, c, t, g, unknown or other
  misc_feature (239)..(239): n is a, c, g, or t
tcagtgatacgtctcacgaccggtgctcgatttagtgtagtgtgaagggaaagggccgtgtgaaggcttcactagtcctggacctcctgtgcaagaacatagaaacatctgtggttcatcctcctcctggtggcagctcccagatgggtcctgtcccaggtgcggctgcaggagtcgggcccagggactagtgaagccttcacaggccctgtccctcacctgcacgtgtctcgtgggtnactccatcaggagggttcggttccgtttcctacgtcggtaccctagggcttcccggctacggtccccgccggacgaacggggtactgggtaaacgttataagttgggaaactaagttaccgtagtcgaccgtaggtcggggacccaccttaagtacccgttaaacccaacccccgttccccgtaacgtaaaagtacgggttaccgaaaggttccaaggacctaaggtttccgaacgacggttaccaaccgtaacccgtacccgaacgaaacccgtacgttaccctacccgtacgactacgtaggtacgttattacgtacgaccgtccgacgacgaacgaccggaccgttacgtacgttagttgtacgacgagaacgacggtacgttaacgtttacgacgtacgtacgtaacgttaaaacctactaaccgttacgttacgtacgtacggtacgtacgggaccggtacggggaacgtaaccggg

SEQ ID NO: 247024 - DNA, 503 bp, Homo sapiens
  misc_feature: GYAE6OF02F36SE.9.70.G04.1.454.CMB.1.raw
  modified_base (300)..(300): a, c, t, g, unknown or other
  misc_feature (300)..(300): n is a, c, g, or t
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
  modified_base (442)..(442): a, c, t, g, unknown or other
  misc_feature (442)..(442): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtccgcggcaagggctggatatntggacaatctatgcagtggaccncatcacacccgtcctcaagngtcgagtcagcatgtcagtcgacacgtccagaccagtctcctgacagtgagttatatcgaccgcgacagacacggccgtgtacttacgtgtgcgagagngtcgttattagacagtctagtaaactcctactacgtctcgcgtcgtgggcgaggactacgg

SEQ ID NO: 247025 - DNA, 586 bp, Homo sapiens
  misc_feature: GYAE6OF02GYY0H.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactgggagtatagttggacgaatctagtgccagtgggacccgccatcctaccaaccccgtccctacaagagtcgagtcagcatgcagtccgacacgtcccagaaccagttcctccctgacagtgagttatatcgacccgccgcagaccacggccgtgtacttacgtgtgaccgaggaacggtacggtaccgtttagtttacgggtaccgagtaccttaagttaaaaccttccgtaacgttaccggttactacgggtaacgttccggtacggggaccgtacggggaccctaacggg

SEQ ID NO: 247026 - DNA, 573 bp, Homo sapiens
  misc_feature: GYAE6OF02HV98H.9.70.G04.1.454.CMB.1.raw
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcaggaggtggtcgttcctactggacctggactccggcacgtcccgccggacaagggactggatatagtggacaatctatgccaggtcggaccnccatctacaacccgtcctanaagngtcgagtcaagcatgcagtcgacaccgtaccacgaacctacgttcctccctgacgagtagtagttatagtcgaccgccgcaacgacgacggccgtgttaacttacgtgtcgacgagaggacggtaccgtttagtttacgacctagtcgtaacgtttaaaactccgtaacgtacggtcgtacggacgttcgtcggggtaccgacggggtactaacgg

SEQ ID NO: 247027 - DNA, 634 bp, Homo sapiens
  misc_feature: GYAE6OF02JK6UK.9.70.G04.1.454.CMB.1.raw
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
tcagtgatacgtctcacgaccggtgctcgatttagtgtagtgtgaagggaaagggaccgtgtgaaggcttcactagtcctggacctcctgtgcaagaacatgaaacatctgtggttcatcctcctcctggtggcagccccagactgggtcctgtcccaggtgcggctgcaggagtcgggcccaggactagtgaagccttcacaggccctgtccctcacctgcactgtctctggtcgactccatcagaggtggtcgttcctactcggacctggactccggctacgtcccgccggacgaagggcctgggagtatgttggacgtaatctatcgcgagtcgggaccnccatctacacccgtcccnaagngtcgatcngcatgtcagtcgacacgtccacgaacctacgttcacccagacagtagtagttaactagttaccgaccgccgtacacgtaccgaccggtaccgtgttaacttaccgttgtacgtaccggaagtacgaaccgggttccgttttaagttttaccgggaacctaggtacgttaacggtttaaaaacctccttaaaccgttacgggtaccgttacggtaaccgtcggttaccggggacccgtaacggggacccgtaagggtacccg

SEQ ID NO: 247028 - DNA, 643 bp, Homo sapiens
  misc_feature: GYAE6OF02GHQP8.9.70.G04.1.454.CMB.1.raw
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
  modified_base (354)..(354): a, c, t, g, unknown or other
  misc_feature (354)..(354): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcactggccctgtccctcacctgcactgtctctggtnactccatcagaggtgtcgttcctactggacctggacttccggcagtccgccggcaagggctggagtatagttcggacgaatctancgacaggtcggaccgcatctaccaacccgtccctanaagcgtacgacgtacagctagtgtcagtaccgactaccgtacccacgaacctacgttcctccctagactacggtgtaacgtttatacgtacggaccccgccgtcgaaccggaacgccgggtaccgtacgttaacgttacgtggtcgtaccggtagtacgacgggttacctttaagtttaccggacgtacgtacgttaaacgtttaaaaccctccgttaaccgttaccggttacgtacggtaaccggttccgggtacgggggtacccgtaacgggggaccctaaccgggg

SEQ ID NO: 247029 - DNA, 556 bp, Homo sapiens
  misc_feature: GYAE6OF02IQ5F7.9.70.G04.1.454.CMB.1.raw
  modified_base (213)..(213): a, c, t, g, unknown or other
  misc_feature (213)..(213): n is a, c, g, or t
  modified_base (327)..(327): a, c, t, g, unknown or other
  misc_feature (327)..(327): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggccaggactagtgaagccttcacaggccctgtccctnacctgcactgtctctggtcactccatcagaggtggtcgttcctactggacctggatccggcagtccgccggcaagggactggagtatattggacaatctaatgccagtggaccncatcacaacccgtccncaagngtcgagtcagcatgcagtccgacacgtccagaaccagttcctccctgacacgtagagttatactcgaccgccgcacgacacggcgtgtattacgtgtcgcgagagacggtaccgttatttacggactagtacgttaacgttaaaacctccttaacgtaccggttcgttacggaccgttcgtcggggaccgtacggggaccgtaacggg

SEQ ID NO: 247030 - DNA, 693 bp, Homo sapiens
  misc_feature: GYAE6OF02G7DFU.9.70.G04.1.454.CMB.1.raw
  modified_base (345)..(345): a, c, t, g, unknown or other
  misc_feature (345)..(345): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtcactccatcagtaggtcggtcgttcctactggacctggactccggcacgtcccggccggcgaagggactggagtatagttcggaacgaatctagtcgccgaggtcgggaccnccaatcctaaccgaaccccgttccctacaagacgtacgagtcaagcaagtcgtacgaagtccgaaccgtaccgtacccaacgaaccctagttaccctcccgtagactagtagtagtttactacgtacggaccccgtccgacgaacgaaccgaccgggtaccgttagttacgtttacgtgttacggacggtaaggaacgggtacggttaaccgttttaagttttaaccgggaccgtacggttaaccgtttaaacggttaaaaaccctttcccgttaacggttaccggttacgttacgggtaccgttcgggtaccggggtacccggaacggggtaacccttaacccgggg

SEQ ID NO: 247031 - DNA, 591 bp, Homo sapiens
  misc_feature: GYAE6OF02FX6FW.9.70.G04.1.454.CMB.1.raw
  modified_base (232)..(232): a, c, t, g, unknown or other
  misc_feature (232)..(232): n is a, c, g, or t
  modified_base (334)..(334): a, c, t, g, unknown or other
  misc_feature (334)..(334): n is a, c, g, or t
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggccaggactagtgaagccttcacaggccctgtccctcacctgcactgtctctggtnactccatcagaggtggtcgttcctactggacctggactccggcagtccgccggcaagggctgggagtatagttggacaatctatcggccaggtcgggacccncatcctaaccaacccgtccctanaagcgtcgagtcacgcatcgtacagtccgactacgtacccaacgaacctacgttcctccctagactacgtcgtaacgttatacgtcgaccgccgacacgaccgaccggtcgttagtaacttcgtgtacgcgagtacgacggtcgtttagttacggactacgtacgttaacgttaaaccttccgtaacgtacggtcgtacggtacgttcgcggggaccggtacgggacctaacgg

SEQ ID NO: 247032 - DNA, 532 bp, Homo sapiens
  misc_feature: GYAE6OF02IEX1G.9.70.G04.1.454.CMB.1.raw
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (399)..(399): a, c, t, g, unknown or other
  misc_feature (399)..(399): n is a, c, g, or t
  modified_base (450)..(450): a, c, t, g, unknown or other
  misc_feature (450)..(450): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcaggtccgccggcaagggctggagtatattggacgaatctatgccagtggaccncatctacaacccgtccctnaagagtcgagtcagcatgtcagtcacacgtccagaaccagttctccctgacngtgagttatatcgaccgccgacacgacacggccgtgtattactgtgcgagngacgtcgttagtttagactagtacgtacgttaaactcctacgtacgtctaggtacgtcgtcgggacgtacgggacctaacgg

SEQ ID NO: 247033 - DNA, 549 bp, Homo sapiens
  misc_feature: GYAE6OF02I40HR.9.70.G04.1.454.CMB.1.raw
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
  modified_base (455)..(455): a, c, t, g, unknown or other
  misc_feature (455)..(455): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcttcctactggacctggactccggcagtccgcggcaagggctgggagtatagttggacgaatctatgccagtgggaccncatcctacaacccgtccctacaagngtcgagtcagcatgcagtcgacaccgtcccagaacctagttcctcctgacagtgtagttatattcgaccgccgcgacgaccacggtccgtagtacttacgngtgcgagagaggtccgttagtttacggactaggcttaagttaaacctctaacctcgttacgtcggtacgtcggtgggccggacgggactaacgg

SEQ ID NO: 247034 - DNA, 521 bp, Homo sapiens
  misc_feature: GYAE6OF02FFZXD.9.70.G04.1.454.CMB.1.raw
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggatatattggacaatctatgccaggtgggaccgccatcctacaaccccgtcctcaagngtcgagtcagcatgtcagtcgacaccgtccagaaccagttcctccctgacagtgagttatatcgaccgcgcagacacggccgtgtattactgtgcgagagaggtccgttatttaggcagctagtaaactcctaactacgtctggacgtcgtgggccagggacctaacgg

SEQ ID NO: 247035 - DNA, 630 bp, Homo sapiens
  misc_feature: GYAE6OF02H943L.9.70.G04.1.454.CMB.1.raw
  modified_base (200)..(200): a, c, t, g, unknown or other
  misc_feature (200)..(200): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
  modified_base (321)..(321): a, c, t, g, unknown or other
  misc_feature (321)..(321): n is a, c, g, or t
  modified_base (332)..(332): a, c, t, g, unknown or other
  misc_feature (332)..(332): n is a, c, g, or t
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggccaggactagtgaagccttcacncggccctgtccctcaccctgcactgtctctggtnactcatcagnggtgtcgttccacgtggacctggatccggnacgtccggccgcgaaggctggcgtaattagtggacaatctactgccnggtcgggaccncacgttcctaaccgacccgtcctanaacggtacgttgacgtacagaccatcgtccgagtccggaactacccgtaccacgaaacctacgttccgtcccctgaaccgtagtacggtaagtttactagtccgacccgtacgaccgaacgtaaccgaccggtcgtacgttaacttacgtcgtgacgacgaggtacggttacgtttagtttacgaccgtagtacgttaacgttaaaaccgttcctaaccgttacgttcgttacgggacggttccggacggggaccggtacgggactaaccggg

SEQ ID NO: 247036 - DNA, 649 bp, Homo sapiens
  misc_feature: GYAE6OF02IL65V.9.70.G04.1.454.CMB.1.raw
  modified_base (334)..(334): a, c, t, g, unknown or other
  misc_feature (334)..(334): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggactccggcagtccgccggcaaaggggcctggatatagttggacgaatctatcgcctagtcgggaccnccatcctaacaaccccgtccctacaagtacgtacgagtacacgcaagtcgtacgagtaccgacaccgtcccgaacgtaaccgtacgttcctccctacgactaggtacgtagttatagtacgaccgccgacgacgacgaccggtccgtagttaacttacgtcgtcgtaccgagacggtacggtaccgtttaacgtttaacggaccgtaacggtaccgttaaacgttaaaaacccgttccgttaaaccgttaccggttaccgttcggggtacccggttacggtccgggggaaccggtacgggtaacccgtaaccggg

SEQ ID NO: 247037 - DNA, 605 bp, Homo sapiens
  misc_feature: GYAE6OF02HJ18I.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgcggcaagggctggatatattggactaatctatgccaggtcgggaccgccatctaaccaaccccgtcctcaagagtcgagtcagcatgcagtcgacacgtaccagaaccctgttcctcccgtagaccgtagttacgtaagtttactacgttcgacccgccgaccgaagaccgaccgggtccgttacgtactttacgtgtcgacggagaggtacggtccgtttaagtttacggaccgtagtacgttaaacgttaaaaccttcctaacgttaccggtcgttacggtaccgttcggtacgggggtaccgtacggggaccgtaaccggg

SEQ ID NO: 247038 - DNA, 673 bp, Homo sapiens
  misc_feature: GYAE6OF02JSR70.9.70.G04.1.454.CMB.1.raw
  modified_base (416)..(416): a, c, t, g, unknown or other
  misc_feature (416)..(416): n is a, c, g, or t
tcagtgatacgtctcacgaccggtgctcgatttagtgtagtgtgaagggaagggccgtgtgaaggcttcactagtcctggacctcctgtgcaagaacatgaaacatctgtggttcatcctctcctggtggcagctcccagatgggtccttgtcccaggtgcggtctgcaggagtcggccaggactagtgaagccttcacgaggccctggtccctcacctgacacttgcttcgtggtagaccttccgatcaggtaggttcggtccgttcctaacgttcgggacctgggatccggcagttcccgacggcaaagggctcggagtattacgttggacggaattcctaagtcgccgaggtcgggacctccgatctaaccgacccgtcctacgaagtcgtccgagtcaagtcaagttcgacngtacgacctacgtaccaacgaccgtacgttccgtccctagacgagtacgtacgttagttagacgtaccgaccgtacgacgtacacggtcgtactaagttccgtagttcggacggtacgaggtacggtacgtttacgtttaacggaccgtacggtaccgttaacggttaaaaaccttccgttaaaccggtaaccggttaaccgttcggtaacccgttacgggtacggtacccgggtaacggggtacccgtaaaccggg

SEQ ID NO: 247039 - DNA, 626 bp, Homo sapiens
  misc_feature: GYAE6OF02J108G.9.70.G04.1.454.CMB.1.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (368)..(368): a, c, t, g, unknown or other
  misc_feature (368)..(368): n is a, c, g, or t
  modified_base (470)..(470): a, c, t, g, unknown or other
  misc_feature (470)..(470): n is a, c, g, or t
  modified_base (523)..(523): a, c, t, g, unknown or other
  misc_feature (523)..(523): n is a, c, g, or t
  modified_base (612)..(612): a, c, t, g, unknown or other
  misc_feature (612)..(612): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcccctgtcccctcacctgcaccttgtctcgtggtnaccttccatcagnggttcggtacttcctactggacctggactccggctagtcccggccggacgaacggggcttgggaattagtaattgggaaccgaattccgtatcgaccgtaggtcgggacccgcctanccttaaccaaccccgtccctagaacgtcgtcgagtcaagccaagtcgtcagtaccgcaccgtaccaggaaccctagttcctccctgacctagtgaccgttanacttcggacccgtcgaccagacccgacggtccgtagttacttaccgtgtacgngtaacgcgtacggtacgtttagttagacccagttactaacggttaaacctccgtaacgttacggcgttacggacgtccgtgggtaccgngggtaaccctacgg

SEQ ID NO: 247040 - DNA, 677 bp, Homo sapiens
  misc_feature: GYAE6OF02H9R8P.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggcctgtccctcacctgcactgtctctggtcgactccatcgagaggtcggtcgttcctactacggacgtcggacgtccggcgagtccgccggacgaaggacgtggagtattacgttaggacgaatctagtgccagtagggaccgaccactactaccgaacccgtaccctcaaagtacgtacgtacgtcacgctaactgtcagtccgaaccgtaccgtacccgaaacaacccgtaacgtttccgtaccccttcgtacgagtacggtagttacttaacgtcgtacccgaccggtaccacgaaccgtaccggccggttagttacttaccgttggacggtacgtaagtacgggtacggtaccggttttaacgtttacggtaccgtacgtaacgtaacgtttaaaaccgttaccttaaccgtacggttccggttacggtacggttccggtacggggtaccgaccgggggtactaacccggg

SEQ ID NO: 247041 - DNA, 600 bp, Homo sapiens
  misc_feature: GYAE6OF02I6W5U.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgacctccatcagaggtcgtcgttcctactggacctggactccggcacgtccgccggcaacggggactgggagttatagttagggacgtaatctatcgccaagtcgggaccgccatctaaccaacccgtcctacaacgacgtcgagtcagcatgtcagtccgacacgtccacgaacctagttacctcctagacagtagagttatattcgaccgtccgacacgacgaccggtcgtgtacttacgtgtcgcgtagtaggacggtaccgtttagtttacggacctacgtacttaacgttaaaacctccgttaaccgtaccggttacgtacgggtaccgttaccggtcggggaccgacgggtaccgtaacggg

SEQ ID NO: 247042 - DNA, 866 bp, Homo sapiens
  misc_feature: GYAE6OF02H0UNN.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgacggccctgtccctcacctgccactgtctcgtggtcgacctccatcaaggagggttcgtcgttcctacgtcggacctgggactcccgggctacggtccccggaccggacgaaacggggtacgtaggggaagttattaagtttcgggaaccgtaattccgtaagtcgtaccgaggggtccgggaacccgtccaattacccgtaacccaaacccccggtttccccaaaacgaaacggtacgggtccggtaaacgttccaaaggtcctaaattcggtacctaagggttcccggaaccctacccggttacccgaaccgtaaaccctaccgttttacccgtaccctacgtaacctaacgggttaggtaaacgttttaagtaacgtaccggtaccccggtaccggacctaacggaaccggaaccgggtcccgggttaacggtttaacgtttaccgtacggttaccgggtaccggtaaacggtaacggggtaaccggtacccggtttttaaacggtttttaaccgggaacccgttaacggttaacccggtttaaacggtttaaaaacccgtttacccgttaaccggtttacccggttaccggtttacgggtaaccgggttacccgggttaccggggggacccggtaacggggggtaaaccccggtaaccggg

SEQ ID NO: 247043 - DNA, 535 bp, Homo sapiens
  misc_feature: GYAE6OF02GAE55.9.70.G04.1.454.CMB.1.raw
  modified_base (326)..(326): a, c, t, g, unknown or other
  misc_feature (326)..(326): n is a, c, g, or t
  modified_base (351)..(351): a, c, t, g, unknown or other
  misc_feature (351)..(351): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtgactccatcagaggtgtcgttcctactggacctggatccggcagtccgccggcaagggctggatatattggacgaatctatgccagtgggaccncatctaccaacccgtccctacaagngtcgatcagcatgtcagtcgacacgtccagaaccagttctcctgacagtgagttatatcgaccgcgacagacgacggcgtgtattactgtgcgagagaggtcgttagtttacgactagtacgttaagttaaaacctcctaacgtacggtcgtcggacgtcgtcgggaccgagggaccgtaacgg

SEQ ID NO: 247044 - DNA, 691 bp, Homo sapiens
  misc_feature: GYAE6OF02IVA07.9.70.G04.1.454.CMB.1.raw
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (292)..(292): a, c, t, g, unknown or other
  misc_feature (292)..(292): n is a, c, g, or t
  modified_base (350)..(350): a, c, t, g, unknown or other
  misc_feature (350)..(350): n is a, c, g, or t
  modified_base (374)..(374): a, c, t, g, unknown or other
  misc_feature (374)..(374): n is a, c, g, or t
  modified_base (490)..(490): a, c, t, g, unknown or other
  misc_feature (490)..(490): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcanacggccctgtccctnacctgcactgtctctggtgactccatcagtggtcgtcgttcctactggacctgggactccggctacgtcccgtccggnaacgggtcttgggataactacgttggaccgaattcgtaagtcgcgtaagcgggtaccnctactcgtaccaacccgtcccganaaaggcgtcgatccgaagactagtactagacggttaccacgaccgtcccgtaacgaaccgtacttcctccgtacgtctaacgtacggtagtttactaacggttcgaccgcccgtanaacggtaccgtaccgggttaccgtacggtttaacttaccgtggtaaccggacgtaacgtaggtaacggttacgtttacggtttaaccgtaccgtaacgtacggttaaccggtttaaaacttcccgttaaacgttccggttacgtacggttaccggttccgggtacggggtaaccgggtaccggggtaaccgttaacccggg

SEQ ID NO: 247045 - DNA, 740 bp, Homo sapiens
  misc_feature: GYAE6OF02I5DR3.9.70.G04.1.454.CMB.1.raw
  modified_base (334)..(334): a, c, t, g, unknown or other
  misc_feature (334)..(334): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcttcctactggacctggactccggcacgtccgaccggcaagggctggagtatacttggaacgaatctatcgaccagtcgggaccncctaagtcctaaccgaacccgttcccactaaacggacgtacgaacggtcaacgaccaagttcggtacctaacggtccgaaaccctaccggttaccccaaacgtaaacccctaacggtttccctaccccgttagaaccgtaacggttaggtaacggtttaacgttaacgtacggaccccggtacccgtacgaaccggacccgtaaccgggtccgttagttaacgtttacgtacggttacggacggtaacgtaacggtacgggttaccgttttaagttttaccggaacgtacgtaaccgtttaacggttttaaaaaccgtacccgttaacgttaaccggttcgttaccggggtaccgttaccgggtaccgggggtaacccggtaacgggggtaacccgtaaaccgggg

SEQ ID NO: 247046 - DNA, 688 bp, Homo sapiens
  misc_feature: GYAE6OF02HQLHF.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgctactgtctcgtggtcgacctccatcaggaggttcggtcttcctacgtggacctggactccggcagtcccgccggcaaggggctaggactatagttgggaactaatctatcgaccgaggtcgggacccgcacttccgtaaccgaaccccgttcccctaacgaaacgtacggtccgtaagtccaaggcctaagtcgtacgaggtccgaaccgtacccgtacccgacgaaacccgtacgttcctccctacggacgtaggtagttagttactaacgtcggacccgaccgaccgtaacgaccgaccggtaccgttacgttattaccgtgtcggacgaggtacggtacggtacgtttacgtttacggaccgtacgtacgttaacgttaaaaccgtttcctaaaccggttaccggtaccggttacggttaccggtacggtaccggggtacccggtacggggtaccgtaacccggg

SEQ ID NO: 247047 - DNA, 740 bp, Homo sapiens
  misc_feature: GYAE6OF02J3HP6.9.70.G04.1.454.CMB.1.raw
  modified_base (627)..(627): a, c, t, g, unknown or other
  misc_feature (627)..(627): n is a, c, g, or t
tcagtgatacgtctcacgaccggtgctcgatttagtgtagtgtgaagggaaaggcctgtgaaggcttcactagtcctggacctcctgtgcaagaacatgaaacatctgtggttcatcctcctcctggtgcagctcccagagtgggtcctgtcccaggtgcggctgcaggacggtccgggacccaggtactaggtcgaacgtcccttacacgacggtccctcgtccctcacctgctctgtctcgtgtacacctcagtcgaggtacggttcggttccttcctacgtacggaccgttggaccgtcccggcgtaccggtccccggccgggaacgaacgggtacgttagggaagttaactaacggttcggaacgtaaactccgttaaggccggtacccgtagggtacccgggacccctaccgtactacccgttaaaccccaaccccggttcctaacggtaacggtcggtacgtaaccggtacacggtactaggtcccgtacgtaaccggtacccgaaccctaccggtacccgaactacccgtacgttccccaccgtagacgtacggttagtaacgttacgacgtacccgaccggcctacgaacgacccggacgttacgttagtacttacggngacgggtactacgacgttacggttaacgtttacgacgactaggtaccctaagttaaccgcgttacggtacgtcgtaggtacccggtggaccgggacggtacggaccgttaccg

SEQ ID NO: 247048 - DNA, 609 bp, Homo sapiens
  misc_feature: GYAE6OF02H1GCL.9.70.G04.1.454.CMB.1.raw
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccagttgcggctgcaggagtcgggcccaggactagtgaagccttcacaggccctgtccctcacctgcactgtctctggtcgactccatcagaggtgtcgttcctacgtggacctggatccggacacgtccggccggacgaaacgggactgggtaagtagttagttcgggaacgtaattctaagtcgccgtaggtcgggaccncatcctaaccaaccccgtccctanaagagtcgactcacgcatcgcagtcgacaccgtaccaacgtaacctacgtttcctcccgagacagtgacgtttatacgtcgaccgccgcacgacacggtccgttagttaacttacgtggtacgagaacggtaggcggttaccgttttagttacggacctagtacttaacgttaaacctccgtacgttacgtcgttaggaccgttcggacgggaccgacgggacctaacgg

SEQ ID NO: 247049 - DNA, 583 bp, Homo sapiens
  misc_feature: GYAE6OF02F7Q3N.9.70.G04.1.454.CMB.1.raw
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (326)..(326): a, c, t, g, unknown or other
  misc_feature (326)..(326): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagnggtgtcgttcctactggacctggactccggcagtccgcggcaagggctggatatattggaacgtatctatgccagtggaccncatcaccaacccgtcctacaagcgtcgagtacagctagtcgtcagtccgacacgtcccaagacctagttcctccgtagtacagtgtaagttatagtcgaccgccgacacgaccgaccggccgttgtacttacgtgtagcgagacgaggtaccgtttagtttacggacctagtacgtaacgtttaaaaccgtccttaacgttacggttcgttacgggtaccgttaccggtacggggacccgtacggggtacctaacgg

SEQ ID NO: 247050 - DNA, 813 bp, Homo sapiens
  misc_feature: GYAE6OF02H92FN.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacaggccctgtccctcacctgcacgtgtctcgtggtcgacctccatcgaggtaggtcggttccgttcctaacgtcgggacctgggactcccggactacggtccccggccgggaccgaaaggggtacccgtaggaacggttattaacgttacgggaaaccgaagtttctaagtcgtaccgtagggttaccggggaaccccgtaccaacttacccgtaaaccgtaaaccccccgttcccgtacgtaaacggacgttacgggaacgttacgaacgtaccgtaattcgtacgtaacggttcgaacccgtaccggtaccctaacggtaaacccgtaacgtttccccgacccgttaggaaccgtttaggtagttaaacgttactaagtaccggtacccgaccgaccgtaacgcgtaaccgggtccgttagttaaacgtttcccgtaggttacggacccgtaagggtaacggtaccggtttaaccgttttacgtttaacccggtaccgaagtttaacccggttaaaactttaaaacccgtccctttaaacggttaccggttacgtacgggttaaccggttccgggttaacggggacccggtaacggggtaaccttaaaccggg

SEQ ID NO: 247051 - DNA, 604 bp, Homo sapiens
  misc_feature: GYAE6OF02IQY99.9.70.G04.1.454.CMB.1.raw
  modified_base (214)..(214): a, c, t, g, unknown or other
  misc_feature (214)..(214): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctnacctgcactgtctctggtgactccatcagaggtggtcgttcctatggacctggactccggcagtccgccggcaagggctgggagtatattggacgaatctatgccagtcgggaccgcatctacaacccgtcctnaagngtcgagtcagctagtgtcagtcgacaccgtacccacgaaaccacgttcctcccgtagtacagtgtaagttatattcgaccgccgacgtacgaccaccgggaccgttagttacttacgtgttagcgtaagaggtacggttaccgtttagtttaacggaccgtagtacgttaaggtttaaaaacctccgttaacgttaccggttacgtacggtaccgttcggtacggggacccggtaggggtaccctaaccggg

SEQ ID NO: 247052 - DNA, 589 bp, Homo sapiens
  misc_feature: GYAE6OF02F8NHP.9.70.G04.1.454.CMB.1.raw
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcaggaggttcggtcgttcctactggacctggactccggcagtccgccggcgaagggactggatatgttggacgaatcgtangccaggtcgggaccnccgatcctaaccaacccgtccctacaaagcgttcgatcgagcatgtcagtccacaccgtcccagaaccctagttccgtccctgaactaggtagtaagttatacgtcgtacccgccgacaacgcaccggccgttagttacttacgtggtgacgtagaacggtacggttacgtttagtttacgacctagtacttaacgttaaacctcctaacttacggtcgtcggtacgttcgcggggacgacgggacctaacgg

SEQ ID NO: 247053 - DNA, 654 bp, Homo sapiens
  misc_feature: GYAE6OF02I8AQM.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgagccttcacacggccttgtccctcacctgcactgtcctctggtcgactccatcgagaggtggtccttctactggacctggactccggactacgtccgccggcgaaggactgggatatagttggacgtaatcgtatcgccgtagtcgggaccgctactcctaaccaacccgtcccctagaagtggtccgagtcacgtcaagtcgtacaccgttacgacgtacccgtacccgaccgtaaccgtacgttccctacccgtacgtacgtacgtacgtagttatacgtacgtacccgccgaccgacgacgtaccggtccgttacgtacgttacgtcgtggtacgtacgaacggtacggtaccggtttacgtttacgtaccgacgtacgttaacgttaaaccttaccgttaaccgttaccgtcgttaggtccccccccggtggtcgggaccggtacgggtaccggtaaccgg

SEQ ID NO: 247054 - DNA, 673 bp, Homo sapiens
  misc_feature: GYAE6OF02IJL1E.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctacgtggacctggactccggcacgtccgccggacgaaggggactcgggaagttagtaagttcgggaacgtaactctagtcgaccgtaaggtcgggacccgccacttccaaccgtaaccccgtcctacaaaggacgtacgacgtacgagacactggtcaaggtccgaacaccgtaccccgaaggtaaacccaggaactcctacccgtagaccgtagtcgtaagttatacgtacggacccgtccgctaacgaccgaaccgggtccgttagtacgttttacctgggttagaccggaaggaggtacgggttcccgtttttaagtttaccgggacctagtcccgttaaaattaaaaccctcgttaaccgttacggtacgcgggttaccgttccgggtacggggacccgaacggggtaaccgg

SEQ ID NO: 247055 - DNA, 811 bp, Homo sapiens
  misc_feature: GYAE6OF02HYS4K.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctccaagatgggtcctgtcccaggtgcggctgcaggagtcgggcccaggactagtgaagccttcacaggccctgtccctcacctgcactgtctctggtgacctccatcagaggtggtcgttcctactggacctggactccggcacggtcccgccggacgaaagggtactggaagtaattagttcgggaacgtaatctagtcgccgtaggttcgggacccgcctattaccctaaccgtaaacccccgtccccttagaaaacgtcggttaccgaagttaccaaggtcctaagttcggtaccgaacggttaccgaacccgtaacccggttaccccgaaacggtaaacccctaccgggttttaccccttaccccgttaggtaaaccgtaacggttacggtaagttttaactaacgttaccgggaccccggtacccggacgaacgggtaacccgaaccgggttacccggtttacgtttaacgtttaccgtagggttacggacggtaacggtaacgggtacgggttacccgtttttaaggttttaaccgggaaccgttacggttacgttaaaacggttttaaaacccgttcccgttaaccggtttaaccggttccggttacgggtaacccgggttccgggttaacccgggggtacccggtaccgggggtaaccctaaccgggg

SEQ ID NO: 247056 - DNA, 616 bp, Homo sapiens
  misc_feature: GYAE6OF02HPGF5.9.70.G04.1.454.CMB.1.raw
  modified_base (233)..(233): a, c, t, g, unknown or other
  misc_feature (233)..(233): n is a, c, g, or t
  modified_base (333)..(333): a, c, t, g, unknown or other
  misc_feature (333)..(333): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtgtcgttcctagtcggacctggactccggcagtccgccggcaagggctggagttatagttaggacgtaatctatgccaggtggaccnctatcctacgaaccccgtcctacgaagtcgtcgagtcagcatgtacagtacacacgtccacgaacctacgttcctccctgactagtacgtagttatagtacgaccgcgacgaacgacgaccggtaccgttagttacgttacgtgtacgacggtagaacggtacggttaccgtttaagttttaacggacctacggtacgttaacgttaaaaccttaccgttaaccgttaacggtcgtacggtaccggtacggttacggggaccggtacggggaccgtaaccggg

SEQ ID NO: 247057 - DNA, 578 bp, Homo sapiens
  misc_feature: GYAE6OF02HGK3F.9.70.G04.1.454.CMB.1.raw
  modified_base (332)..(332): a, c, t, g, unknown or other
  misc_feature (332)..(332): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctcgtggtgacctccatcgagaggtggtcgttcctactggacctggatccggcagtcccgccggcaagggactggatatagtggacaatctatgccaggtcggaccncatcctacaaccccgtcctacgaagacgtcgagtcagcaatgtcagtcgacacgtacccacgtaaccagttcctcctgactagtgtagttatagtcgaccgccgacgacgaccgaccggtcgtagttacttacgtgtcgcgagaggtacggtaccgtttagttacgacgtagtcgttaacgttaaaacctccgtaacgttacggtcgtacggtacgtcggtcggggaccgtacgggacgtaaccgg

SEQ ID NO: 247058 - DNA, 618 bp, Homo sapiens
  misc_feature: GYAE6OF02I0L8E.9.70.G04.1.454.CMB.1.raw
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcaggagtggtcttcctactcggacctggactccggcacgtccgcggacaagggctggatatagtggactatctatcgcagtcggaccncatcctacaacccgtccanaagcgtcgagtcagactagtcgtcagtcgaaccaccgtacccgaacgaacctacgttcctcccgtagactaggtagtaacgttatacgtacggacccgaccgtacacgaccgacggtccgttagttaacttacgtggtacgacggaagacggtacggttaccgtttagtttaacggacctaagtaccgttaacgtttaaaaccctcgttaaccgttacggtaccgttcggtaccggtcggttacggggaccggtacggggaccgtaacgg

SEQ ID NO: 247059 - DNA, 557 bp, Homo sapiens
  misc_feature: GYAE6OF02HO13I.9.70.G04.1.454.CMB.1.raw
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
  modified_base (454)..(454): a, c, t, g, unknown or other
  misc_feature (454)..(454): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctatggacctggatccggcagtccgccggcgaaagggctggagtatagttggacgaatctatgccagtcgggaccncatctaccacccgtccctacaagngtacgagtcagcatgtcagtcacaccgccaacgaaccagttcctccctagacagtgtattatagtacgaccgccgcacgacgacggccgtagtattacgngtgcgagcgaggtcgttagtttacggacctagtacgttaagttaaaccttcctaacgtacggttactgggtacgtcgtcggggaccgacggggacctaacggg

SEQ ID NO: 247060 - DNA, 956 bp, Homo sapiens
  misc_feature: GYAE6OF02IROZ6.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagagtgggtcctcgtccctagttgcggctcgcgaggagtccgggcccaggactagtgaagtccttcacacggcccctcgtcccctcacctgcctactgtctcgtggtcgtacctccatcgaggtacgggtcggttccgttcctactggacctggacttccggcacggtcccgccggacaacgggtctgggacgtattagttacgggaacgtaatctagtgacccgtagggtcgggacccgacctattacctaaccctaaccccggttcccacgtaaacggtacggttacggtacgtaccgacggtcctaaagttcggtaccgaacggtacccgtaaccgtaaccccggttacccccgaaaccggtaaaaccccgttaaccggttttaccccgtttacccccgttaacgggtaaacccgttaacgggttaacggttaaacgggttttaactttaaacggttacccggtaacccccgggtaccccgggtaacccggaaccggtaaacccgggtaacccgggttacccgggtttacgtttaaccgtttttaaccggttacgggtttacggtaaccgggtaacgggtaaacgggttaaccgggtttacccggtttttaaaccgggtttttaaccggggttaacccgttaaaccgggtttaaccggtttaaacccggtttttaaaaaaaccccgttaccccggttttaaacccgggtttaacccgggtttaaccggtttaccgggttaacccggggttttacccggggtacccggggggttaaccccggggtaaccggggggtaaccccggtaaaccccgggg

SEQ ID NO: 247061 - DNA, 539 bp, Homo sapiens
  misc_feature: GYAE6OF02HAC7B.9.70.G04.1.454.CMB.1.raw
  modified_base (296)..(296): a, c, t, g, unknown or other
  misc_feature (296)..(296): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcagtccgccggcaagggactggngtatattggacgaatctatgccagtgggaccgccatctacaacccgtccctcaagagtcgagtcagcatgtcagtcgacacgtccacgaaccacgttctccctgacagtgagttatatcgaccgcgcacgacacggccgtagtacttacgtgtgcgagagaggtaccgttagtttaggaccagtctaagttaaaacctcgtaactacgttcgtacgacgtcgtcgggacgacggacctaacgg

SEQ ID NO: 247062 - DNA, 636 bp, Homo sapiens
  misc_feature: GYAE6OF02IOW3N.9.70.G04.1.454.CMB.1.raw
  modified_base (209)..(209): a, c, t, g, unknown or other
  misc_feature (209)..(209): n is a, c, g, or t
  modified_base (349)..(349): a, c, t, g, unknown or other
  misc_feature (349)..(349): n is a, c, g, or t
  modified_base (390)..(390): a, c, t, g, unknown or other
  misc_feature (390)..(390): n is a, c, g, or t
  modified_base (413)..(413): a, c, t, g, unknown or other
  misc_feature (413)..(413): n is a, c, g, or t
  modified_base (424)..(424): a, c, t, g, unknown or other
  misc_feature (424)..(424): n is a, c, g, or t
tcagtgatacgtctcacgaccggtgctcgatttagtgtagtgtgaagggaagggccgtgtgaaggcttcactagtcctggacctcctgtgcaagaacatgaaacatctgtgttcatcctcctcctggtgcagctcccagatgggtcctgtcccaggtgcggctgcaggagtcggccaggactgtgagccttcacaggccctgtcccctnacctgccactcgtctctggtcgacctccatcagacgttggtcgttcctactggtacctgggtacctccggcacggtcccgcggacgtaaagggcctggagttatagttagggaacctaatcgtatcgcaggtcgggaccncgtactcacacccgtcctacgacgagtcgagtcagcagtcncacgtcacaccgtaccagaaccnctacctcctanacagtcgtaatacgtatacgccgtccgacgaacgtaccgacgtccgtacgtacttacgtacgtcgacgacgtacgaggtacccgttagttttaaccggaccgtaggttaaccgttaacgttaaaaccgttaccgttaaacgttacccggttaggttaccgggtacgttacccgggttaacggggcccggtaacggggtaacccgtaaccggg

SEQ ID NO: 247063 - DNA, 557 bp, Homo sapiens
  misc_feature: GYAE6OF02F9Q3K.9.70.G04.1.454.CMB.1.raw
  modified_base (233)..(233): a, c, t, g, unknown or other
  misc_feature (233)..(233): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcactggacctggatccggcagtccgccggcaaggggactgggagttatagttggaacgtaatctaatgccaagtgggaccgccatctaacaacccgtcctacaagcgtcgagtcagcatgcagtcgacacgtccagaccagttcctaccctgacagtgagttatagtacgacccgccgcagacacggccgtgtacttctgtcgcgagtagacggtcgtttagtttacggactacgacgtaacgttaaacttcctaacgttacggtactggtaccgtcgtacggggccgaggggacctaacggg

SEQ ID NO: 247064 - DNA, 673 bp, Homo sapiens
  misc_feature: GYAE6OF02JZ0A5.9.70.G04.1.454.CMB.1.raw
  modified_base (325)..(325): a, c, t, g, unknown or other
  misc_feature (325)..(325): n is a, c, g, or t
  modified_base (367)..(367): a, c, t, g, unknown or other
  misc_feature (367)..(367): n is a, c, g, or t
tcagtgatacgtctcacgaccggtgctcgatttagtgtagtgtgaagggaaagggccgtgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtaccctcacctgcactgtctcgtggtgactccatccagaggttcggtcttcctacgtggacctggaactccggcacgtccgccggacagggctgggatatagtgaacgtaatctancgcacggtcggaccgtcatcctacgacccgtccctaaacggngttcgacgtcaggctactcggttcaacggttccgaaccctaccgtacccgaacgaacccgtacgttaccgtacccctaggtacacggtaacgtagttactaacgttccgaacccgccggaccgtaacgaccgaccggtaccgtagtacgttacgtacgtacgcggaagtacggaacggtaccgtttaacgtttacggaccgttacgtaccgttaacggttaaaaccttaccgttaaacccgttacggttaccgtaccgggttacggtaccggtaccggggtacggttaccggggacccgttaacgg

SEQ ID NO: 247065 - DNA, 588 bp, Homo sapiens
  misc_feature: GYAE6OF02G9GT1.9.70.G04.1.454.CMB.1.raw
  modified_base (335)..(335): a, c, t, g, unknown or other
  misc_feature (335)..(335): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacacggcctgtccctcacctgcactgtctctggtgactccatcagaggtggtccgttcctacgtggacctggatccggcaggtcccgccggcaaggggctggagtatagttggacgaatctatgccaggtcgggaccncatctaccaacccgtcctacaagagtcgagtcagcatgtcagtcgacacgtccagaaccagttctcctgacagtgtagttatatacgaccgcgcacgacaccggcgtagtacttacgtgtcgacgagacgacggtccgtttaagtttacggaccgtagtacgttaacgttaaaaccgttcccttaacgttaccggttacgtacgggtacggttaccggtacgggggtacccggtacggggaccctaaccgggg

SEQ ID NO: 247066 - DNA, 700 bp, Homo sapiens
  misc_feature: GYAE6OF02JLYA2.9.70.G04.1.454.CMB.1.raw
  modified_base (296)..(296): a, c, t, g, unknown or other
  misc_feature (296)..(296): n is a, c, g, or t
  modified_base (363)..(363): a, c, t, g, unknown or other
  misc_feature (363)..(363): n is a, c, g, or t
tcagtgatacgtctcacgaccggtgctcgatttagtgtagtgtgaaggaaagggacctgtgaaggcttcactagtcctggacctcctgtgcaagaacatgaaacatctgtggttcatcctcctcctggtggtcagctcccagatgggtcctgtcccaggtgcggctgcaggagtcgggcccaggactagtgaagccttcacaggcctgtccctcacctgcactgtctctggtgactccatcacgaggtggtcgttcctactcgacctgactcgcagtccgcgcgaaggactggatntattggacgatcgtatgcagtggaccgcgatcctacaacccgtccctcgaagacgtcgtacgtcgancgaattcgtacgacgttacggacctaccggtacccgtaacgaaacccgagttttacccctaccccgttaggtaaccgtaacggttacggtaaggtttaacttaacgttacggaccccggtaccggaccgaacggttaaaccgaccgggttacccgttacggttaacgtttacccgtagggttccgacggtaacggtagggaacggttacccgggttttaagttttacgggtaccctaacggaccgttttaaacggttaaaaacctttccgtaaaccgttaccggttcgtaacgggtaccgtaccgttcgggggacccgttagggacccgtaaccggg

SEQ ID NO: 247067 - DNA, 807 bp, Homo sapiens
  misc_feature: GYAE6OF02I39U8.9.70.G04.1.454.CMB.1.raw
  modified_base (380)..(380): a, c, t, g, unknown or other
  misc_feature (380)..(380): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggccaggactagtgaagccttcacaggccctgtccctcacctgcactgtctcgtggtcacctccatcgaggtaggttcggtccgttacctacgtcggacctggactccggctacggtcccggacggcgaaaggggtctgggatatagtggaacgtaatctagtgaccgaggtcgggacctccagtactaaccctacccgtcctanaaggacgttacggacgtcacggtcacgttcgtacgtacggtaccgaaccgtacccgtacccgaagtaaacccgtacggtttccctaccccgtaggtaaacctaggttacgtaacgttttaactacggttacccggacccggtacccgtaccggaacggtaaccccgtaacccggggttcccggtttaaacggttaaccttttaaccggtcgggttcggaacccggggtaacggtaacggggttaacgggttaacccggttttttaagttaaccggggtaaccctacgggttaaccgtttaaaaaccgggtttaaaaaccttaccccgtttaaacgggtttaacccggttaccggtaacgggggtacccgtttaccggggtaccggggggtaaacccggaaccgggggttaacccgttaaacccgggg

SEQ ID NO: 247068 - DNA, 855 bp, Homo sapiens
  misc_feature: GYAE6OF02HUS1L.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggccaggactagtgaagccttcacacggccctgtccctcacctgcactgtctcgtggtcgactccatcgaggtaggttcggttccgttcctacgtcggacccttgggacttcccggctacggtccccgggaccggacggaaacggggtactagggtacgtaagttagttacgggaaccgtaattcctaagtacggccgtaagggtccgggtaacccgaccaacgttaccctaaacccgaaacccccgttccccgtaacgaacgggttaacggttccggtaaggtaccgaaacggtcctaacgtttcgtaccgtacggttacccgaaacccttaccggtacccgaaaccgtaacccgtaaccggttttaccctacccgtacggtaacgtacggtaacgttaaacgtttaacgttacttaccggaacccggacccgtacgaaccgtaaaccggcccgggtaccgtttagttaacgtttaccgtcggttacggaccgtaagggtaaccgggtaaccggtttaaccggttttaacgttttaaacccgggaccttaacggttaccggttaaaaccggtttaaaaacccttcccgtttaaaccggttacccggttaggtttaccgggttaccgggtaccgggtttacccgggggaaccggttaccgggggtaacccgttaaccgggg

SEQ ID NO: 247069 - DNA, 673 bp, Homo sapiens
  misc_feature: GYAE6OF02GN8OJ.9.70.G04.1.454.CMB.1.raw
  modified_base (223)..(223): a, c, t, g, unknown or other
  misc_feature (223)..(223): n is a, c, g, or t
  modified_base (415)..(415): a, c, t, g, unknown or other
  misc_feature (415)..(415): n is a, c, g, or t
tcagtgatacgtctcacgaccggtgctcgatttagtgtagtgtgaagggaaagggcctgtgaaggcttcacaggccctgtccctcacctgcactgtctctggtgactccatcagaggtggtcgttcctactggacctggatccggcagtccgccggcaagggactggagtatattggacgaatctatgccagtgggaccgccatctacaacccgtcctcaagngtcgagtcagcatgtcagtcgacacgtcccagaaccagttctccctgacacgtgagttatatgaccgccgcagacacggccgtgtattacgtgtgcgagagaggtccgttagtttacggacctagtctagttaaaactctacgtacgtctaggtacgtcgtgggcgagggaccgaaggtcaccgtctcctcncgcctcacacggcccagtccggtcctcccgtgccgtccctgtcctccgacggacgccctaccgtaccggacgtacgaccgaccgtaacgggcccgggtacccgtcggggtacccgtccggtacccggttacggggtaacccgtaaacgggggttaaccccttaacccggtttacccccggtaaacgggttaacccggtttaccgttaacccggtaacccggtttaacggggacccggttaacccggggggtccccggg

SEQ ID NO: 247070 - DNA, 561 bp, Homo sapiens
  misc_feature: GYAE6OF02FFC2J.9.70.G04.1.454.CMB.1.raw
  modified_base (243)..(243): a, c, t, g, unknown or other
  misc_feature (243)..(243): n is a, c, g, or t
  modified_base (353)..(353): a, c, t, g, unknown or other
  misc_feature (353)..(353): n is a, c, g, or t
tcagtgatacgtctcacgaccggtgctcgatttagtgtagtgtgaagggaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagnggtgtctcactggacctggatccggcagtccgcggcaagggctggatatattggacaatctatgccaggtcggggaccgccatccgtaaccaaccccgtccctacgaagnggtcgagtcagcagtgtacaggtcgaacaccgtacccaacgaacctacgttcctcccttagaccgagtagaagttatagtcgaccgccgcagacacgggccgtgtattactgtgcgagagacggtccgtttagtttaggacctagcttaacgttaaactcctaacgtacggtcgtacggtacgtcgtgggccgaggggtacctaacgg

SEQ ID NO: 247071 - DNA, 539 bp, Homo sapiens
  misc_feature: GYAE6OF02IHHRM.9.70.G04.1.454.CMB.1.raw
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcttcctatggacctggatccggcagtccgccggcaagggctggatatattggacgaatctatgcagtggaccncatcacacccgtcctanagngtcgatcagcatgtcagtcgacacgtccagaaccacgttctccctgacagtgagttatatcgaccgccgacgacgacgacggcgtgtacttacgtgtcgcgagaggacggtcgttaagttttacggacctagtactaagttaaaacctcctaacttacggtcgtcggacgtcggtcgggaccgacgggactaacggg

SEQ ID NO: 247072 - DNA, 576 bp, Homo sapiens
  misc_feature: GYAE6OF02H1F7B.9.70.G04.1.454.CMB.1.raw
  modified_base (341)..(341): a, c, t, g, unknown or other
  misc_feature (341)..(341): n is a, c, g, or t
  modified_base (363)..(363): a, c, t, g, unknown or other
  misc_feature (363)..(363): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcacggtcccgccggcgaaagggcctgggagtattagttggaacgtaatctatgccaggtgggaccncatcctaccaacccgtccctanaagacgtcgagtcagcatgtcagtcgaccacgtacccacgaacctagttcctcccgtgactagtcgtagttatagtcgaccgccgcacgacgaccggtcgtgtacttacgtgtgacgagacggacggtacgtttagtttacgacgcgtacgtaacgttaaacctctaacgtacgttcgtacggacgtcggtcgggaccgacgggacctaacgg

SEQ ID NO: 247073 - DNA, 566 bp, Homo sapiens
  misc_feature: GYAE6OF02FSZP1.9.70.G04.1.454.CMB.1.raw
  modified_base (332)..(332): a, c, t, g, unknown or other
  misc_feature (332)..(332): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaagactagtgaagccttcacaggccctgtccctcacctgcactgtctctggtgactccatcagaggtggtcgttcctactggacctggactccggcagtccgccggcaagggactgggagtatagttggacgaatctatgccagtgggaccncatctacacccgtcctcaagcgtcgagtcagcatgtcagtcgaacacgtcccacgaccacgttcctccctgacagtgagtatactcgacccgccgcacgaccacggccgtgtacttacgtgtcgacgagagacggtccgtttagtttacggacctacgtacgttaacgttaaaacctccgtaacgttaccgtacgtacggacgttcgtcggggaccgtacggggacctaacggg

SEQ ID NO: 247074 - DNA, 580 bp, Homo sapiens
  misc_feature: GYAE6OF02GZUUV.9.70.G04.1.454.CMB.1.raw
  modified_base (234)..(234): a, c, t, g, unknown or other
  misc_feature (234)..(234): n is a, c, g, or t
  modified_base (329)..(329): a, c, t, g, unknown or other
  misc_feature (329)..(329): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccaggactagtcgaacgccttcacaggccctgtccctcgacctgcactgtctttggnactccatcagaggtgtcgttcctactggacctggatccggcagtcccgccggcaagggcctggatatattggacgaatctatgccagtgggaccnccatcctaccacccgtccctanaagngtcgagtcagctatgtcagtcgactaccgtcccacgaacctacgttctccctgacagtgtagttatagtacgaccgccgtacgacgtaacgaccggtccgttagttacttacgtgtcgacgagagtacggtccgtttaagtttacgaccgtagtctacgttaaaactcctaacgttacggtcgtaggtccgtacggtgggcccggacgggtaccgtaaggtcccg

SEQ ID NO: 247075 - DNA, 791 bp, Homo sapiens
  misc_feature: GYAE6OF02JIA01.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatagaaacatctgtggttcatcctcctcctggtggcagctcccagatgggtcctgtcccaggtgcggctgcaggagtcgggcccaggactagtgaagccttcacacggccctgtcccctcacctgcacctgtctctggtagacctccatcgagaggtggtccgttctactcggacctggactccggcacggtcccggccggacgaacgggtaccgtggaacgtagtaacttggaccggtaaattccgtactggtcccgaacgtcgggaaccgcccaaatccccgtaccaaaccccggtcccgtacgtaaacggaacgttccggaaggttccaaaggtcccgaatcggttccaagttccgggacccaacgggtacccctaacggtaaacccctaacgggttttacctaccccgttacgggtaaccgtaacgggtttacgtaacggtttaacgttaaaccggttcggtaaaccccggacccggtacccgaacgggtacccgtaaccggggttcccgttaacggttaacgtttacccgtacggttacgggaccgttaacggacggttaacgggtacccggtttaacgttttagggaccctaagggttacctaacggtttaaaccgaccgttacgttaaccgggtcttacggggtaccggtccggtacgggggtacccgtaggggtaccctaaccggg

SEQ ID NO: 247076 - DNA, 665 bp, Homo sapiens
  misc_feature: GYAE6OF02GHDI3.9.70.G04.1.454.CMB.1.raw
  modified_base (234)..(234): a, c, t, g, unknown or other
  misc_feature (234)..(234): n is a, c, g, or t
  modified_base (336)..(336): a, c, t, g, unknown or other
  misc_feature (336)..(336): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtccctcacctgcactgtctctggtnactccatcagaggtggtccgttcctacgtggacctggactccggcagtcccgcggcaagggctggaagtatagtggaacgatctatcgaccagtcgggaccncgaactcgaaccctacccgtcctacgaagtcgtacgtagtcagctagtcgtacagtccgaacgtaccgtacccaacgtaaccgtacgttccctcccgtacgactagtagtacgttaatactcggacccgccgacgtacgaccgacggtccgttaagttacgtttacgtacggtcgacggtacgtaacggtacggttaccgtttagtttaaccggacgtacgttaaccggttaaacgttaaaaccgttcccgttaaccggttaccggttacggtaccgggtaccggttaccgggtccggggtaaccgggtaccgggtaccgtaacccggg

SEQ ID NO: 247077 - DNA, 550 bp, Homo sapiens
  misc_feature: GYAE6OF02GY58D.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccgccatctacaacccgtcctacaagagtcgagtcagcatgtcagtcgacacgtcccagaccagttcctccctgacagtgagttatagtcgaccgccgcagaccaccggccgtgtacttacgtgtgcgagagaggtccgtttatttacggacctagtcttaacgttaaaaccttcctaacgtaccggtctacggtcgtcgtcggggccgacggggacctaacggg

SEQ ID NO: 247078 - DNA, 747 bp, Homo sapiens
  misc_feature: GYAE6OF02I7FQW.9.70.G04.1.454.CMB.1.raw
  modified_base (236)..(236): a, c, t, g, unknown or other
  misc_feature (236)..(236): n is a, c, g, or t
tcagtgatacgtctcacgaccggtgctcgatttagtgtagtgtgaagggaaagggcctgtgaaggcttcactagtcctggacctcctgtgcaaagaacatgaaacatctgtggttcatcctcctcctggtggcagctcccagatgggtcctgtcccaggtgcggctgcaggagtcgggcccaggactagtgaagccttacacacggccctgtccctcacctgcactgtctctggtnactccatcagaggtcggtcgttcctacgtggtacctggactccggcgacggtcccggcggacgaacggggtactgggaagttagtagttgggaacgaacttctagtcgtacccgaggtcgggaacctccgtaatccgtaacccgaaccccggttccctaacaaaggtaccgtaccggacgttacgacgtacctaagtcgtccgaaggttaccgaacccgaacccggttaccccaaacgtaaccctaacggtttcctaccccgtaggaccgtaagttcgtaacgtttacgttaacgttaccggaacccgcccggtaacgacgtaaccggtaaccggtccgtagtttacttaaccgtggttacggaccgggtagtaacggacggtttaaccgtttaacgttttaaccgggacctacggtaccgttaaacgtttaaaccgtaccgttaacgtacggttaccgttacgggtaccggttcggtacggggtaaccggtaacggggaccctaaccggg

SEQ ID NO: 247079 - DNA, 673 bp, Homo sapiens
  misc_feature: GYAE6OF02IPV6N.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtccgggcccaggactagtgaagccttcacaggccctgtccctcacctgcactgtctctggtcacctccatcgagtaggtggttccgttcctacgtcggacctggactccggcacggtcccggccggcgaaagggcgtggaagtagtagttgggaactaatcgtagcgaccgtaggtacgggaccgacctagttaccctaaccgaaccccgtttcccaagtaaacgacgtcgaacgtacgagtactaagtacgtacgacggttaccgaccgtaccgtacccgaacggtaaaccctacgtttcccgtaccccgttaggaacgtaggttacgtaacgtttactaacgtaccgacccgtaccgactacgaccgtaccggtcgttagttaacgttacgtcgtaggacgaagtacggtacggtcgtttaagttacgacgacgtacgtaacgttaaacctcgtaacgtacgtcgtacggtacgtcgacgggacgacgggactaaccgg

SEQ ID NO: 247080 - DNA, 526 bp, Homo sapiens
  misc_feature: GYAE6OF02FIAIO.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggatatattggacgaatctatgccagtgggaccgcatctacaacccgtccctcaagagtcgagtcagcatgtcagtcgacacgtcccagaaccagttctccctgacagtgagttatatcgaccgccgcagacacggccgtgtattactgtgcgagagaggcgtttatttaggaccagcttagttaaaactcctaacttacggtctggacgtcgtgggccgagggacctaacgg

SEQ ID NO: 247081 - DNA, 903 bp, Homo sapiens
  misc_feature: GYAE6OF02H17RH.9.70.G04.1.454.CMB.1.raw
  modified_base (228)..(228): a, c, t, g, unknown or other
  misc_feature (228)..(228): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctntggtcgactccatcagtaggtggtccgttaccctacgtcggaccctggactcccggcgacggtcccggaccgggacgaaacggggtacctgggtaacgttagttacgtttagggaaccggtaattccgtaagtccggtacccgaagggttccggggaacccgtccccgaacgtttaccctaaaccccgtaaacccccgttcccccgttaaccgaaaacgggtacggttaccgggtaacggttaccgaacggtaccgtaagtttaccggtaccgtaacgggttacccggaaccgtaaccccggtaccccgtaaacggtaaaccccgttaacggttttcccccgttaccccgtacggtaaccgtaacgggttacggttaacggttttaaacgttaccggttaccggtaaccccggtcccggaccgtaacggaacccggaacccgggtcccggtttaagttaaccgtttacggttcgtacgggaccggtaaaggtagggtaaacccggtttaccggttttaacgttttaaccgggacccgttaacggtaccggttttaaaacggttttaaaaaccccgttttcccgttaaaccggttacccgggtttccggttagggttaaccccggtttccggggtaccggggtaaccccgggtaacggggaaccccgtaaaccggg

SEQ ID NO: 247082 - DNA, 669 bp, Homo sapiens
  misc_feature: GYAE6OF02HGUP1.9.70.G04.1.454.CMB.1.raw
  modified_base (524)..(524): a, c, t, g, unknown or other
  misc_feature (524)..(524): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactggacctggatccggcacggtcccgccgggtcgaaacggggactcgggagtatagttgggaaccgaatctaatcgccgtaggtcgggacccgcctatcctaaccaaccccgtcccctacgaaacgtacggtccgaagtcaggtctaatcgtacgacgtccgactaccgtacccgaacgaaccacgtttccctcccgtgacctaggttcgtaagttatacgtacgtacccgccgcaacggaccaccgggtccgttagtacttacgtnttcggcgaaggtacggacggttaccgtttaagtttaccggacctaggttacccgttaaagttaaaaacccttccgtaaaccgttacggtttacgtacgggtaccggttcggtaccggggtcccgtaacggggtaccgtaaccggg

SEQ ID NO: 247083 - DNA, 744 bp, Homo sapiens
  misc_feature: GYAE6OF02F22TZ.9.70.G04.1.454.CMB.1.raw
  modified_base (523)..(523): a, c, t, g, unknown or other
  misc_feature (523)..(523): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcactcatcgagaggtcgttccgttacctacgtggacctggaccttccgggcacggtcccggacccggacgaacggggactagggacgttatagttcggaacgtaatcttagtcgaccgtagggtccgggacccgtactactccctaaacccgtaccccgtcctaacgaagtcgtacgacgtcacgtccgtaattcggtacaggtaccgaccaccgtccccgaaagtaccctacgttcccttacccagtacctagttcgtaacttacgtacttaccggacccgacccggtanaacggaacccggccgggttacttacggttaactttaccgtagggtcgaccgaagtaacgggttacggtttaacccgttttaagtaaccgggtacgtaaccggttaccgttttaaaaacccggttaaaacccttcccggtttaacggttaaccggttacccttacggggtaacccggtttcgggacccgggggtaccccgtaaggggaacccccgttacggg

SEQ ID NO: 247084 - DNA, 580 bp, Homo sapiens
  misc_feature: GYAE6OF02IOUDG.9.70.G04.1.454.CMB.1.raw
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcaggtcccgcggcaagggctggagtatagttggacaatctagtcgcctaggtcgggaccgcatcctaccaacccgtcctanaagngtcgagtcagcatcgtcagtcgactaccgtcccacgaacctgttcctccctagacagtgagttatacgtcgaccgccgacagaccgaccggtccgtagttacttacgtgtacgacgagacggtacggtccgtttaagtttacggactagtcgtaacgttaaaacctccgttaacgttaccggttcgtcggacgttcgcgggaccgacgggacctaacggg

SEQ ID NO: 247085 - DNA, 623 bp, Homo sapiens
  misc_feature: GYAE6OF02H7KH3.9.70.G04.1.454.CMB.1.raw
  modified_base (233)..(233): a, c, t, g, unknown or other
  misc_feature (233)..(233): n is a, c, g, or t
  modified_base (358)..(358): a, c, t, g, unknown or other
  misc_feature (358)..(358): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcgttcctactggacctggactccggcacgtccgccggcaagggctgggatatagttggacgaatctatcgccaggtgggaccgccatcctaaccaaccccgtccctanaagacgtcgagtcagcagtgtcagtccgacaccgtacccacgaaccacgttcctcccgtagacagtgtagttatagtcgacccgcgaccgacgaccgaccggtcgtacgttactttacgtggtcgacggagtacggacggttaccgttttaacgtttacgaccgtacggtaccgttaacggtttaaaaccttcccgttaacgttaccggttaccgttcggtacggttaccggttacgggggaccggtacgggggacctaaccggg

SEQ ID NO: 247086 - DNA, 715 bp, Homo sapiens
  misc_feature: GYAE6OF02JESZN.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatcgggtcctgtccccaggtgcggctgcaggagtcgggcccaggactagtgaagccttcacaggcctgtccctcacctgcactgtctctggtcactccatcagtaggtgttcgttcctactggacctggactccggctacgtccgaccgggacaaaggggtactagggacgtatacgttcgggaacgaatcgtaatcggaccctaaggttcgggaacccgcctaacgttcctaaaccgaaaccccggttccctaacgaaaggacggttaccggaagttaccgacggacctaagttcggttaccaacggttccgaaaccgtaccggtacccgaacgtaaacccgtaacgtttacccgtacccgtacgaacgtaacggtacggtaagttaacttacgtacgacccggccgaccgaacgaccgaccggtaccgtacgttacttacgtgtacgacgtaacgaacggtacggtaccgtttacgtttaacggaccgtacgtacgttaacgttaaaaccttccgtaacgtacggttacgtacggtaccggtcggtacgggaccgtacgggtaccgtaacgg

SEQ ID NO: 247087 - DNA, 742 bp, Homo sapiens
  misc_feature: GYAE6OF02IBRM2.9.70.G04.1.454.CMB.1.raw
  modified_base (368)..(368): a, c, t, g, unknown or other
  misc_feature (368)..(368): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtgcagctcccagatgggtcctgtcccaggtgcggctgcaggagtcgggcccaggactagtgaagccttcacaggccctgccctcacctgcactgtctctggtcgacctcatcagtaggtcggtcgttacctacgtcggacctggactccggctacggtcccgccggacgaaaaggggtaatgggaagttacttaaggttacggaactaatccttaagtcgaccgtaggggtccggaaccncctaactcctaaaccctaaaccccggtccctaagaaacggtacgtaccgtaagttacgacgtctaagtcgtacgacgtacgaccctacgtaccaacgtaacctacgttacctccgtacgtaacgtagttacggtaacgttttacgtaacgttacggaccccggtacgacctaacgggaccggtaacccgggtccgtttaacggttaacgtttacgtcggttacgggacgtaacgggacgggttaacggttaaccggttttaacgtttaacggaccgttaacgtaccgtttaaacgttaaaaccgttccgtaaccgtttaccggtcgtacggtaccggttacgggtaccggggacgtaaccggggtactaaccgg

SEQ ID NO: 247088 - DNA, 600 bp, Homo sapiens
  misc_feature: GYAE6OF02GAQEZ.9.70.G04.1.454.CMB.1.raw
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggactccggcagtcccgccggcaagggctggagtatagttggacgaatctatgccaggtcgggaccgccatctaccacccgtccctanaaagngtcgagtcagcatgcagtcgacacgtcccaagacctagttcctcctgacagtgtattatagtcgacccgcgcacgaccgaccgggtcgttgttacttaccgtggtcgtacggacgtaggaccggttaccgttttaagtttaccggactacggttaccttaacggttaaaaccttcccgttaacgttacggttcgtacgggtaccgttccggtcggggacccggtacggggaccctaacggg

SEQ ID NO: 247089 - DNA, 734 bp, Homo sapiens
  misc_feature: GYAE6OF02H14CC.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtcgactccatcagtacggttggttcgttcctacgtcggacctggactccggcaggtcccgccggacgaaaggggctggaacgttaatagttagggacgaatctatcgaccgtaggtcgggaccaccactacctaaccaaccccgtccctacgaaaggtacgtccgaagtccaagctagtcgtacgtacgtccggtaaccaccggtacccaacgtaaacccgtaccggtttccctacccgtagtaacctaggttacgtacgtttaatacgttaccggaccccgtaccgtaccgaacgaccgaacccgggttcgttaacggttaactttccgtaggttacggacggtaaggtaaccggtaacgggttaacccgttttaaggttttaaccggaccgttaacgtacgttttaaaacgttaaaaacccttcccgttaacggtaacccggttcgttacgggtaccgttccgggttacgggggacccggtacggggaaccgtaacccggg

SEQ ID NO: 247090 - DNA, 705 bp, Homo sapiens
  misc_feature: GYAE6OF02IL4WY.9.70.G04.1.454.CMB.1.raw
  modified_base (233)..(233): a, c, t, g, unknown or other
  misc_feature (233)..(233): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtnactccatcagaggtggtcttccatggacctggactccggcagtccgcggcaagggctggatatagttgggacaatctagtcgccgaggtcgggaccgccattccaaccgaacccgtccctacaacgtacgtcgactcgagacagttcgtcctacggtccgaaccgtacccgtacccgaagaaacccttacggttaccctaccctagacctacggtaggtaagtttaactagttccggaacccgtcccggacaccggtaaccgaccgggacccgtttagttaacgtttacgtcgttacggacggtaaggtaacggtacgggttaccgttttaagttttaaccggggaccttaaggtaccgtttaaacggtttaaaaacccgttaccgtttaaccggttaaccggttacggttaccgggtaccggttaccgggtacgggggtacccggtaacgggggtaacccgttaacccggg

SEQ ID NO: 247091 - DNA, 524 bp, Homo sapiens
  misc_feature: GYAE6OF02FRPTW.9.70.G04.1.454.CMB.1.raw
  modified_base (329)..(329): a, c, t, g, unknown or other
  misc_feature (329)..(329): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatattggacgaatctatgccagtgggaccnccatctacaacccgtcctanaagngtcgagtcagcatgtcagtcgacncgtccagaaccagttcctccctgacagtgagttatatgacccgcgcagacacggcgtgtattacgtgtgcgagagagtccgttatttaggacagctagttaaaacctctaacgtacgtctggacgtcgtgggcgacgggactaacgg

SEQ ID NO: 247092 - DNA, 674 bp, Homo sapiens
  misc_feature: GYAE6OF02I2YQZ.9.70.G04.1.454.CMB.1.raw
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
tcagtgatacgtctcacgaccggtgctcgatttagtgtagtgtgaagggaaagggaccgtgtgaaggcttcactagtcctggacctcctgtgcaagaacatgaaacatatgtggttcatcctcctcctggtggcagctcccagatgggtcctgtcccaggtgcggctgcaggagtcgggcccaggactagtgaagccttcacaggccctgtccctcacctgcactgtctctggtnactccatcagnggtggtcttcctactggacctggactccggcagtccgcggacaagggctggagtatagttggacgtaatctagtcgccaggtgggaccncatcctaaccacccgttcccanaagcgttacgagtcgagacagttgaccagtccgacgtacccgtaccgaacgtaaccctagttcccctaccgtcgaaccgtagtacgtaagtttacgtactcggtaacccgtccggaccgtaacgaccgaaccggtcccgttagttaaccgttacgtcgtacggtaccgaaggtacggtacggttaccgttttaacgtttaacggtaccgtacggttaaccgttaaacggtttaaaacccttccgttaaccgttaccggttacgttacgggttaccggtacggttacgggggacccttaagggggaccgttaaccggg

SEQ ID NO: 247093 - DNA, 568 bp, Homo sapiens
  misc_feature: GYAE6OF02FHT4M.9.70.G04.1.454.CMB.1.raw
  modified_base (328)..(328): a, c, t, g, unknown or other
  misc_feature (328)..(328): n is a, c, g, or t
  modified_base (398)..(398): a, c, t, g, unknown or other
  misc_feature (398)..(398): n is a, c, g, or t
  modified_base (449)..(449): a, c, t, g, unknown or other
  misc_feature (449)..(449): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttccactggacctggactccggcagtccgcggcaagggctggatatagttggacaatctatgccaggtcgggacccnccatcctaccaaccccgtcctacgaagagtcgagtcagcatcgcagtcgacacgtccagacctgtctccngacagtgagttatagtcgaccgccgtcacgacacgggtacctgtacttcgngtgacgagacggacggttccgtttagttacggaccagtacgttaaacgttaaaccttcccgtaacgttaccggtcttacggtaccggtccgtaggggaccgtacggggtacctaacggg

SEQ ID NO: 247094 - DNA, 788 bp, Homo sapiens
  misc_feature: GYAE6OF02JBNL6.9.70.G04.1.454.CMB.1.raw
  modified_base (448)..(448): a, c, t, g, unknown or other
  misc_feature (448)..(448): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctccctcgtggtgcacgcctccagtgtcgggtcctcgtaccgaggtcggcggtctgacgtagggtcggtcccgggacccgaaggtacgtagtaggaacgttccttacaacgaccggtcccttcctcccctacacctcgacctacgttcgttcctcgtggtcacctacctatcgagtggttcgttccttacctagtccggtacgtaggaccgtccggatccggtccgggccgaggaacgggtctagggtatacgttagtacggaactaattcagtcgaaccgtgggtaccggaccctactactaccgtaaccccgtaccccgttaccgaanaagggtccgtaccggtaacacgacggtacctaggttacgtaccggtaacggtcccaaacccggttcccgtaaccgtaaccgtaaaccgtttccgttacccctaccgtacgtaaacgtggtaacgtttaacgttaacgtacgtacccggtacccgacctaacggaaccgtaccgggtaccggtacggttatttaccgttacgtcggtacggacgtaagtaccgggtacgttacgtttaagttaccggacgtagttaaccgttaaacttaaacctcggttaccggtacgttaccggacgttacggtaccggtacgggacccggtaacgggtacctaacccgg

SEQ ID NO: 247095 - DNA, 887 bp, Homo sapiens
  misc_feature: GYAE6OF02IPL1V.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacacggccctgtaccctcacctgcactgtctctggtcgactccatcgaggtaggtggttcgttcctacgtggaccgtggactccggacagtcccgccggacgaaagggacctgggagttattaggttaggaactaacttcgtaactcggacccgtaaggtccggggaccccgtacctacttaacccgtaaaccccgtaaacccccggtttcccctaaacgtaaaaccgggtacggtttaacccgggtaacggttacccgaaaacggtcccgtaaaagtttccggttaaccggtaaaccggttacccgggaaaccccgttaaacccccggttaaccccgaaaacccggttaaaacccccggtagttttaccccccgtacccccggtttaaggaacccgttaaacgggttaaccgggtttaaaggttttaaccttaacgggttaaccccgaccccgggtaccgacccgtaaaccgggtaacccggacccgggttacccgttttaggtaaaccttttacggcggtacgaacgggtagtaaacccgggtaggtttacccgggttttaaagtttacccggaacctacggttaaccgtttaaaccgttaaaccgttccccggttaaacgttaccgtacggtacgggttaccggccgggttaccggggacccggtaacggggtaccctaaaccggg

SEQ ID NO: 247096 - DNA, 556 bp, Homo sapiens
  misc_feature: GYAE6OF02GM7SF.9.70.G04.1.454.CMB.1.raw
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
  modified_base (421)..(421): a, c, t, g, unknown or other
  misc_feature (421)..(421): n is a, c, g, or t
tcagtgatacgtctcacgaccggtgctcgatttagtgtagtgtgaagggaaagggcctgtgaaggcttcactagtcctgggacctcctgtgcaagaacatgaaacatctgtggttcatcctctcctggtggcagctcccagatgggtcctgtcccaggtgcggctgcaggagtcgggcccaggactagtgaagccgttcacagggccctggtccccgtcacctgcactgtctctggtgactccatcagaggtggtcgttcctatggacctggactccggcagtccgccggcaagggactggagtagtagttgggacgtaatcgtatcgcctaggtcgggaccgcatctaaccgaacccgtccctacaaagngtcgagtcagcatgtcagtcgacncgtccagaactagtctcctgacagtnagtatatcgaccgccgcgagacaccggccgtgtattacgtgtcgcgagagacggtacgttagtttacgacgtagtacgtaagttaaactcctaactacgtctacggtacgtcgtcgggcgtacgggacgtaacgg

SEQ ID NO: 247097 - DNA, 678 bp, Homo sapiens
  misc_feature: GYAE6OF02IQXU3.9.70.G04.1.454.CMB.1.raw
  modified_base (271)..(271): a, c, t, g, unknown or other
  misc_feature (271)..(271): n is a, c, g, or t
  modified_base (511)..(511): a, c, t, g, unknown or other
  misc_feature (511)..(511): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacaggccctgtaccctcacctgcactgtctctggtgactcatcagaggtgtcgttctatggacctggatccggnacgtccgccggacaagggactgggtatattacgttggaacgtaatcgtaagtcgacctaggtcgggaccgcctagtacctaaccgaacccgtccctagtaaaggcgtcgacgtcagctaagtgtcacgtacgactacgtaccccaagaaaccctacggttcctaccctgtaacctacggttgtaagttataacgtcgtacccgccgtacgacgaaccgacggtcgttacgtaacttacgngttacggaccgtaagggaccggtacggttaccgtttaacgttttacgggacctttacggtaccgtttaaacgtttaaaaccgttcccgttaaacggttaacccggttacggtaccgggtacggttaccggttcgggggaaccccgtacgggggtaacccgtaacggg

SEQ ID NO: 247098 - DNA, 549 bp, Homo sapiens
  misc_feature: GYAE6OF02HXDWG.9.70.G04.1.454.CMB.1.raw
  modified_base (329)..(329): a, c, t, g, unknown or other
  misc_feature (329)..(329): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggactggagtatagtggacgaatctatgccagtcggaccncatctacaacccgtccctagaagagtcgagtcagcatgtcagtcgacacgtaccacgaacctagttcctccctgactagtgagttatagtcgaccgccgcacgacacggccgtgtacttacgtgtgcgagagacggtcttagtttaggacagtcgtaagttaaaacctcttaacgtacgtcgtaggtacgtcgtacggggaccgtacgggaccgtaacgg

SEQ ID NO: 247099 - DNA, 700 bp, Homo sapiens
  misc_feature: GYAE6OF02JDNC9.9.70.G04.1.454.CMB.1.raw
  modified_base (289)..(289): a, c, t, g, unknown or other
  misc_feature (289)..(289): n is a, c, g, or t
  modified_base (362)..(362): a, c, t, g, unknown or other
  misc_feature (362)..(362): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgccactgtctcgtggtgactccatcagaggtcggtcttcctactggacctggactccggcagtccgccggnaagggctgggatatagttggacgtaatctatgaccaggtgggacctccatacctaccaaacccgttcccctanaaagcgttacgagtccagcaattggtacacggttccgaacgtacccgtacccgaacgaaacccgtagtttccctaccgtacgtaaccgtaaggttacgtaagtttaaacgtacgttaccggtacccgtcccggacaaccggaaccgaacccgggtccgttagttaaccgtttaccgtacgtttcggaacggtacgaacgggtaaccggttaccgtttaagttttaaccgggacttaacggtacttaaaaccggttaaaaacttccgtaaaccgttaccggttacgtacggtaaccggttcggtaccggggacccgtacgggggtaacccgtaaacggg

SEQ ID NO: 247100 - DNA, 781 bp, Homo sapiens
  misc_feature: GYAE6OF02I8XN8.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtgttcatcctcctcctggtggcagctcccagatgggtcctgtcccaggtgcggctgcaggagtccgggcccaggactagtgaagccttcacacggccctgtccctcacctgcactgtctctgggtcacctccatcgaggtagggttcggttccgttacctacgtcgggtaccgtggtacgtcccggacctacggtccccggcccggacgaacggggtctaggggtaacgttattagtacgggacgtaaacttccgttaacggtcggtaccgacgggttacggggaccccgtaccctacgttacccgtaaccccgtaacccccggttaccctacggaaacggtaccggttacggtacggtaacgacgtacgtaagttcgtaaccgtacggttcccgaacccgtacccgtacccgaacggtaaacccttaccggtttcccttacccgtacggaaccgtacggttacgttaacgtttacgttaacgttaccggacccggacccgtacgaaccggaccgtaccgggtaccgtagttacgttaccgtaggtcggacggtaacgtacgggtacgttaaccggtttagtttaccggactcggtacttaacggttaaaccttcgtaaccgtacggttcgtacggtcgttacggcgggaaccgtacgggaaccgtaaccgg

SEQ ID NO: 247101 - DNA, 697 bp, Homo sapiens
  misc_feature: GYAE6OF02JHPTK.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtgtcgttcctactcggacctggactccggcacgtcccggccggacgaaggggactgggagttatagttcggaacgtaattcctagtcgacccgtaggtcgggaccctcctacgtacctaacccgaacccgttccctacgaaaggtacgttccgagtcagctagtcgacaggtcaacgaccgtacccaacgtaaccctacgttccctacccgtagacgtacgtcgtaacgttacgtacgtacgacccgccgtaccgaacgtaccgaccgggtccgttaggttaacttacgtacgtcggacggaacggtaaggtacggttaccgtttacgtttaaccggaccgtaaggttaccgtttaaacgttaaaacccgttccgttaaccgttaccgggtaccgttaacgggaccggttaccggtacgggggacccggttaacggggaccgttaaccggg

SEQ ID NO: 247102 - DNA, 830 bp, Homo sapiens
  misc_feature: GYAE6OF02GRK4A.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacgacggccctgtccctcacctgccatgtctcgtggtgtactccatcgaggtaggttggtccgttcctacgtcggtacctggacttccgggctacggtcccggccggacgaaacggggtaccttaggggaacgttattacggttacgggaaacgtaacgttactaggtcgacccggtaggttaccggggacccctaccgtacttacccgttaaaccccgaacccccggttaccctaccgaaaaggtcggttaaccggagttaccgacgtacgtacgttacggtacgacggttacccaacgtaccccgtacccgaaacgtaaacccgtacgtttaccctaccccgttacggacttacgggtacgttaacggttaacgttacgtacccggtaacccggtccgaaccgacggtacccgtaccgggtcccgttaagttacgtttacgtacgggtacggaccgtaaggaacggttaacggttaaccggttttaacgtttaacccgggaacgttacggttaaccgttaaacgttttaaaaccgttacccgtttaaccgggtaaccggttaccggtttacgggtaaccggttacgggtacccggggtacccggtaaacgggggtacccttaaacccggg

SEQ ID NO: 247103 - DNA, 569 bp, Homo sapiens
  misc_feature: GYAE6OF02ICKY4.9.70.G04.1.454.CMB.1.raw
  modified_base (340)..(340): a, c, t, g, unknown or other
  misc_feature (340)..(340): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (464)..(464): a, c, t, g, unknown or other
  misc_feature (464)..(464): n is a, c, g, or t
  modified_base (532)..(532): a, c, t, g, unknown or other
  misc_feature (532)..(532): n is a, c, g, or t
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcggcccaggactagtgaagccttcacaggccctgtccctcacctgcactgtctctggtgactcatcaggaggtggtcgttcctactggacctgggactccggcacggtcccgccggacgaaggggctggagttatagttggaacgatctatcgccaggtcgggaccncatactaccaaaccccgtccctagaaagcgtacgagtcagcatgcagtcacacgtccagacccngttccncctgacagtatacgttanatcgacccgcncacgaccacgggcgtagtacttacngtgcgagacgacggttacctttagtttacgacctagtacctaagttaaacctccgttacgtaccggtntcgggacttcggtacgggaccgacggggacctaacgg

SEQ ID NO: 247104 - DNA, 553 bp, Homo sapiens
  misc_feature: GYAE6OF02FJ2MG.9.70.G04.1.454.CMB.1.raw
tcagtgatacgtctcacgaccggtgctcgatttagtgtagtgtgaagggaaagggcctgtgaaggcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtccgttcctactggacctggatccggcagtccgccggcaaggctggagtatattggacgaatctatgccagtcgggaccgccatcctacaaccccgtccctacgaagacgtcgagtcagcatgtcagtcgacaccgtacccacgaaccagttcctccctgacagtgtacgttatatcgaccgccgacagaccacggcgtgtattactgtgcgtagagtacggtcgttagtttacgacagacgttaacgttaaacctcctaactacggtcgtacggacgtcgtcgggccgacgggaccgtaacgg
